United States Patent
Fotin-Mleczek et al.

(10) Patent No.: US 11,596,699 B2
(45) Date of Patent: Mar. 7, 2023

(54) RNA ENCODING AN ANTIBODY

(71) Applicant: CureVac SE, Tübingen (DE)

(72) Inventors: Mariola Fotin-Mleczek, Sindelfingen (DE); Ingmar Hoerr, Stuttgart (DE)

(73) Assignee: CureVac SE, Tübingen (DE)

( * ) Notice: Subject to any disclaimer, the term of this patent is extended or adjusted under 35 U.S.C. 154(b) by 893 days.

(21) Appl. No.: 16/097,084

(22) PCT Filed: Apr. 28, 2017

(86) PCT No.: PCT/EP2017/060226
§ 371 (c)(1),
(2) Date: Oct. 26, 2018

(87) PCT Pub. No.: WO2017/186928
PCT Pub. Date: Nov. 2, 2017

(65) Prior Publication Data
US 2020/0023076 A1   Jan. 23, 2020

(30) Foreign Application Priority Data
Apr. 29, 2016   (WO) .................. PCT/EP2016/059711

(51) Int. Cl.
| | | |
|---|---|---|
| A61K 48/00 | (2006.01) | |
| C07K 16/10 | (2006.01) | |
| C07K 16/12 | (2006.01) | |
| C07K 16/28 | (2006.01) | |
| C07K 16/32 | (2006.01) | |
| C12N 15/85 | (2006.01) | |
| A61K 39/00 | (2006.01) | |

(52) U.S. Cl.
CPC .......... *A61K 48/0066* (2013.01); *C07K 16/10* (2013.01); *C07K 16/1018* (2013.01); *C07K 16/1027* (2013.01); *C07K 16/1045* (2013.01); *C07K 16/1282* (2013.01); *C07K 16/2803* (2013.01); *C07K 16/2809* (2013.01); *C07K 16/2863* (2013.01); *C07K 16/2887* (2013.01); *C07K 16/32* (2013.01); *C12N 15/85* (2013.01); *A61K 2039/505* (2013.01); *C07K 2317/31* (2013.01); *C07K 2317/52* (2013.01); *C07K 2317/565* (2013.01)

(58) Field of Classification Search
None
See application file for complete search history.

(56) References Cited

U.S. PATENT DOCUMENTS

| | | |
|---|---|---|
| 2005/0032730 A1 | 2/2005 | Von der Mulbe et al. |
| 2005/0059624 A1 | 3/2005 | Hoerr et al. |
| 2005/0250723 A1 | 11/2005 | Hoerr et al. |
| 2006/0188490 A1 | 8/2006 | Hoerr et al. |
| 2008/0025944 A1 | 1/2008 | Hoerr et al. |
| 2008/0267873 A1 | 10/2008 | Hoerr et al. |
| 2009/0324584 A1 | 12/2009 | Hoerr et al. |
| 2010/0048883 A1 | 2/2010 | Ketterer et al. |
| 2010/0189729 A1 | 7/2010 | Hoerr et al. |
| 2010/0203076 A1 | 8/2010 | Fotin-Mleczek et al. |
| 2010/0291156 A1 | 11/2010 | Barner et al. |
| 2010/0305196 A1 | 12/2010 | Probst et al. |
| 2011/0053829 A1 | 3/2011 | Baumhof et al. |
| 2011/0250225 A1 | 10/2011 | Fotin-Mleczek et al. |
| 2012/0021043 A1 | 1/2012 | Kramps et al. |
| 2012/0258046 A1 | 10/2012 | Mutzke |
| 2013/0129754 A1 | 5/2013 | Thess et al. |
| 2013/0142818 A1 | 6/2013 | Baumhof et al. |
| 2013/0259879 A1 | 10/2013 | Baumhof et al. |
| 2013/0280283 A1 | 10/2013 | Lorenz et al. |
| 2013/0295043 A1 | 11/2013 | Kallen et al. |
| 2013/0336998 A1 | 12/2013 | Kallen et al. |
| 2015/0037326 A1 | 2/2015 | Butler-Ransohoff et al. |
| 2015/0050302 A1 | 2/2015 | Thess |
| 2015/0057340 A1 | 2/2015 | Thess et al. |
| 2015/0093413 A1 | 4/2015 | Thess et al. |
| 2015/0118183 A1 | 4/2015 | Baumhof |
| 2015/0118264 A1 | 4/2015 | Baumhof et al. |
| 2015/0165006 A1 | 6/2015 | Thess et al. |
| 2015/0184195 A1 | 7/2015 | Thess et al. |
| 2015/0218554 A1 | 8/2015 | Thess |
| 2015/0306249 A1 | 10/2015 | Baumhof et al. |
| 2015/0320847 A1 | 11/2015 | Thess et al. |
| 2016/0130345 A1 | 5/2016 | Fotin-Mleczek et al. |
| 2016/0166668 A1 | 6/2016 | Kallen et al. |
| 2016/0166678 A1 | 6/2016 | Kallen et al. |
| 2016/0166710 A1 | 6/2016 | Baumhof |

(Continued)

FOREIGN PATENT DOCUMENTS

| | | |
|---|---|---|
| WO | WO 2008/083949 | 7/2008 |
| WO | WO 2013/151671 | 10/2013 |
| WO | WO 2016/059602 | 4/2016 |
| WO | WO 2016/184576 | 11/2016 |
| WO | WO 2017/021546 | 2/2017 |
| WO | WO 2017/025447 | 2/2017 |
| WO | WO 2017/064146 | 4/2017 |
| WO | WO 2017/081110 | 5/2017 |
| WO | WO 2017/109134 | 6/2017 |
| WO | WO 2017/137095 | 8/2017 |

(Continued)

OTHER PUBLICATIONS

He, M e tal., Oncotarget, 2017: vol. 8: pp. 67129-67139.*

(Continued)

*Primary Examiner* — Michael D Burkhart
(74) *Attorney, Agent, or Firm* — Parker Highlander PLLC

(57) ABSTRACT

The present invention relates to a RNA encoding an antibody or a fragment or variant thereof and a composition, in particular a passive vaccine, comprising such an RNA. The present invention further relates to the use of such an RNA or of such a composition for treatment of tumours and cancer diseases, cardiovascular diseases, infectious diseases, autoimmune diseases, virus diseases and monogenetic diseases, e.g. also in gene therapy. The present invention also relates to a combination of at least two modified RNA's, in particular wherein one RNA encodes a heavy chain variable region of an antibody and another RNA encodes the corresponding light chain variable region of said antibody.

19 Claims, 50 Drawing Sheets

Specification includes a Sequence Listing.

(56) References Cited

U.S. PATENT DOCUMENTS

| | | |
|---|---|---|
| 2016/0166711 A1 | 6/2016 | Schnee et al. |
| 2016/0168207 A1 | 6/2016 | Kramps et al. |
| 2016/0168227 A1 | 6/2016 | Kallen et al. |
| 2016/0235864 A1 | 8/2016 | Schlake et al. |
| 2016/0304883 A1 | 10/2016 | Grund et al. |
| 2016/0304938 A1 | 10/2016 | Wochner |
| 2016/0326575 A1 | 11/2016 | Von Der Mulbe |
| 2016/0331844 A1 | 11/2016 | Fotin-Mleczek et al. |
| 2017/0014496 A1 | 1/2017 | Fotin-Mleczek et al. |
| 2017/0029847 A1 | 2/2017 | Thess |
| 2017/0114378 A1 | 4/2017 | Wochner et al. |
| 2017/0252430 A1 | 9/2017 | Fotin-Mleczek et al. |
| 2017/0326225 A1 | 11/2017 | Rauch et al. |
| 2018/0044687 A1 | 2/2018 | Thess et al. |
| 2018/0125952 A1 | 5/2018 | Fotin-Mleczek et al. |
| 2018/0126003 A1 | 5/2018 | Hoerr |
| 2018/0142275 A1 | 5/2018 | Roos et al. |
| 2018/0147146 A1 | 5/2018 | Eber et al. |
| 2018/0148727 A1 | 5/2018 | Grund et al. |
| 2018/0201967 A1 | 7/2018 | Eber et al. |
| 2018/0208957 A1 | 7/2018 | Roos et al. |
| 2018/0214537 A1 | 8/2018 | Mutzke et al. |
| 2018/0237786 A1 | 8/2018 | Schlake et al. |
| 2018/0237817 A1 | 8/2018 | Roos et al. |
| 2018/0243219 A1 | 8/2018 | Ketterer et al. |
| 2018/0296663 A1 | 10/2018 | Hipp et al. |
| 2018/0298372 A1 | 10/2018 | Funkner et al. |
| 2018/0312545 A1 | 11/2018 | Baumhof et al. |
| 2018/0371392 A1 | 12/2018 | Mayer et al. |
| 2019/0010485 A1 | 1/2019 | Yazdan Panah et al. |
| 2019/0017100 A1 | 1/2019 | Wochner et al. |
| 2019/0024096 A1 | 1/2019 | Schmid et al. |

FOREIGN PATENT DOCUMENTS

| | | |
|---|---|---|
| WO | WO 2017/140345 | 8/2017 |
| WO | WO 2017/140905 | 8/2017 |
| WO | WO 2017/149139 | 9/2017 |
| WO | WO 2017/162297 | 9/2017 |
| WO | WO 2017/182634 | 10/2017 |
| WO | WO 2017/191258 | 11/2017 |
| WO | WO 2017/191264 | 11/2017 |
| WO | WO 2017/191274 | 11/2017 |
| WO | WO 2017/203008 | 11/2017 |
| WO | WO 2017/212006 | 12/2017 |
| WO | WO 2017/212007 | 12/2017 |
| WO | WO 2017/212009 | 12/2017 |
| WO | WO 2019/008001 | 1/2019 |

OTHER PUBLICATIONS

International Search Report and Written Opinion issued in corresponding PCT Application No. PCT/EP2017/060226, dated Sep. 18, 2017.

Proudfoot, "3' Non-coding region sequences in eukaryotic messenger RNA", *Nature*, 263:211-214, 1976.

* cited by examiner

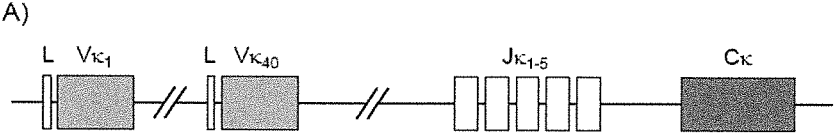
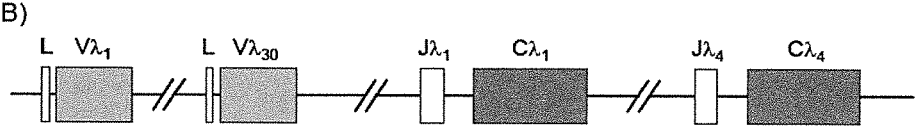
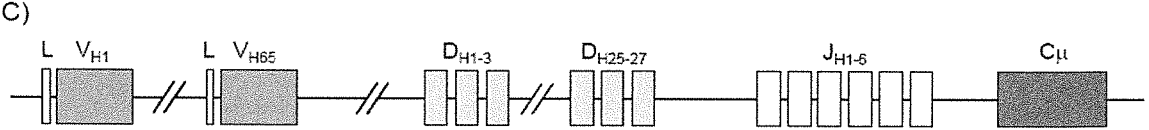
Fig. 2

| Fragment | Structure |
|---|---|
| F(ab')$_2$ | 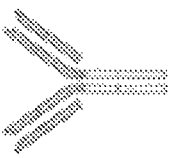 |
| Fab' | 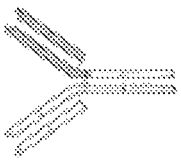 |
| Fab | 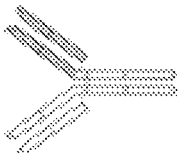 |
| Fc | 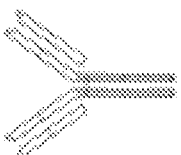 |
| Facb | 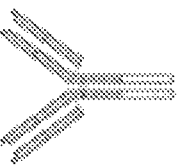 |
| pFc' | 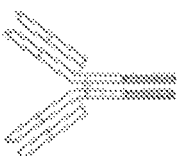 |
| Fd | 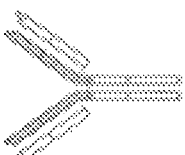 |
| Fv | 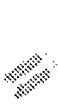 |
Fig. 4

Signal peptid = Signal peptide
CAG GCG TAT CTG CAG CAG AGC GGC GCG GAA CTG GTG CGC CCG GGC GCG
AGC GTG AAA ATG AGC TGC AAA GCG AGC GGC TAT ACC TTT ACC AGC TAT
AAC ATG CAT TGG GTG AAA CAG ACC CCG CGC CAG GGC CTG GAA TGG ATT
GGC GCG ATT TAT CCG GGC AAC GGC GAT ACC AGC TAT AAC CAG AAA TTT
AAA GGC AAA GCG ACC CTG ACC GTG GAT AAA AGC AGC AGC ACC GCG TAT
ATG CAG CTG AGC AGC CTG ACC AGC GAA GAT AGC GCG GTG TAT TTT TGC
GCG CGC GTG GTG TAT TAT AGC AAC AGC TAT TGG TAT TTT GAT GTG TGG
GGC ACC GGC ACC ACC GTG ACC GTG AGC GGC CCG AGC GTG TTT CCG CTG
GCG CCG AGC AGC AAA AGC ACC AGC GGC GGC ACC GCG GCG CTG GGC TGC
CTG GTG AAA GAT TAT TTT CCG GAA CCG GTG ACC GTG AGC TGG AAC AGC
GGC GCG CTG ACC AGC GGC GTG CAT ACC TTT CCG GCG GTG CTG CAG AGC
AGC GGC CTG TAT AGC CTG AGC AGC GTG GTG ACC GTG CCG AGC AGC AGC
CTG GGC ACC CAG ACC TAT ATT TGC AAC GTG AAC CAT AAA CCG AGC AAC
ACC AAA GTG GAT AAA AAA GCG GAA CCG AAA AGC TGC GAT AAA ACC CAT
ACC TGC CCG CCG TGC CCG GCG CCG GAA CTG CTG GGC GGC CCG AGC GTG
TTT CTG TTT CCG CCG AAA CCG AAA GAT ACC CTG ATG ATT AGC CGC ACC
CCG GAA GTG ACC TGC GTG GTG GTG GAT GTG AGC CAT GAA GAT CCG GAA
GTG AAA TTT AAC TGG TAT GTG GAT GGC GTG GAA GTG CAT AAC GCG AAA
ACC AAA CCG CGC GAA GAA CAG TAT AAC AGC ACC TAT CGC GTG GTG AGC
GTG CTG ACC GTG CTG CAT CAG GAT TGG CTG AAC GGC AAA GAA TAT AAA
TGC AAA GTG AGC AAC AAA GCG CTG CCG GCG CCG ATT GAA AAA ACC ATT
AGC AAA GCG AAA GGC CAG CCG CGC GAA CCG CAG GTG TAT ACC CTG CCG
CCG AGC CGC GAT GAA CTG ACC AAA AAC CAG GTG AGC CTG ACC TGC CTG
GTG AAA GGC TTT TAT CCG AGC GAT ATT GCG GTG GAA TGG GAA AGC AAC
GGC CAG CCG GAA AAC AAC TAT AAA ACC ACC CCG CCG GTG CTG GAT AGC
GAT GGC AGC TTT TTT CTG TAT AGC AAA CTG ACC GTG GAT AAA AGC CGC
TGG CAG CAG GGC AAC GTG TTT AGC TGC AGC GTG ATG CAT GAA GCG CTG
CAT AAC CAT TAT ACC CAG AAA AGC CTG AGC CTG AGC CCG GGC AAA TAA

Fig. 8

```
CAG GCC TAC CTG CAG CAG AGC GGC GCG GAG CTC GTG CGG CCG GGG GCC
TCG GTC AAG ATG AGC TGC AAG GCC AGC GGC TAC ACC TTC ACG AGC TAC
AAC ATG CAC TGG GTG AAG CAG ACC CCG CGC CAG GGG CTG GAG TGG ATC
GGC GCC ATC TAC CCC GGG AAC GGC GAC ACC AGC TAC AAC CAG AAG TTC
AAG GGC AAG GCG ACC CTG ACG GTG GAC AAG TCG AGC AGC ACC GCC TAC
ATG CAG CTC AGC AGC CTG ACC TCG GAG GAC AGC GCC GTC TAC TTC TGC
GCC CGG GTG GTG TAC TAC AGC AAC AGC TAC TGG TAC TTC GAC GTC TGG
GGG ACC GGC ACG ACC GTG ACC GTG AGC GGG CCC AGC GTC TTC CCC CTG
GCC CCC TCG AGC AAG AGC ACC AGC GGC GGC ACG GCG GCC CTC GGG TGC
CTG GTG AAG GAC TAC TTC CCC GAG CCC GTG ACC GTC AGC TGG AAC TCG
GGC GCC CTG ACC AGC GGG GTG CAC ACC TTC CCG GCC GTG CTC CAG AGC
AGC GGC CTG TAC AGC CTG AGC TCG GTC GTG ACG GTG CCC AGC AGC AGC
CTC GGG ACC CAG ACC TAC ATC TGC AAC GTC AAC CAC AAG CCC AGC AAC
ACC AAG GTG GAC AAG AAG GCG GAG CCC AAG TCG TGC GAC AAG ACG CAC
ACC TGC CCG CCC TGC CCC GCC CCC GAG CTG CTG GGC GGC CCG AGC GTG
TTC CTC TTC CCG CCC AAG CCC AAG GAC ACC CTG ATG ATC AGC CGC ACC
CCC GAG GTC ACG TGC GTG GTG GTC GAC GTG AGC CAC GAG GAC CCC GAG
GTG AAG TTC AAC TGG TAC GTC GAC GGG GTG GAG GTG CAC AAC GCC AAG
ACC AAG CCC CGG GAG GAG CAG TAC AAC AGC ACC TAC CGC GTC GTG AGC
GTG CTG ACC GTC CTC CAC CAG GAC TGG CTG AAC GGC AAG GAG TAC AAG
TGC AAG GTG TCG AAC AAG GCC CTG CCG GCC CCC ATC GAG AAG ACG ATC
AGC AAG GCG AAG GGG CAG CCC CGG GAG CCC CAG GTG TAC ACC CTC CCG
CCC AGC CGC GAC GAG CTG ACC AAG AAC CAG GTC AGC CTG ACC TGC CTC
GTG AAG GGC TTC TAC CCC AGC GAC ATC GCC GTG GAG TGG GAG TCG AAC
GGG CAG CCC GAG AAC AAC TAC AAG ACG ACC CCG CCC GTC CTG GAC AGC
GAC GGC AGC TTC TTC CTG TAC AGC AAG CTC ACC GTG GAC AAG AGC CGG
TGG CAG CAG GGC AAC GTG TTC AGC TGC TCG GTC ATG CAC GAG GCC CTG
CAC AAC CAC TAC ACC CAG AAG AGC CTG AGC CTC AGC CCC GGG AAG TGA
```

Fig. 9

```
CAG ATT GTG CTG AGC CAG AGC CCG GCG ATT CTG AGC GCG AGC CCG GGC
GAA AAA GTG ACC ATG ACC TGC CGC GCG AGC AGC AGC GTG AGC TAT ATG
CAT TGG TAT CAG CAG AAA CCG GGC AGC AGC CCG AAA CCG TGG ATT TAT
GCG CCG AGC AAC CTG GCG AGC GGC GTG CCG GCG CGC TTT AGC GGC AGC
GGC AGC GGC ACC AGC TAT AGC CTG ACC ATT AGC CGC GTG GAA GCG GAA
GAT GCG GCG ACC TAT TAT TGC CAG CAG TGG AGC TTT AAC CCG CCG ACC
TTT GGC GCG GGC ACC AAA CTG GAA CTG AAA CGC ACC GTG GCG GCG CCG
AGC GTG TTT ATT TTT CCG CCG AGC GAT GAA CAG CTG AAA AGC GGC ACC
GCG AGC GTG GTG TGC CTG CTG AAC AAC TTT TAT CCG CGC GAA GCG AAA
GTG CAG TGG AAA GTG GAT AAC GCG CTG CAG AGC GGC AAC AGC CAG GAA
AGC GTG ACC GAA CAG GAT AGC AAA GAT AGC ACC TAT AGC CTG AGC AGC
ACC CTG ACC CTG AGC AAA GCG GAT TAT GAA AAA CAT AAA GTG TAT GCG
TGC GAA GTG ACC CAT CAG GGC CTG AGC AGC CCG GTG ACC AAA AGC TTT
AAC CGC TAA
```

Fig. 10

```
CAG ATC GTG CTG AGC CAG TCG CCG GCC ATC CTC AGC GCG AGC CCC GGC
GAG AAG GTC ACC ATG ACG TGC CGG GCC AGC AGC TCG GTG AGC TAC ATG
CAC TGG TAC CAG CAG AAG CCC GGG AGC AGC CCC AAG CCG TGG ATC TAC
GCC CCC AGC AAC CTG GCC TCG GGC GTG CCC GCG CGC TTC AGC GGG AGC
GGC AGC GGG ACC AGC TAC AGC CTG ACC ATC TCG CGG GTC GAG GCC GAG
GAC GCC GCC ACC TAC TAC TGC CAG CAG TGG AGC TTC AAC CCG CCC ACG
TTC GGC GCC GGC ACC AAG CTC GAG CTG AAG CGC ACC GTG GCG GCC CCC
AGC GTG TTC ATC TTC CCG CCC AGC GAC GAG CAG CTG AAG AGC GGG ACC
GCC TCG GTC GTG TGC CTC CTG AAC AAC TTC TAC CCC CGG GAG GCC AAG
GTG CAG TGG AAG GTC GAC AAC GCG CTG CAG AGC GGC AAC AGC CAG GAG
AGC GTG ACG GAG CAG GAC AGC AAG GAC AGC ACC TAC TCG CTC AGC AGC
ACC CTG ACC CTG AGC AAG GCC GAC TAC GAG AAG CAC AAG GTG TAC GCC
TGC GAG GTC ACG CAC CAG GGG CTC AGC TCG CCC GTG ACC AAG AGC TTC
AAC CGC TGA
```

Fig. 11

AAGCTTACCATGGCCGTGATGGCGCCGCGGACCCTGGTCCTCCTGCTGAGCGGCGCCCTCGCCCT
GACGCAGACCTGGGCCGGGCAGGCCTACCTGCAGCAGAGCGGCGCGGAGCTCGTGCGGCCGGGGG
CCTCGGTCAAGATGAGCTGCAAGGCCAGCGGCTACACCTTCACGAGCTACAACATGCACTGGGTG
AAGCAGACCCCGCGCCAGGGGCTGGAGTGGATCGGCGCCATCTACCCCGGGAACGGCGACACCAG
CTACAACCAGAAGTTCAAGGGCAAGGCGACCCTGACGGTGGACAAGTCGAGCAGCACCGCCTACA
TGCAGCTCAGCAGCCTGACCTCGGAGGACAGCGCCGTCTACTTCTGCGCCCGGGTGGTGTACTAC
AGCAACAGCTACTGGTACTTCGACGTCTGGGGGACCGGCACGACCGTGACCGTGAGCGGGCCCAG
CGTCTTCCCCCTGGCCCCCTCGAGCAAGAGCACCAGCGGCGGCACGGCGGCCCTCGGGTGCCTGG
TGAAGGACTACTTCCCCGAGCCCGTGACCGTCAGCTGGAACTCGGGCGCCCTGACCAGCGGGGTG
CACACCTTCCCGGCCGTGCTCCAGAGCAGCGGCCTGTACAGCCTGAGCTCGGTCGTGACGGTGCC
CAGCAGCAGCCTCGGGACCCAGACCTACATCTGCAACGTCAACCACAAGCCCAGCAACACCAAGG
TGGACAAGAAGGCGGAGCCCAAGTCGTGCGACAAGACGCACACCTGCCCGCCCTGCCCCGCCCCC
GAGCTGCTGGGCGGCCCGAGCGTGTTCCTCTTCCCGCCCAAGCCCAAGGACACCCTGATGATCAG
CCGCACCCCCGAGGTCACGTGCGTGGTGGTCGACGTGAGCCACGAGGACCCCGAGGTGAAGTTCA
ACTGGTACGTCGACGGGGTGGAGGTGCACAACGCCAAGACCAAGCCCCGGGAGGAGCAGTACAAC
AGCACCTACCGCGTCGTGAGCGTGCTGACCGTCCTCCACCAGGACTGGCTGAACGGCAAGGAGTA
CAAGTGCAAGGTGTCGAACAAGGCCCTGCCGGCCCCCATCGAGAAGACGATCAGCAAGGCGAAGG
GGCAGCCCCGGGAGCCCCAGGTGTACACCCTCCCGCCCAGCCGCGACGAGCTGACCAAGAACCAG
GTCAGCCTGACCTGCCTCGTGAAGGGCTTCTACCCCAGCGACATCGCCGTGGAGTGGGAGTCGAA
CGGGCAGCCCGAGAACAACTACAAGACGACCCCGCCCGTCCTGGACAGCGACGGCAGCTTCTTCC
TGTACAGCAAGCTCACCGTGGACAAGAGCCGGTGGCAGCAGGGCAACGTGTTCAGCTGCTCGGTC
ATGCACGAGGCCCTGCACAACCACTACACCCAGAAGAGCCTGAGCCTCAGCCCCGGGAAGCATCA
TCATCATCATCATTGACCAGATCTTTCTGACATTTCTGACATTTCTGACATTTCTGACATTTCTG
ACATTTCTGACATTTCTGACATTTCTGACATTTCTGACATTTCTGACATATGCATACCATGGCCG
TGATGGCGCCGCGGACCCTGGTCCTCCTGCTGAGCGGCGCCCTCGCCCTGACGCAGACCTGGGCC
GGGCAGATCGTGCTGAGCCAGTCGCCGGCCATCCTCAGCGCGAGCCCCGGCGAGAAGGTCACCAT
GACGTGCCGGGCCAGCAGCTCGGTGAGCTACATGCACTGGTACCAGCAGAAGCCCGGGAGCAGCC
CCAAGCCGTGGATCTACGCCCCCAGCAACCTGGCCTCGGGCGTGCCCGCGCGCTTCAGCGGGAGC
GGCAGCGGGACCAGCTACAGCCTGACCATCTCGCGGGTCGAGGCCGAGGACGCCGCCACCTACTA
CTGCCAGCAGTGGAGCTTCAACCCGCCCACGTTCGGCGCCGGCACCAAGCTCGAGCTGAAGCGCA
CCGTGGCGGCCCCCAGCGTGTTCATCTTCCCGCCCAGCGACGAGCAGCTGAAGAGCGGGACCGCC
TCGGTCGTGTGCCTCCTGAACAACTTCTACCCCGGGGAGGCCAAGGTGCAGTGGAAGGTCGACAA
CGCGCTGCAGAGCGGCAACAGCCAGGAGAGCGTGACGGAGCAGGACAGCAAGGACAGCACCTACT
CGCTCAGCAGCACCCTGACCCTGAGCAAGGCCGACTACGAGAAGCACAAGGTGTACGCCTGCGAG
GTCACGCACCAGGGGCTCAGCTCGCCCGTGACCAAGAGCTTCAACCGCTGACCACTAGT

Fig. 12

```
CAG GTG CAG CTG AAA CAG AGC GGC CCG GGC CTG GTG CAG CCG AGC CAG
AGC CTG AGC ATT ACC TGC ACC GTG AGC GGC TTT AGC CTG ACC AAC TAT
GGC GTG CAT TGG GTG CGC CAG AGC CCG GGC AAA GGC CTG GAA TGG CTG
GGC GTG ATT TGG AGC GGC GGC AAC ACC GAT TAT AAC ACC CCG TTT ACC
AGC CGC CTG AGC ATT AAC AAA GAT AAC AGC AAA AGC CAG GTG TTT TTT
AAA ATG AAC AGC CTG CAG AGC AAC GAT ACC GCG ATT TAT TAT TGC GCG
CGC GCG CTG ACC TAT TAT GAT TAT GAA TTT GCG TAT TGG GGC CAG GGC
ACC CTG GTG ACC GTG AGC GCG GCG AGC ACC AAA GGC CCG AGC GTG TTT
CCG CTG GCG CCG AGC AGC AAA AGC ACC AGC GGC GGC ACC GCG GCG CTG
GGC TGC CTG GTG AAA GAT TAT TTT CCG GAA CCG GTG ACC GTG AGC TGG
AAC AGC GGC GCG CTG ACC AGC GGC GTG CAT ACC TTT CCG GCG GTG CTG
CAG AGC AGC GGC CTG TAT AGC CTG AGC AGC GTG GTG ACC GTG CCG AGC
AGC AGC CTG GGC ACC CAG ACC TAT ATT TGC AAC GTG AAC CAT AAA CCG
AGC AAC ACC AAA GTG GAT AAA CGC GTG GAA CCG AAA AGC CCG AAA AGC
TGC GAT AAA ACC CAT ACC TGC CCG CCG TGC CCG GCG CCG GAA CTG CTG
GGC GGC CCG AGC GTG TTT CTG TTT CCG CCG AAA CCG AAA GAT ACC CTG
ATG ATT AGC CGC ACC CCG GAA GTG ACC TGC GTG GTG GTG GAT GTG AGC
CAT GAA GAT CCG GAA GTG AAA TTT AAC TGG TAT GTG GAT GGC GTG GAA
GTG CAT AAC GCG AAA ACC AAA CCG CGC GAA GAA CAG TAT AAC AGC ACC
TAT CGC GTG GTG AGC GTG CTG ACC GTG CTG CAT CAG GAT TGG CTG AAC
GGC AAA GAA TAT AAA TGC AAA GTG AGC AAC AAA GCG CTG CCG GCG CCG
ATT GAA AAA ACC ATT AGC AAA GCG AAA GGC CAG CCG CGC GAA CCG CAG
GTG TAT ACC CTG CCG CCG AGC CGC GAT GAA CTG ACC AAA AAC CAG GTG
AGC CTG ACC TGC CTG GTG AAA GGC TTT TAT CCG AGC GAT ATT GCG GTG
GAA TGG GAA AGC AAC GGC CAG CCG GAA AAC AAC TAT AAA ACC ACC CCG
CCG GTG CTG GAT AGC GAT GGC AGC TTT TTT CTG TAT AGC AAA CTG ACC
GTG GAT AAA AGC CGC TGG CAG CAG GGC AAC GTG TTT AGC TGC AGC GTG
ATG CAT GAA GCG CTG CAT AAC CAT TAT ACC CAG AAA AGC CTG AGC CTG
AGC CCG GGC AAA TAA
```

Fig. 13

```
CAG GTG CAG CTG AAG CAG AGC GGC CCG GGG CTC GTC CAG CCC TCG CAG
AGC CTG AGC ATC ACC TGC ACG GTG AGC GGC TTC AGC CTG ACC AAC TAC
GGG GTG CAC TGG GTC CGG CAG TCG CCC GGC AAG GGG CTC GAG TGG CTG
GGC GTG ATC TGG AGC GGC GGG AAC ACC GAC TAC AAC ACC CCC TTC ACG
AGC CGC CTG AGC ATC AAC AAG GAC AAC AGC AAG TCG CAG GTG TTC TTC
AAG ATG AAC AGC CTC CAG AGC AAC GAC ACC GCC ATC TAC TAC TGC GCG
CGG GCC CTG ACC TAC TAC GAC TAC GAG TTC GCC TAC TGG GGC CAG GGG
ACC CTG GTC ACG GTG AGC GCC GCG AGC ACC AAG GGC CCG AGC GTG TTC
CCC CTC GCC CCC TCG AGC AAG AGC ACC AGC GGC GGG ACC GCC GCC CTG
GGC TGC CTG GTC AAG GAC TAC TTC CCC GAG CCG GTG ACG GTG AGC TGG
AAC TCG GGG GCC CTC ACC AGC GGC GTC CAC ACC TTC CCC GCG GTG CTG
CAG AGC AGC GGG CTG TAC AGC CTC AGC TCG GTG GTC ACC GTG CCC AGC
AGC AGC CTG GGC ACG CAG ACC TAC ATC TGC AAC GTG AAC CAC AAG CCC
AGC AAC ACC AAG GTC GAC AAG CGC GTG GAG CCG AAG TCG CCC AAG AGC
TGC GAC AAG ACC CAC ACG TGC CCG CCC TGC CCC GCC CCC GAG CTG CTC
GGC GGG CCC AGC GTG TTC CTG TTC CCG CCC AAG CCC AAG GAC ACC CTG
ATG ATC AGC CGG ACC CCC GAG GTC ACC TGC GTG GTG GTC GAC GTG AGC
CAC GAG GAC CCG GAG GTG AAG TTC AAC TGG TAC GTC GAC GGC GTG GAG
GTG CAC AAC GCC AAG ACG AAG CCC CGC GAG GAG CAG TAC AAC AGC ACC
TAC CGG GTC GTG TCG GTG CTC ACC GTC CTG CAC CAG GAC TGG CTG AAC
GGG AAG GAG TAC AAG TGC AAG GTG AGC AAC AAG GCC CTC CCC GCG CCC
ATC GAG AAG ACC ATC AGC AAG GCC AAG GGC CAG CCG CGC GAG CCC CAG
GTG TAC ACG CTG CCC CCC AGC CGG GAC GAG CTG ACC AAG AAC CAG GTC
AGC CTC ACC TGC CTG GTG AAG GGG TTC TAC CCG TCG GAC ATC GCC GTG
GAG TGG GAG AGC AAC GGC CAG CCC GAG AAC AAC TAC AAG ACC ACG CCC
CCG GTC CTG GAC AGC GAC GGC AGC TTC TTC CTC TAC AGC AAG CTG ACC
GTG GAC AAG AGC CGC TGG CAG CAG GGG AAC GTG TTC TCG TGC AGC GTC
ATG CAC GAG GCC CTG CAC AAC CAC TAC ACC CAG AAG AGC CTC AGC CTG
AGC CCC GGC AAG TGA
```

Fig. 14

GAT ATT CTG CTG ACC CAG AGC CCG GTG ATT CTG AGC GTG AGC CCG GGC
GAA CGC GTG AGC TTT AGC TGC CGC GCG AGC CAG AGC ATT GGC ACC AAC
ATT CAT TGG TAT CAG CAG CGC ACC AAC GGC AGC CCG CGC CTG CTG ATT
AAA TAT GCG AGC GAA AGC ATT AGC GGC ATT CCG AGC CGC TTT AGC GGC
AGC GGC AGC GGC ACC GAT TTT ACC CTG AGC ATT AAC AGC GTG GAA AGC
GAA GAT ATT GCG GAT TAT TAT TGC CAG CAG AAC AAC AAC TGG CCG ACC
ACC TTT GGC GCG GGC ACC AAA CTG GAA CTG AAA CGC ACC GTG GCG GCG
CCG AGC GTG TTT ATT TTT CCG CCG AGC GAT GAA CAG CTG AAA AGC GGC
ACC GCG AGC GTG GTG TGC CTG CTG AAC AAC TTT TAT CCG CGC GAA GCG
AAA GTG CAG TGG AAA GTG GAT AAC GCG CTG CAG AGC GGC AAC AGC CAG
GAA AGC GTG ACC GAA CAG GAT AGC AAA GAT AGC ACC TAT AGC CTG AGC
AGC ACC CTG ACC CTG AGC AAA GCG GAT TAT GAA AAA CAT AAA GTG TAT
GCG TGC GAA GTG ACC CAT CAG GGC CTG AGC AGC CCG GTG ACC AAA AGC
TTT AAC CGC GGC GCG TAA

Fig. 15

```
GAC ATC CTG CTC ACC CAG AGC CCG GTG ATC CTG TCG GTC AGC CCC GGC
GAG CGG GTG AGC TTC AGC TGC CGC GCC AGC CAG TCG ATC GGG ACG AAC
ATC CAC TGG TAC CAG CAG CGG ACC AAC GGC AGC CCC CGC CTG CTC ATC
AAG TAC GCG AGC GAG AGC ATC AGC GGG ATC CCC TCG CGG TTC AGC GGC
AGC GGG AGC GGC ACC GAC TTC ACC CTG AGC ATC AAC AGC GTG GAG TCG
GAG GAC ATC GCC GAC TAC TAC TGC CAG CAG AAC AAC AAC TGG CCG ACG
ACC TTC GGC GCC GGG ACC AAG CTG GAG CTC AAG CGC ACC GTC GCC GCG
CCC AGC GTG TTC ATC TTC CCG CCC AGC GAC GAG CAG CTG AAG AGC GGC
ACG GCC AGC GTG GTC TGC CTG CTC AAC AAC TTC TAC CCC CGG GAG GCC
AAG GTG CAG TGG AAG GTG GAC AAC GCC CTG CAG TCG GGG AAC AGC CAG
GAG AGC GTC ACC GAG CAG GAC AGC AAG GAC AGC ACC TAC AGC CTG TCG
AGC ACC CTC ACG CTG AGC AAG GCC GAC TAC GAG AAG CAC AAG GTG TAC
GCG TGC GAG GTG ACC CAC CAG GGC CTG AGC AGC CCC GTC ACC AAG TCG
TTC AAC CGC GGC GCC TGA
```

Fig. 16

AAGCTTACCATG*GCCGTGATGGCGCCGCGGACCCTGGTCCTCCTGCTGAGCGGCGCCCTCGCCCT*
*GACGCAGACCTGGGCCGGG*CAGGTGCAGCTGAAGCAGAGCGGCCCGGGGCTCGTCCAGCCCTCGC
AGAGCCTGAGCATCACCTGCACGGTGAGCGGCTTCAGCCTGACCAACTACGGGGTGCACTGGGTC
CGGCAGTCGCCCGGCAAGGGGCTCGAGTGGCTGGGCGTGATCTGGAGCGGCGGGAACACCGACTA
CAACACCCCCTTCACGAGCCGCCTGAGCATCAACAAGGACAACAGCAAGTCGCAGGTGTTCTTCA
AGATGAACAGCCTCCAGAGCAACGACACCGCCATCTACTACTGCGCGCGGGCCCTGACCTACTAC
GACTACGAGTTCGCCTACTGGGGCCAGGGGACCCTGGTCACGGTGAGCGCCGCGAGCACCAAGGG
CCCGAGCGTGTTCCCCCTCGCCCCCTCGAGCAAGAGCACCAGCGGCGGGACCGCCGCCCTGGGCT
GCCTGGTCAAGGACTACTTCCCCGAGCCGGTGACGGTGAGCTGGAACTCGGGGGCCCTCACCAGC
GGCGTCCACACCTTCCCCGCGGTGCTGCAGAGCAGCGGGCTGTACAGCCTCAGCTCGGTGGTCAC
CGTGCCCAGCAGCAGCCTGGGCACGCAGACCTACATCTGCAACGTGAACCACAAGCCCAGCAACA
CCAAGGTCGACAAGCGCGTGGAGCCGAAGTCGCCCAAGAGCTGCGACAAGACCCACACGTGCCCG
CCCTGCCCCGCCCCCGAGCTGCTCGGCGGGCCCAGCGTGTTCCTGTTCCCGCCCAAGCCCAAGGA
CACCCTGATGATCAGCCGGACCCCCGAGGTCACCTGCGTGGTGGTCGACGTGAGCCACGAGGACC
CGGAGGTGAAGTTCAACTGGTACGTCGACGGCGTGGAGGTGCACAACGCCAAGACGAAGCCCCGC
GAGGAGCAGTACAACAGCACCTACCGGGTCGTGTCGGTGCTCACCGTCCTGCACCAGGACTGGCT
GAACGGGAAGGAGTACAAGTGCAAGGTGAGCAACAAGGCCCTCCCCGCGCCCATCGAGAAGACCA
TCAGCAAGGCCAAGGGCCAGCCGCGCGAGCCCCAGGTGTACACGCTGCCCCCAGCCGGGACGAG
CTGACCAAGAACCAGGTCAGCCTCACCTGCCTGGTGAAGGGGTTCTACCCGTCGGACATCGCCGT
GGAGTGGGAGAGCAACGGCCAGCCCGAGAACAACTACAAGACCACGCCCCCGGTCCTGGACAGCG
ACGGCAGCTTCTTCCTCTACAGCAAGCTGACCGTGGACAAGAGCCGCTGGCAGCAGGGGAACGTG
TTCTCGTGCAGCGTCATGCACGAGGCCCTGCACAACCACTACACCCAGAAGAGCCTCAGCCTGAG
CCCCGGCAAGCATCATCATCATCATCATTGACCAGATCTTTCTGACATTTCTGACATTTCTGACA
TTTCTGACATTTCTGACATTTCTGACATTTCTGACATTTCTGACATTTCTGACATTTCTGACATA
TGCATACC*ATG**GCCGTGATGGCGCCGCGGACCCTGGTCCTCCTGCTGAGCGGCGCCCTCGCCCTG*
*ACGCAGACCTGGGCCGGGG*ACATCCTGCTCACCCAGAGCCCGGTGATCCTGTCGGTCAGCCCCGG
CGAGCGGGTGAGCTTCAGCTGCCGCGCCAGCCAGTCGATCGGGACGAACATCCACTGGTACCAGC
AGCGGACCAACGGCAGCCCCCGCCTGCTCATCAAGTACGCGAGCGAGAGCATCAGCGGGATCCCC
TCGCGGTTCAGCGGCAGCGGGAGCGGCACCGACTTCACCCTGAGCATCAACAGCGTGGAGTCGGA
GGACATCGCCGACTACTACTGCCAGCAGAACAACAACTGGCCGACGACCTTCGGCGCCGGGACCA
AGCTGGAGCTCAAGCGCACCGTCGCCGCGCCCAGCGTGTTCATCTTCCCGCCCAGCGACGAGCAG
CTGAAGAGCGGCACGGCCAGCGTGGTCTGCCTGCTCAACAACTTCTACCCCGGGAGGCCAAGGT
GCAGTGGAAGGTGGACAACGCCCTGCAGTCGGGGAACAGCCAGGAGAGCGTCACCGAGCAGGACA
GCAAGGACAGCACCTACAGCCTGTCGAGCACCCTCACGCTGAGCAAGGCCGACTACGAGAAGCAC
AAGGTGTACGCGTGCGAGGTGACCCACCAGGGCCTGAGCAGCCCCGTCACCAAGTCGTTCAACCG
CGGCGCCTGACCACTAGT

Fig. 17

```
GAA GTG CAG CTG GTG GAA AGC GGC GGC GGC CTG GTG CAG CCG GGC GGC
AGC CTG CGC CTG AGC TGC GCG GCG AGC GGC TTT AAC ATT AAA GAT ACC
TAT ATT CAT TGG GTG CGC CAG GCG CCG GGC AAA GGC CTG GAA TGG GTG
GCG CGC ATT TAT CCG ACC AAC GGC TAT ACC CGC TAT GCG GAT AGC GTG
AAA GGC CGC TTT ACC ATT AGC GCG GAT ACC AGC AAA AAC ACC GCG TAT
CTG CAG ATG AAC AGC CTG CGC GCG GAA GAT ACC GCG GTG TAT TAT TGC
AGC CGC TGG GGC GGC GAT GGC TTT TAT GCG ATG GAT TAT TGG GGC CAG
GGC ACC CTG GTG ACC GTG AGC AGC GCG AGC ACC AAA GGC CCG AGC GTG
TTT CCG CTG GCG CCG AGC AGC AAA AGC ACC AGC GGC GGC ACC GCG GCG
CTG GGC TGC CTG GTG AAA GAT TAT TTT CCG GAA CCG GTG ACC GTG AGC
TGG AAC AGC GGC GCG CTG ACC AGC GGC GTG CAT ACC TTT CCG GCG GTG
CTG CAG AGC AGC GGC CTG TAT AGC CTG AGC AGC GTG GTG ACC GTG CCG
AGC AGC AGC CTG GGC ACC CAG ACC TAT ATT TGC AAC GTG AAC CAT AAA
CCG AGC AAC ACC AAA GTG GAT AAA AAA GTG GAA CCG CCG AAA AGC TGC
GAT AAA ACC CAT ACC TGC CCG CCG TGC CCG GCG CCG GAA CTG CTG GGC
GGC CCG AGC GTG TTT CTG TTT CCG CCG AAA CCG AAA GAT ACC CTG ATG
ATT AGC CGC ACC CCG GAA GTG ACC TGC GTG GTG GTG GAT GTG AGC CAT
GAA GAT CCG GAA GTG AAA TTT AAC TGG TAT GTG GAT GGC GTG GAA GTG
CAT AAC GCG AAA ACC AAA CCG CGC GAA GAA CAG TAT AAC AGC ACC TAT
CGC GTG GTG AGC GTG CTG ACC GTG CTG CAT CAG GAT TGG CTG AAC GGC
AAA GAA TAT AAA TGC AAA GTG AGC AAC AAA GCG CTG CCG GCG CCG ATT
GAA AAA ACC ATT AGC AAA GCG AAA GGC CAG CCG CGC GAA CCG CAG GTG
TAT ACC CTG CCG CCG AGC CGC GAT GAA CTG ACC AAA AAC CAG GTG AGC
CTG ACC TGC CTG GTG AAA GGC TTT TAT CCG AGC GAT ATT GCG GTG GAA
TGG GAA AGC AAC GGC CAG CCG GAA AAC AAC TAT AAA ACC ACC CCG CCG
GTG CTG GAT AGC GAT GGC AGC TTT TTT CTG TAT AGC AAA CTG ACC GTG
GAT AAA AGC CGC TGG CAG CAG GGC AAC GTG TTT AGC TGC AGC GTG ATG
CAT GAA GCG CTG CAT AAC CAT TAT ACC CAG AAA AGC CTG AGC CTG AGC
CCG GGC AAA TAA
```

Fig. 18

```
GAG GTG CAG CTG GTC GAG AGC GGC GGG GGC CTC GTG CAG CCG GGC GGG
TCG CTG CGG CTG AGC TGC GCC GCG AGC GGG TTC AAC ATC AAG GAC ACC
TAC ATC CAC TGG GTG CGC CAG GCC CCC GGC AAG GGC CTC GAG TGG GTC
GCC CGG ATC TAC CCC ACG AAC GGG TAC ACC CGC TAC GCC GAC AGC GTG
AAG GGC CGG TTC ACC ATC AGC GCG GAC ACC TCG AAG AAC ACG GCC TAC
CTG CAG ATG AAC AGC CTG CGC GCC GAG GAC ACC GCC GTG TAC TAC TGC
AGC CGG TGG GGC GGC GAC GGG TTC TAC GCC ATG GAC TAC TGG GGG CAG
GGC ACC CTC GTC ACC GTG AGC AGC GCG TCG ACG AAG GGG CCC AGC GTG
TTC CCG CTG GCC CCC AGC AGC AAG AGC ACC AGC GGC GGG ACC GCC GCC
CTG GGC TGC CTC GTC AAG GAC TAC TTC CCC GAG CCC GTG ACC GTG TCG
TGG AAC AGC GGC GCG CTG ACG AGC GGG GTC CAC ACC TTC CCG GCC GTG
CTG CAG AGC AGC GGC CTC TAC TCG CTG AGC AGC GTG GTC ACC GTG CCC
AGC AGC AGC CTG GGG ACC CAG ACG TAC ATC TGC AAC GTG AAC CAC AAG
CCC TCG AAC ACC AAG GTC GAC AAG AAG GTG GAG CCC CCG AAG AGC TGC
GAC AAG ACC CAC ACC TGC CCG CCC TGC CCC GCC CCC GAG CTC CTG GGC
GGG CCC AGC GTG TTC CTG TTC CCG CCC AAG CCC AAG GAC ACG CTC ATG
ATC AGC CGC ACC CCC GAG GTC ACC TGC GTG GTG GTC GAC GTG AGC CAC
GAG GAC CCC GAG GTG AAG TTC AAC TGG TAC GTC GAC GGC GTG GAG GTG
CAC AAC GCC AAG ACC AAG CCG CGG GAG GAG CAG TAC AAC TCG ACG TAC
CGC GTC GTG AGC GTG CTG ACC GTC CTG CAC CAG GAC TGG CTC AAC GGC
AAG GAG TAC AAG TGC AAG GTG AGC AAC AAG GCC CTG CCC GCG CCC ATC
GAG AAG ACC ATC AGC AAG GCC AAG GGG CAG CCC CGG GAG CCG CAG GTG
TAC ACC CTG CCC CCC AGC CGC GAC GAG CTC ACG AAG AAC CAG GTC AGC
CTG ACC TGC CTG GTG AAG GGC TTC TAC CCC TCG GAC ATC GCC GTG GAG
TGG GAG AGC AAC GGG CAG CCG GAG AAC AAC TAC AAG ACC ACC CCG CCC
GTC CTC GAC AGC GAC GGC AGC TTC TTC CTG TAC AGC AAG CTG ACG GTG
GAC AAG TCG CGG TGG CAG CAG GGC AAC GTG TTC AGC TGC AGC GTC ATG
CAC GAG GCC CTC CAC AAC CAC TAC ACC CAG AAG AGC CTG AGC CTG AGC
CCC GGG AAG TGA
```

Fig. 19

```
GAT ATT CAG ATG ACC CAG AGC CCG AGC AGC CTG AGC GCG AGC GTG GGC
GAT CGC GTG ACC ATT ACC TGC CGC GCG AGC CAG GAT GTG AAC ACC GCG
GTG GCG TGG TAT CAG CAG AAA CCG GGC AAA GCG CCG AAA CTG CTG ATT
TAT AGC GCG AGC TTT CTG TAT AGC GGC GTG CCG AGC CGC TTT AGC GGC
AGC CGC AGC GGC ACC GAT TTT ACC CTG ACC ATT AGC AGC CTG CAG CCG
GAA GAT TTT GCG ACC TAT TAT TGC CAG CAG CAT TAT ACC ACC CCG CCG
ACC TTT GGC CAG GGC ACC AAA GTG GAA ATT AAA CGC ACC GTG GCG GCG
CCG AGC GTG TTT ATT TTT CCG CCG AGC GAT GAA CAG CTG AAA AGC GGC
ACC GCG AGC GTG GTG TGC CTG CTG AAC AAC TTT TAT CCG CGC GAA GCG
AAA GTG CAG TGG AAA GTG GAT AAC GCG CTG CAG AGC GGC AAC AGC CAG
GAA AGC GTG ACC GAA CAG GAT AGC AAA GAT AGC ACC TAT AGC CTG AGC
AGC ACC CTG ACC CTG AGC AAA GCG GAT TAT GAA AAA CAT AAA GTG TAT
GCG TGC GAA GTG ACC CAT CAG GGC CTG AGC AGC CCG GTG ACC AAA AGC
TTT AAC CGC GGC GAA TGC TAA
```

Fig. 20

```
GAC ATC CAG ATG ACC CAG AGC CCG TCG AGC CTG AGC GCC AGC GTG GGC
GAC CGG GTC ACG ATC ACC TGC CGC GCG AGC CAG GAC GTG AAC ACC GCC
GTG GCC TGG TAC CAG CAG AAG CCC GGG AAG GCC CCC AAG CTC CTG ATC
TAC TCG GCG AGC TTC CTG TAC AGC GGC GTC CCC AGC CGG TTC AGC GGG
TCG CGC AGC GGC ACC GAC TTC ACG CTC ACC ATC AGC AGC CTG CAG CCG
GAG GAC TTC GCC ACC TAC TAC TGC CAG CAG CAC TAC ACC ACG CCC CCC
ACC TTC GGG CAG GGC ACC AAG GTG GAG ATC AAG CGG ACC GTG GCC GCC
CCC AGC GTC TTC ATC TTC CCG CCC AGC GAC GAG CAG CTG AAG TCG GGC
ACG GCC AGC GTG GTG TGC CTC CTG AAC AAC TTC TAC CCC CGC GAG GCG
AAG GTC CAG TGG AAG GTG GAC AAC GCC CTG CAG AGC GGG AAC AGC CAG
GAG AGC GTG ACC GAG CAG GAC TCG AAG GAC AGC ACC TAC AGC CTC AGC
AGC ACC CTG ACG CTG AGC AAG GCC GAC TAC GAG AAG CAC AAG GTC TAC
GCC TGC GAG GTG ACC CAC CAG GGG CTC TCG AGC CCC GTG ACC AAG AGC
TTC AAC CGG GGC GAG TGC TGA
```

Fig. 21

AAGCTTACC*ATG*GCCGTGATGGCGCCGCGGACCCTGGTCCTCCTGCTGAGCGGCGCCCTCGCCCT
*GACGCAGACCTGGGCCGGGG*AGGTGCAGCTGGTCGAGAGCGGCGGGGGCCTCGTGCAGCCGGGCG
GGTCGCTGCGGCTGAGCTGCGCCGCGAGCGGGTTCAACATCAAGGACACCTACATCCACTGGGTG
CGCCAGGCCCCCGGCAAGGGCCTCGAGTGGGTCGCCCGGATCTACCCCACGAACGGGTACACCCG
CTACGCCGACAGCGTGAAGGGCCGGTTCACCATCAGCGCGGACACCTCGAAGAACACGGCCTACC
TGCAGATGAACAGCCTGCGCGCCGAGGACACCGCCGTGTACTACTGCAGCCGGTGGGGCGGCGAC
GGGTTCTACGCCATGGACTACTGGGGGCAGGGCACCCTCGTCACCGTGAGCAGCGCGTCGACGAA
GGGGCCCAGCGTGTTCCCGCTGGCCCCCAGCAGCAAGAGCACCAGCGGCGGGACCGCCGCCCTGG
GCTGCCTCGTCAAGGACTACTTCCCCGAGCCCGTGACCGTGTCGTGGAACAGCGGCGCGCTGACG
AGCGGGGTCCACACCTTCCCGGCCGTGCTGCAGAGCAGCGGCCTCTACTCGCTGAGCAGCGTGGT
CACCGTGCCCAGCAGCAGCCTGGGGACCCAGACGTACATCTGCAACGTGAACCACAAGCCCTCGA
ACACCAAGGTCGACAAGAAGGTGGAGCCCCCGAAGAGCTGCGACAAGACCCACACCTGCCCGCCC
TGCCCCGCCCCCGAGCTCCTGGGCGGGCCCAGCGTGTTCCTGTTCCCGCCCAAGCCCAAGGACAC
GCTCATGATCAGCCGCACCCCCGAGGTCACCTGCGTGGTGGTCGACGTGAGCCACGAGGACCCCG
AGGTGAAGTTCAACTGGTACGTCGACGGCGTGGAGGTGCACAACGCCAAGACCAAGCCGCGGGAG
GAGCAGTACAACTCGACGTACCGCGTCGTGAGCGTGCTGACCGTCCTGCACCAGGACTGGCTCAA
CGGCAAGGAGTACAAGTGCAAGGTGAGCAACAAGGCCCTGCCCGCGCCCATCGAGAAGACCATCA
GCAAGGCCAAGGGGCAGCCCCGGGAGCCGCAGGTGTACACCCTGCCCCCCAGCCGCGACGAGCTC
ACGAAGAACCAGGTCAGCCTGACCTGCCTGGTGAAGGGCTTCTACCCCTCGGACATCGCCGTGGA
GTGGGAGAGCAACGGGCAGCCGGAGAACAACTACAAGACCACCCCGCCCGTCCTCGACAGCGACG
GCAGCTTCTTCCTGTACAGCAAGCTGACGGTGGACAAGTCGCGGTGGCAGCAGGGCAACGTGTTC
AGCTGCAGCGTCATGCACGAGGCCCTCCACAACCACTACACCCAGAAGAGCCTGAGCCTGAGCCC
CGGGAAGCATCATCATCATCATCATTGACCAGATCTTTCTGACATTTCTGACATTTCTGACATTT
CTGACATTTCTGACATTTCTGACATTTCTGACATTTCTGACATTTCTGACATTTCTGACATATGC
ATACC*ATG*GCCGTGATGGCGCCGCGGACCCTGGTCCTCCTGCTGAGCGGCGCCCTCGCCCTGACG
*CAGACCTGGGCCGGGG*ACATCCAGATGACCCAGAGCCCGTCGAGCCTGAGCGCCAGCGTGGGCGA
CCGGGTCACGATCACCTGCCGCGCGAGCCAGGACGTGAACACCGCCGTGGCCTGGTACCAGCAGA
AGCCCGGGAAGGCCCCCAAGCTCCTGATCTACTCGGCGAGCTTCCTGTACAGCGGCGTCCCCAGC
CGGTTCAGCGGGTCGCGCAGCGGCACCGACTTCACGCTCACCATCAGCAGCCTGCAGCCGGAGGA
CTTCGCCACCTACTACTGCCAGCAGCACTACACCACGCCCCCCACCTTCGGGCAGGGCACCAAGG
TGGAGATCAAGCGGACCGTGGCCGCCCCAGCGTCTTCATCTTCCCGCCCAGCGACGAGCAGCTG
AAGTCGGGCACGGCCAGCGTGGTGTGCCTCCTGAACAACTTCTACCCCCGCGAGGCGAAGGTCCA
GTGGAAGGTGGACAACGCCCTGCAGAGCGGGAACAGCCAGGAGAGCGTGACCGAGCAGGACTCGA
AGGACAGCACCTACAGCCTCAGCAGCACCCTGACGCTGAGCAAGGCCGACTACGAGAAGCACAAG
GTCTACGCCTGCGAGGTGACCCACCAGGGGCTCTCGAGCCCCGTGACCAAGAGCTTCAACCGGGG
CGAGTGCTGATGA<u>CCACTAG</u>

Fig. 22

AAGCTTACCATGGCCGTGATGGCGCCGCGGACCCTGGTCCTCCTGCTGAGCGGCGCCCTCGCCCT
GACGCAGACCTGGGCCGGGCAGGCCTACCTGCAGCAGAGCGGCGCGGAGCTCGTGCGGCCGGGGG
CCTCGGTCAAGATGAGCTGCAAGGCCAGCGGCTACACCTTCACGAGCTACAACATGCACTGGGTG
AAGCAGACCCCGCGCCAGGGGCTGGAGTGGATCGGCGCCATCTACCCCGGGAACGGCGACACCAG
CTACAACCAGAAGTTCAAGGGCAAGGCGACCCTGACGGTGGACAAGTCGAGCAGCACCGCCTACA
TGCAGCTCAGCAGCCTGACCTCGGAGGACAGCGCCGTCTACTTCTGCGCCCGGGTGGTGTACTAC
AGCAACAGCTACTGGTACTTCGACGTCTGGGGGACCGGCACGACCGTGACCGTGAGCGGGCCCAG
CGTCTTCCCCCTGGCCCCCTCGAGCAAGAGCACCAGCGGCGGCACGGCGGCCCTCGGGTGCCTGG
TGAAGGACTACTTCCCCGAGCCCGTGACCGTCAGCTGGAACTCGGGCGCCCTGACCAGCGGGGTG
CACACCTTCCCGGCCGTGCTCCAGAGCAGCGGCCTGTACAGCCTGAGCTCGGTCGTGACGGTGCC
CAGCAGCAGCCTCGGGACCCAGACCTACATCTGCAACGTCAACCACAAGCCCAGCAACACCAAGG
TGGACAAGAAGGCGGAGCCCAAGTCGTGCGACAAGACGCACACCTGCCCGCCCTGCCCCGCCCCC
GAGCTGCTGGGCGGCCCGAGCGTGTTCCTCTTCCCGCCCAAGCCCAAGGACACCCTGATGATCAG
CCGCACCCCCGAGGTCACGTGCGTGGTGGTCGACGTGAGCCACGAGGACCCCGAGGTGAAGTTCA
ACTGGTACGTCGACGGGGTGGAGGTGCACAACGCCAAGACCAAGCCCCGGGAGGAGCAGTACAAC
AGCACCTACCGCGTCGTGAGCGTGCTGACCGTCCTCCACCAGGACTGGCTGAACGGCAAGGAGTA
CAAGTGCAAGGTGTCGAACAAGGCCCTGCCGGCCCCCATCGAGAAGACGATCAGCAAGGCGAAGG
GGCAGCCCCGGGAGCCCCAGGTGTACACCCTCCCGCCCAGCCGCGACGAGCTGACCAAGAACCAG
GTCAGCCTGACCTGCCTCGTGAAGGGCTTCTACCCCAGCGACATCGCCGTGGAGTGGGAGTCGAA
CGGGCAGCCCGAGAACAACTACAAGACGACCCCGCCCGTCCTGGACAGCGACGGCAGCTTCTTCC
TGTACAGCAAGCTCACCGTGGACAAGAGCCGGTGGCAGCAGGGCAACGTGTTCAGCTGCTCGGTC
ATGCACGAGGCCCTGCACAACCACTACACCCAGAAGAGCCTGAGCCTCAGCCCCGGGAAGCATCA
TCATCATCATCATTGACCATGCATTTCTGACATTTCTGACATTTCTGACATTTCTGACATTTCTG
ACATTTCTGACATTTCTGACATTTCTGACATTTCTGACATTTCTGACATAGATCTACCATGGCCG
TGATGGCGCCGCGGACCCTGGTCCTCCTGCTGAGCGGCGCCCTCGCCCTGACGCAGACCTGGGCC
GGGCAGATCGTGCTGAGCCAGTCGCCGGCCATCCTCAGCGCGAGCCCCGGCGAGAAGGTCACCAT
GACGTGCCGGGCCAGCAGCTCGGTGAGCTACATGCACTGGTACCAGCAGAAGCCCGGGAGCAGCC
CCAAGCCGTGGATCTACGCCCCCAGCAACCTGGCCTCGGGCGTGCCCGCGCGCTTCAGCGGGAGC
GGCAGCGGGACCAGCTACAGCCTGACCATCTCGCGGGTCGAGGCCGAGGACGCCGCCACCTACTA
CTGCCAGCAGTGGAGCTTCAACCCGCCCACGTTCGGCGCCGGCACCAAGCTCGAGCTGAAGCGCA
CCGTGGCGGCCCCCAGCGTGTTCATCTTCCCGCCCAGCGACGAGCAGCTGAAGAGCGGGACCGCC
TCGGTCGTGTGCCTCCTGAACAACTTCTACCCCGGGAGGCCAAGGTGCAGTGGAAGGTCGACAA
CGCGCTGCAGAGCGGCAACAGCCAGGAGAGCGTGACGGAGCAGGACAGCAAGGACAGCACCTACT
CGCTCAGCAGCACCCTGACCCTGAGCAAGGCCGACTACGAGAAGCACAAGGTGTACGCCTGCGAG
GTCACGCACCAGGGGCTCAGCTCGCCCGTGACCAAGAGCTTCAACCGCTGACCACTAGT

Fig. 25

AAGCTTACCATGGCCGTGATGGCGCCGCGGACCCTGGTCCTCCTGCTGAGCGGCGCCCTCGCCCT
GACGCAGACCTGGGCCGGGCAGGTGCAGCTGAAGCAGAGCGGCCCGGGGCTCGTCCAGCCCTCGC
AGAGCCTGAGCATCACCTGCACGGTGAGCGGCTTCAGCCTGACCAACTACGGGGTGCACTGGGTC
CGGCAGTCGCCCGGCAAGGGGCTCGAGTGGCTGGGCGTGATCTGGAGCGGCGGGAACACCGACTA
CAACACCCCCTTCACGAGCCGCCTGAGCATCAACAAGGACAACAGCAAGTCGCAGGTGTTCTTCA
AGATGAACAGCCTCCAGAGCAACGACACCGCCATCTACTACTGCGCGCGGGCCCTGACCTACTAC
GACTACGAGTTCGCCTACTGGGGCCAGGGGACCCTGGTCACGGTGAGCGCCGCGAGCACCAAGGG
CCCGAGCGTGTTCCCCCTCGCCCCCTCGAGCAAGAGCACCAGCGGCGGGACCGCCGCCCTGGGCT
GCCTGGTCAAGGACTACTTCCCCGAGCCGGTGACGGTGAGCTGGAACTCGGGGGCCCTCACCAGC
GGCGTCCACACCTTCCCCGCGGTGCTGCAGAGCAGCGGGCTGTACAGCCTCAGCTCGGTGGTCAC
CGTGCCCAGCAGCAGCCTGGGCACGCAGACCTACATCTGCAACGTGAACCACAAGCCCAGCAACA
CCAAGGTCGACAAGCGCGTGGAGCCGAAGTCGCCCAAGAGCTGCGACAAGACCCACACGTGCCCG
CCCTGCCCCGCCCCCGAGCTGCTCGGCGGGCCCAGCGTGTTCCTGTTCCCGCCCAAGCCCAAGGA
CACCCTGATGATCAGCCGGACCCCCGAGGTCACCTGCGTGGTGGTCGACGTGAGCCACGAGGACC
CGGAGGTGAAGTTCAACTGGTACGTCGACGGCGTGGAGGTGCACAACGCCAAGACGAAGCCCCGC
GAGGAGCAGTACAACAGCACCTACCGGGTCGTGTCGGTGCTCACCGTCCTGCACCAGGACTGGCT
GAACGGGAAGGAGTACAAGTGCAAGGTGAGCAACAAGGCCCTCCCCGCGCCCATCGAGAAGACCA
TCAGCAAGGCCAAGGGCCAGCCGCGCGAGCCCCAGGTGTACACGCTGCCCCCAGCCGGGACGAG
CTGACCAAGAACCAGGTCAGCCTCACCTGCCTGGTGAAGGGGTTCTACCCGTCGGACATCGCCGT
GGAGTGGGAGAGCAACGGCCAGCCCGAGAACAACTACAAGACCACGCCCCCGGTCCTGGACAGCG
ACGGCAGCTTCTTCCTCTACAGCAAGCTGACCGTGGACAAGAGCCGCTGGCAGCAGGGGAACGTG
TTCTCGTGCAGCGTCATGCACGAGGCCCTGCACAACCACTACACCCAGAAGAGCCTCAGCCTGAG
CCCCGGCAAGCATCATCATCATCATCAT<u>TGACC</u>ATGCATTTCTGACATTTCTGACATTTCTGACA
TTTCTGACATTTCTGACATTTCTGACATTTCTGACATTTCTGACATTTCTGACATTTCTGACATA
GATCTACC*ATG*GCCGTGATGGCGCCGCGGACCCTGGTCCTCCTGCTGAGCGGCGCCCTCGCCCTG
ACGCAGACCTGGGCCGGGGACATCCTGCTCACCCAGAGCCCGGTGATCCTGTCGGTCAGCCCCGG
CGAGCGGGTGAGCTTCAGCTGCCGCGCCAGCCAGTCGATCGGGACGAACATCCACTGGTACCAGC
AGCGGACCAACGGCAGCCCCGCCTGCTCATCAAGTACGCGAGCGAGAGCATCAGCGGGATCCCC
TCGCGGTTCAGCGGCAGCGGGAGCGGCACCGACTTCACCCTGAGCATCAACAGCGTGGAGTCGGA
GGACATCGCCGACTACTACTGCCAGCAGAACAACAACTGGCCGACGACCTTCGGCGCCGGGACCA
AGCTGGAGCTCAAGCGCACCGTCGCCGCGCCCAGCGTGTTCATCTTCCCGCCCAGCGACGAGCAG
CTGAAGAGCGGCACGGCCAGCGTGGTCTGCCTGCTCAACAACTTCTACCCCGGGAGGCCAAGGT
GCAGTGGAAGGTGGACAACGCCCTGCAGTCGGGGAACAGCCAGGAGAGCGTCACCGAGCAGGACA
GCAAGGACAGCACCTACAGCCTGTCGAGCACCCTCACGCTGAGCAAGGCCGACTACGAGAAGCAC
AAGGTGTACGCGTGCGAGGTGACCCACCAGGGCCTGAGCAGCCCCGTCACCAAGTCGTTCAACCG
CGGCGCC<u>TGACCACTAGT</u>

Fig. 26

AAGCTTACCATGGCCGTGATGGCGCCGCGGACCCTGGTCCTCCTGCTGAGCGGCGCCCTCGCCCT
*GACGCAGACCTGGGCCGGGGAGGTGCAGCTGGTCGAGAGCGGCGGGGGCCTCGTGCAGCCGGGCG
GGTCGCTGCGGCTGAGCTGCGCCGCGAGCGGGTTCAACATCAAGGACACCTACATCCACTGGGTG
CGCCAGGCCCCCGGCAAGGGCCTCGAGTGGGTCGCCCGGATCTACCCCACGAACGGGTACACCCG
CTACGCCGACAGCGTGAAGGGCCGGTTCACCATCAGCGCGGACACCTCGAAGAACACGGCCTACC
TGCAGATGAACAGCCTGCGCGCCGAGGACACCGCCGTGTACTACTGCAGCCGGTGGGGCGGCGAC
GGGTTCTACGCCATGGACTACTGGGGGCAGGGCACCCTCGTCACCGTGAGCAGCGCGTCGACGAA
GGGGCCCAGCGTGTTCCCGCTGGCCCCCAGCAGCAAGAGCACCAGCGGCGGGACCGCCGCCCTGG
GCTGCCTCGTCAAGGACTACTTCCCCGAGCCCGTGACCGTGTCGTGGAACAGCGGCGCGCTGACG
AGCGGGGTCCACACCTTCCCGGCCGTGCTGCAGAGCAGCGGCCTCTACTCGCTGAGCAGCGTGGT
CACCGTGCCCAGCAGCAGCCTGGGGACCCAGACGTACATCTGCAACGTGAACCACAAGCCCTCGA
ACACCAAGGTCGACAAGAAGGTGGAGCCCCCGAAGAGCTGCGACAAGACCCACACCTGCCCGCCC
TGCCCCGCCCCCGAGCTCCTGGGCGGGCCCAGCGTGTTCCTGTTCCCGCCCAAGCCCAAGGACAC
GCTCATGATCAGCCGCACCCCCGAGGTCACCTGCGTGGTGGTCGACGTGAGCCACGAGGACCCCG
AGGTGAAGTTCAACTGGTACGTCGACGGCGTGGAGGTGCACAACGCCAAGACCAAGCCGCGGGAG
GAGCAGTACAACTCGACGTACCGCGTCGTGAGCGTGCTGACCGTCCTGCACCAGGACTGGCTCAA
CGGCAAGGAGTACAAGTGCAAGGTGAGCAACAAGGCCCTGCCCGCGCCCATCGAGAAGACCATCA
GCAAGGCCAAGGGGCAGCCCCGGGAGCCGCAGGTGTACACCCTGCCCCCCAGCCGCGACGAGCTC
ACGAAGAACCAGGTCAGCCTGACCTGCCTGGTGAAGGGCTTCTACCCCTCGGACATCGCCGTGGA
GTGGGAGAGCAACGGGCAGCCGGAGAACAACTACAAGACCACCCCGCCCGTCCTCGACAGCGACG
GCAGCTTCTTCCTGTACAGCAAGCTGACGGTGGACAAGTCGCGGTGGCAGCAGGGCAACGTGTTC
AGCTGCAGCGTCATGCACGAGGCCCTCCACAACCACTACACCCAGAAGAGCCTGAGCCTGAGCCC
CGGGAAGCATCATCATCATCATCAT*TGACC**ATGCATTTCTGACATTTCTGACATTTCTGACATTT
CTGACATTTCTGACATTTCTGACATTTCTGACATTTCTGACATTTCTGACATTTCTGACATAGAT
CT*ACCATGGCCGTGATGGCGCCGCGGACCCTGGTCCTCCTGCTGAGCGGCGCCCTCGCCCTGACG
*CAGACCTGGGCCGGGGACATCCAGATGACCCAGAGCCCGTCGAGCCTGAGCGCCAGCGTGGGCGA
CCGGGTCACGATCACCTGCCGCGCGAGCCAGGACGTGAACACCGCCGTGGCCTGGTACCAGCAGA
AGCCCGGGAAGGCCCCCAAGCTCCTGATCTACTCGGCGAGCTTCCTGTACAGCGGCGTCCCCAGC
CGGTTCAGCGGGTCGCGCAGCGGCACCGACTTCACGCTCACCATCAGCAGCCTGCAGCCGGAGGA
CTTCGCCACCTACTACTGCCAGCAGCACTACACCACGCCCCCCACCTTCGGGCAGGGCACCAAGG
TGGAGATCAAGCGGACCGTGGCCGCCCCCAGCGTCTTCATCTTCCCGCCCAGCGACGAGCAGCTG
AAGTCGGGCACGGCCAGCGTGGTGTGCCTCCTGAACAACTTCTACCCCCGCGAGGCGAAGGTCCA
GTGGAAGGTGGACAACGCCCTGCAGAGCGGGAACAGCCAGGAGAGCGTGACCGAGCAGGACTCGA
AGGACAGCACCTACAGCCTCAGCAGCACCCTGACGCTGAGCAAGGCCGACTACGAGAAGCACAAG
GTCTACGCCTGCGAGGTGACCCACCAGGGGCTCTCGAGCCCCGTGACCAAGAGCTTCAACCGGGG
CGAGTGCTGATGACCACTAG*

A
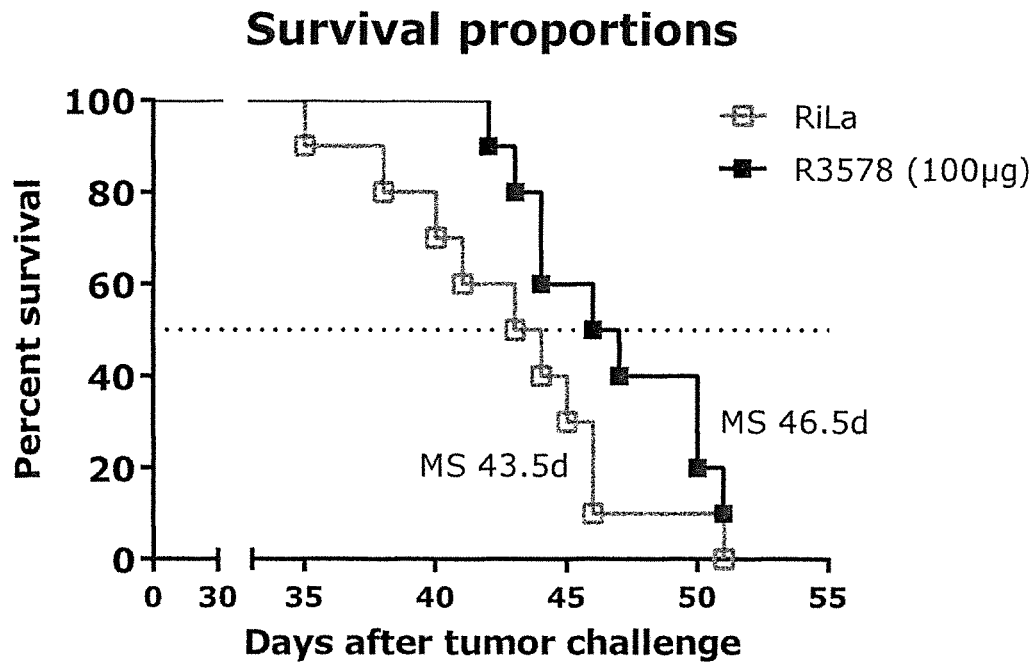
B
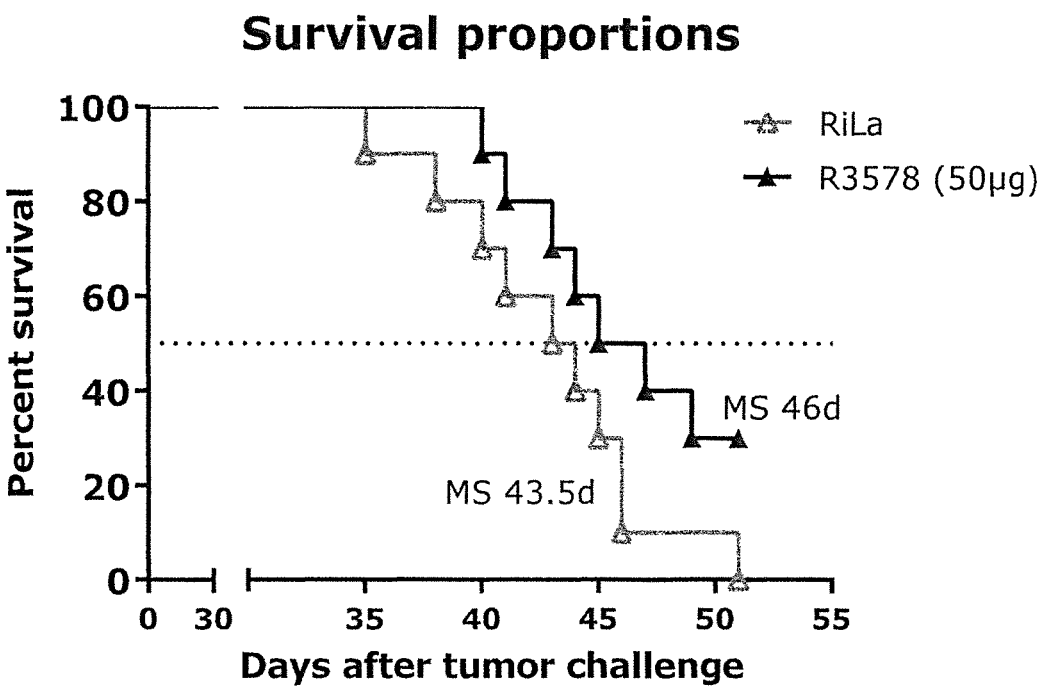
Fig. 30

R1965

```
GGGAGAAAGCUUACCAUGGCCGUGAUGGCGCCGCGGACCCUGGUCCUCCUGCUGAGCGGC
GCCCUCGCCCUGACGCAGACCUGGGCCGGGGAGGUGCAGCUGGUCGAGAGCGGCGGGGGC
CUCGUGCAGCCGGGCGGGUCGCUGCGGCUGAGCUGCGCCGCGAGCGGGUUCAACAUCAAG
GACACCUACAUCCACUGGGUGCGCCAGGCCCCCGGCAAGGGCCUCGAGUGGGUCGCCCGG
AUCUACCCCACGAACGGGUACACCCGCUACGCCGACAGCGUGAAGGGCCGGUUCACCAUC
AGCGCGGACACCUCGAAGAACACGGCCUACCUGCAGAUGAACAGCCUGCGCGCCGAGGAC
ACCGCCGUGUACUACUGCAGCCGGUGGGGCGGCGACGGGUUCUACGCCAUGGACUACUGG
GGGCAGGGCACCCUCGUCACCGUGAGCAGCGCGUCGACGAAGGGGCCCAGCGUGUUCCCG
CUGGCCCCCAGCAGCAAGAGCACCAGCGGCGGGACCGCCGCCCUGGGCUGCCUCGUCAAG
GACUACUUCCCCGAGCCCGUGACCGUGUCGUGGAACAGCGGCGCGCUGACGAGCGGGGUC
CACACCUUCCCGGCCGUGCUGCAGAGCAGCGGCCUCUACUCGCUGAGCAGCGUGGUCACC
GUGCCCAGCAGCAGCCUGGGGACCCAGACGUACAUCUGCAACGUGAACCACAAGCCCUCG
AACACCAAGGUCGACAAGAAGGUGGAGCCCCCGAAGAGCUGCGACAAGACCCACACCUGC
CCGCCCUGCCCCGCCCCCGAGCUCCUGGGCGGGCCCAGCGUGUUCCUGUUCCCGCCCAAG
CCCAAGGACACGCUCAUGAUCAGCCGCACCCCCGAGGUCACCUGCGUGGUGGUCGACGUG
AGCCACGAGGACCCCGAGGUGAAGUUCAACUGGUACGUCGACGGCGUGGAGGUGCACAAC
GCCAAGACCAAGCCGCGGGAGGAGCAGUACAACUCGACGUACCGCGUCGUGAGCGUGCUG
ACCGUCCUGCACCAGGACUGGCUCAACGGCAAGGAGUACAAGUGCAAGGUGAGCAACAAG
GCCCUGCCCGCGCCCAUCGAGAAGACCAUCAGCAAGGCCAAGGGGCAGCCCCGGGAGCCG
CAGGUGUACACCCUGCCCCCAGCCGCGACGAGCUCACGAAGAACCAGGUCAGCCUGACC
UGCCUGGUGAAGGGCUUCUACCCCUCGGACAUCGCCGUGGAGUGGGAGAGCAACGGGCAG
CCGGAGAACAACUACAAGACCACCCCGCCCGUCCUCGACAGCGACGGCAGCUUCUUCCUG
UACAGCAAGCUGACGGUGGACAAGUCGCGGUGGCAGCAGGGCAACGUGUUCAGCUGCAGC
GUCAUGCACGAGGCCCUCCACAACCACUACACCCAGAAGAGCCUGAGCCUGAGCCCCGGG
AAGCAUCAUCAUCAUCAUUGACCAUGCAUUUGAAAGCCGGGGGUGGGAGAUCCGGAU
UGCCAGUCUGCUCGAUAUCGCAGGCUGGGUCCGUGACUACCCACUCCCCCUUUAAUUCCG
CCCCUCUCCCUCCCCCCCCCUAACGUUACUGGCCGAAGCCGCUUGGAAUAAGGCCGGUG
UGCGUUUGUCUAUAUGUUAUUUUCCACCAUAUUGCCGUCUUUGGCAAUGUGAGGGCCCG
GAAACCUGGCCCUGUCUUCUUGACGAGCAUUCCUAGGGGUCUUUCCCCUCUCGCCAAAGG
AAUGCAAGGUCUGUUGAAUGUCGUGAAGGAAGCAGUUCCUCUGGAAGCUUCUUGAAGACA
AACAACGUCUGUAGCGACCCUUUGCAGGCAGCGGAACCCCCCACCUGGCGACAGGUGCCU
CUGCGGCCAAAAGCCACGUGUAUAAGAUACACCUGCAAAGGCGGCACAACCCCAGUGCCA
CGUUGUGAGUUGGAUAGUUGUGGAAAGAGUCAAAUGGCUCUCCUCAAGCGUAUUCAACAA
GGGGCUGAAGGAUGCCCAGAAGGUACCCCAUUGUAUGGGAUCUGAUCUGGGGCCUCGGUG
CACAUGCUUUACGUGUGUUUAGUCGAGGUUAAAAAACGUCUAGGCCCCCCGAACCACGGG
GACGUGGUUUUCCUUUGAAAAACACGAUGAUAAUAGAUCUACCAUGGCCGUGAUGGCGCC
GCGGACCCUGGUCCUCCUGCUGAGCGGCGCCCUCGCCCUGACGCAGACCUGGGCCGGGGA
CAUCCAGAUGACCCAGAGCCCGUCGAGCCUGAGCGCCAGCGUGGGCGACCGGGUCACGAU
CACCUGCCGCGCGAGCCAGGACGUGAACACCGCCGUGGCCUGGUACCAGCAGAAGCCCGG
GAAGGCCCCCAAGCUCCUGAUCUACUCGGCGAGCUUCCUGUACAGCGGCGUCCCCAGCCG
GUUCAGCGGGUCGCGCAGCGGCACCGACUUCACGCUCACCAUCAGCAGCCUGCAGCCGGA
GGACUUCGCCACCUACUACUGCCAGCAGCACUACACCACGCCCCCCACCUUCGGGCAGGG
CACCAAGGUGGAGAUCAAGCGGACCGUGGCCGCCCCCAGCGUCUUCAUCUUCCCGCCCAG
CGACGAGCAGCUGAAGUCGGGCACGGCCAGCGUGGUGUGCCUCCUGAACAACUUCUACCC
CCGCGAGGCGAAGGUCCAGUGGAAGGUGGACAACGCCCUGCAGAGCGGGAACAGCCAGGA
GAGCGUGACCGAGCAGGACUCGAAGGACAGCACCUACAGCCUCAGCAGCACCCUGACGCU
```

Fig. 39

```
GAGCAAGGCCGACUACGAGAAGCACAAGGUCUACGCCUGCGAGGUGACCCACCAGGGGCU
CUCGAGCCCCGUGACCAAGAGCUUCAACCGGGGCGAGUGCUGACCACUAGUUAUAAGACU
GACUAGCCCGAUGGGCCUCCCAACGGGCCCUCCUCCCCUCCUUGCACCGAGAUUAAUAAA
AAAAAAAAAAAAAAAAAAAAAAAAAAAAAAAAAAAAAAAAAAAAAAAAAAAAAAAAAAAA
AUAUUCCCCCCCCCCCCCCCCCCCCCCCCCCCUCUAG
```

GGGAGAAAGCUUACCAUGGCCGUGAUGGCGCCGCGGACCCUGGUCCUCCUGCUGAGCGGC
GCCCUCGCCCUGACGCAGACCUGGGCCGGGCAGGUGCAGCUGAAGCAGAGCGGCCCGGGG
CUCGUCCAGCCCUCGCAGAGCCUGAGCAUCACCUGCACGGUGAGCGGCUUCAGCCUGACC
AACUACGGGGUGCACUGGGUCCGGCAGUCGCCCGGCAAGGGGCUCGAGUGGCUGGGCGUG
AUCUGGAGCGGCGGGAACACCGACUACAACACCCCCUUCACGAGCCGCCUGAGCAUCAAC
AAGGACAACAGCAAGUCGCAGGUGUUCUUCAAGAUGAACAGCCUCCAGAGCAACGACACC
GCCAUCUACUACUGCGCGCGGGCCCUGACCUACUACGACUACGAGUUCGCCUACGGGGC
CAGGGGACCCUGGUCACGGUGAGCGCCGCGAGCACCAAGGGCCCGAGCGUGUUCCCCCUC
GCCCCCUCGAGCAAGAGCACCAGCGGCGGGACCGCCGCCCUGGGCUGCCUGGUCAAGGAC
UACUUCCCCGAGCCGGUGACGGUGAGCUGGAACUCGGGGGCCCUCACCAGCGGCGUCCAC
ACCUUCCCCGCGGUGCUGCAGAGCAGCGGGCUGUACAGCCUCAGCUCGGUGGUCACCGUG
CCCAGCAGCAGCCUGGGCACGCAGACCUACAUCUGCAACGUGAACCACAAGCCCAGCAAC
ACCAAGGUCGACAAGCGCGUGGAGCCGAAGUCGCCCAAGAGCUGCGACAAGACCCACACG
UGCCCGCCCUGCCCCGCCCCGAGCUGCUCGGCGGGCCCAGCGUGUUCCUGUUCCCGCCC
AAGCCCAAGGACACCCUGAUGAUCAGCCGGACCCCCGAGGUCACCUGCGUGGUGGUCGAC
GUGAGCCACGAGGACCCGGAGGUGAAGUUCAACUGGUACGUCGACGGCGUGGAGGUGCAC
AACGCCAAGACGAAGCCCCGCGAGGAGCAGUACAACAGCACCUACCGGGUCGUGUCGGUG
CUCACCGUCCUGCACCAGGACUGGCUGAACGGGAAGGAGUACAAGUGCAAGGUGAGCAAC
AAGGCCCUCCCCGCGCCCAUCGAGAAGACCAUCAGCAAGGCCAAGGGCCAGCCGCGCGAG
CCCCAGGUGUACACGCUGCCCCCAGCCGGGACGAGCUGACCAAGAACCAGGUCAGCCUC
ACCUGCCUGGUGAAGGGGUUCUACCCGUCGGACAUCGCCGUGGAGUGGGAGAGCAACGGC
CAGCCCGAGAACAACUACAAGACCACGCCCCGGUCCUGGACAGCGACGGCAGCUUCUUC
CUCUACAGCAAGCUGACCGUGGACAAGAGCCGCUGGCAGCAGGGGAACGUGUUCUCGUGC
AGCGUCAUGCACGAGGCCCUGCACAACCACUACACCCAGAAGAGCCUCAGCCUGAGCCCC
GGCAAGCAUCAUCAUCAUCAUCAUUGACCAUGCAUUUGAAAGCCGGGGGUGGGAGAUCCG
GAUUGCCAGUCUGCUCGAUAUCGCAGGCUGGGUCCGUGACUACCCACUCCCCCUUUAAUU
CCGCCCCUCUCCCUCCCCCCCCCUAACGUUACUGGCCGAAGCCGCUUGGAAUAAGGCCG
GUGUGCGUUUGUCUAUAUGUUAUUUUCCACCAUAUUGCCGUCUUUGGCAAUGUGAGGGC
CCGGAAACCUGGCCCUGUCUUCUUGACGAGCAUUCCUAGGGGUCUUUCCCCUCUCGCCAA
AGGAAUGCAAGGUCUGUUGAAUGUCGUGAAGGAAGCAGUUCCUCUGGAAGCUUCUUGAAG
ACAAACAACGUCUGUAGCGACCCUUUGCAGGCAGCGGAACCCCCCACCUGGCGACAGGUG
CCUCUGCGGCCAAAAGCCACGUGUAUAAGAUACACCUGCAAAGGCGGCACAACCCCAGUG
CCACGUUGUGAGUUGGAUAGUUGUGGAAAGAGUCAAAUGGCUCUCCUCAAGCGUAUUCAA
CAAGGGGCUGAAGGAUGCCCAGAAGGUACCCCAUUGUAUGGGAUCUGAUCGGGGCCUCG
GUGCACAUGCUUUACGUGUGUUUAGUCGAGGUUAAAAAACGUCUAGGCCCCCCGAACCAC
GGGGACGUGGUUUUCCUUUGAAAAACACGAUGAUAAUAGAUCUACCAUGGCCGUGAUGGC
GCCGCGGACCCUGGUCCUCCUGCUGAGCGGCGCCCUCGCCCUGACGCAGACCUGGGCCGG
GGACAUCCUGCUCACCCAGAGCCCGGUGAUCCUGUCGGUCAGCCCCGGCGAGCGGGUGAG
CUUCAGCUGCCGCGCCAGCCAGUCGAUCGGGACGAACAUCCACUGGUACCAGCAGCGGAC
CAACGGCAGCCCCGCCUGCUCAUCAAGUACGCGAGCGAGAGCAUCAGCGGGAUCCCCUC
GCGGUUCAGCGGCAGCGGGAGCGGCACCGACUUCACCCUGAGCAUCAACAGCGUGGAGUC
GGAGGACAUCGCCGACUACUACUGCCAGCAGAACAACAACUGGCCGACGACCUUCGGCGC
CGGGACCAAGCUGGAGCUCAAGCGCACCGUCGCCGCGCCCAGCGUGUUCAUCUUCCCGCC
CAGCGACGAGCAGCUGAAGAGCGGCACGGCCAGCGUGGUCUGCCUGCUCAACAACUUCUA
CCCCCGGGAGGCCAAGGUGCAGUGGAAGGUGGACAACGCCCUGCAGUCGGGGAACAGCCA
GGAGAGCGUCACCGAGCAGGACAGCAAGGACAGCACCUACAGCCUGUCGAGCACCCUCAC

Fig. 40

```
GCUGAGCAAGGCCGACUACGAGAAGCACAAGGUGUACGCGUGCGAGGUGACCCACCAGGG
CCUGAGCAGCCCCGUCACCAAGUCGUUCAACCGCGGCGCCUGACCACUAGUUAUAAGACU
GACUAGCCCGAUGGGCCUCCCAACGGGCCCUCCUCCCCUCCUUGCACCGAGAUUAAUAAA
AAAAAAAAAAAAAAAAAAAAAAAAAAAAAAAAAAAAAAAAAAAAAAAAAAAAAAAAAAAA
AUAUUCCCCCCCCCCCCCCCCCCCCCCCCCCCCCUCUAG
```

```
GGGAGAAAGCUUACCAUGGACUUCCAGGUGCAGAUCUUCAGCUUCCUGCUCAUCUCCGCC
AGCGUCAUCAUCUCCCGCGGCGACAUCCAGCUGACCCAGAGCCCCGCCUCCCUCGCCGUG
AGCCUGGGCCAGCGCGCGACCAUCUCCUGCAAGGCCAGCCAGUCCGUCGACUACGACGGG
GACAGCUACCUGAACUGGUACCAGCAGAUCCCCGGCCAGCCCCGAAGCUCCUGAUCUAC
GACGCCUCCAACCUGGUGAGCGGGAUCCCGCCGCGGUUCUCCGGCAGCGGGUCCGGCACG
GACUUCACCCUCAACAUCCACCCCGUGGAGAAGGUCGACGCCGCCACCUACCACUGCCAG
CAGAGCACCGAGGACCCCUGGACGUUCGGCGGGGGCACCAAGCUGGAGAUCAAGGGCGGC
GGGGGGUCCGGCGGGGGCGGGAGCGGCGGCGGGGGCUCCCAGGUGCAGCUGCAGCAGAGC
GGGGCGGAGCUCGUGCGCCCCGGCUCCAGCGUCAAGAUCUCCUGCAAGGCCAGCGGGUAC
GCCUUCAGCUCCUACUGGAUGAACUGGGUGAAGCAGCGGCCGGGCCAGGGCCUGGAGUGG
AUCGGGCAGAUCUGGCCCGGCGACGGGGACACCAACUACAACGGCAAGUUCAAGGGGAAG
GCCACCCUGACGGCGGACGAGAGCUCCAGCACCGCCUACAUGCAGCUCUCCAGCCUGGCC
UCCGAGGACAGCGCCGUGUACUUCUGCGCCCGCCGGGAGACCACCACGGUCGGCCGCUAC
UACUACGCGAUGGACUACUGGGGCCAGGGGACCACCGUGACCGUGUCCAGCGGCGGGGGC
GGGUCCGACAUCAAGCUGCAGCAGAGCGGCGCCGAGCUCGCCCGGCCCGGCGCCUCCGUC
AAGAUGAGCUGCAAGACGUCCGGGUACACCUUCACCCGCUACACCAUGCACUGGGUGAAG
CAGCGGCCCGGCCAGGGGCUGGAGUGGAUCGGCUACAUCAACCCGAGCCGCGGCUACACG
AACUACAACCAGAAGUUCAAGGACAAGGCCACCCUGACCACCGACAAGUCCAGCUCCACG
GCGUACAUGCAGCUCAGCAGCCUGACCUCCGAGGACAGCGCCGUGUACUACUGCGCCCGG
UACUACGACGACCACUACUGCCUGGACUACUGGGGGCAGGGCACCACCCUCACGGUCUCC
AGCGUGGAGGGCGGGUCCGGGGGCAGCGGCGGGUCCGGCGGGAGCGGCGGGGUGGACGAC
AUCCAGCUGACCCAGUCCCCCGCCAUCAUGAGCGCCUCCCCCGGCGAGAAGGUCACCAUG
ACCUGCCGCGCGAGCUCCAGCGUGUCCUACAUGAACUGGUACCAGCAGAAGAGCGGCACG
UCCCCCAAGCGGUGGAUCUACGACACCAGCAAGGUGGCCAGCGGGGUCCCGUACCGCUUC
UCCGGCAGCGGGUCCGGCACCAGCUACUCCCUGACCAUCAGCUCCAUGGAGGCCGAGGAC
GCCGCCACGUACUACUGCCAGCAGUGGAGCUCCAACCCCCUCACCUUCGGGGCGGGCACC
AAGCUGGAGCUGAAGCACCACCACCACCACCACUGAGGACUAGUUAUAAGACUGACUAGC
CCGAUGGGCCUCCCAACGGGCCCUCCUCCCCUCCUUGCACCGAGAUUAAUAAAAAAAAAA
AAAAAAAAAAAAAAAAAAAAAAAAAAAAAAAAAAAAAAAAAAAAAAAAAAAAUAUUCC
CCCCCCCCCCCCCCCCCCCCCCCCCCCUCUAG
```

Fig. 41

RNA ENCODING AN ANTIBODY

This application is a national phase application under 35 U.S.C. § 371 of International Application No. PCT/EP2017/060226, filed Apr. 28, 2017, which claims benefit of International Application No. PCT/EP2016/059711, filed Apr. 29, 2016, the entire contents of each of which are hereby incorporated by reference.

The present invention relates to a RNA encoding an antibody or a fragment or variant thereof and a composition, in particular a passive vaccine, comprising such an RNA. The present invention further relates to the use of such an RNA or of such a composition for treatment of tumours and cancer diseases, cardiovascular diseases, infectious diseases, autoimmune diseases, virus diseases and monogenetic diseases, e.g. also in gene therapy. The present invention also relates to a combination of at least two modified RNA's, in particular wherein one RNA encodes a heavy chain or a heavy chain variable region of an antibody and another RNA encodes the corresponding light chain or light chain variable region of said antibody.

The occurrence of tumours and cancer diseases is, alongside cardiovascular and infectious diseases, one of the most frequent causes of death in modern societies and is associated with usually considerable costs during the therapy and subsequent rehabilitation measures. The treatment of tumours and cancer diseases depends greatly, for example, on the nature of the tumour which occurs and at present conventionally is undertaken by using radio- or chemotherapy, in addition to invasive interventions. However, these therapies represent an exceptional burden on the immune system, and in some cases can be employed to only a limited extent. Furthermore, these therapy forms usually require long pauses between the individual treatments for regeneration of the immune system. In recent years, alongside these "conventional methods", molecular biology programmes in particular have emerged as promising for the treatment or for assisting these therapies.

An example of these molecular biology methods comprises the use of antibodies or immunoglobulins as essential effectors of the immune system. Antibodies or immunoglobulins can be generated either in vitro by using known molecular biology methods or by the immune system of the organism itself to be treated. The immune system of higher vertebrates thus has two separate functions of the immune system: the innate immune system, which reacts non-specifically to pathogens (e.g. by macrophage-mediated phagocytosis) and the adaptive immune system, which reacts specifically to pathogens by means of specialized effector cells (e.g. B and T cells). The antibodies or immunoglobulins which are secreted by plasma cells during an immune response are part of this adaptive immune system. Together with the complement system, they form the humoral branch of the immune response.

Alongside their essential importance for the immune system in higher vertebrates, precisely because of their high affinity and specificity for a particular antigen antibodies are an outstanding means both in biochemical and molecular biology research and in diagnostics and medical uses. Thus, antibodies are capable of binding specifically to their target structures (e.g. antigens, which substantially comprise proteins, peptides, in some cases lipids, carbohydrates etc.) and of thereby blocking (inhibiting) or, where appropriate, labelling these. They can moreover activate the immune system by means of their Fc part, so that the labelled cells are destroyed. Over 100 therapeutic antibodies are currently to be found in clinical studies. Antibodies which can be employed in cancer therapy play by far the most important role in this context. Most of the antibodies prepared for this at present are monoclonal antibodies which originate originally, for example, from the mouse. In order to prevent an immune reaction against such monoclonal antibodies, at present chiefly humanized or human antibodies are employed for therapy (cf. David Male; "Immunologie auf einen Blick [Immunology at a Glance]", 1st German edition, 2005, Elsevier-Urban & Fischer Verlag; Charles A. Janeway, Paul Travers, Mark Walport and Mark Shlomchik, Immunobiology, 5th edition, 2001, Garland Publishing; Dissertation by Christian Klein, Monoklonale Antikörper and rekombinante Antikörperfragmente gegen sekundäre Arzneipflanzenmetabolite [Monoclonal Antibodies and Recombinant Antibody Fragments Against Secondary Medicinal Plant Metabolites], 2004; Andreas Schmiedl and Stefan Dübel, Rekombinante Antikörper & Phagen-Display [Recombinant Antibody & Phage Display], 2004, Molekulare Biotechnologie [Molecular Biotechnology] (Wiley-VCH)).

Antibodies are typically immunoglobulins or can be derived from immunoglobulins. Immunoglobulins can in turn be differentiated into five main classes of immunoglobulins on the basis of their heavy chain, the IgM ($\mu$), IgD ($\delta$), IgG ($\gamma$), IgA ($\alpha$) and IgE ($\epsilon$) antibodies, IgG antibodies making up the largest proportion. Immunoglobulins can moreover be differentiated into the isotypes $\kappa$ and $\lambda$ on the basis of their light chains.

For example, IgG antibodies are typically built up two identical light and two heavy protein chains which are bonded to one another via disulfide bridges. As shown in FIG. 1, the light chain comprises the N-terminal variable domain $V_L$ (also referred to as "light chain variable region") and the C-terminal constant domain $C_L$ (also referred to as "light chain constant region"). The heavy chain of an IgG antibody can be divided into an N-terminal variable domain $V_H$ (also referred to as "heavy chain variable region") and three constant domains $C_H1$, $C_H2$ and $C_H3$ (all three constant domains together are also referred to as "heavy chain constant region"). While the amino acid sequence is largely the same in the region of the constant domains, wide differences in sequence are typically found within the variable domains.

The antibody repertoire of a human comprises about at least $10^{11}$ different antibody specificities. In higher vertebrates, the formation of antibodies takes place naturally in the immune system by somatic recombination. In this context, an organism is indeed theoretically capable of generating an antibody of appropriate specificity against any antigen. However, if each of these antibodies were to be coded by an endogenous gene, they would burst the human genome. Instead, in humans antibody genes are composed of a large number of individual gene segments. The part of the antibody gene which codes for the variable region of a light chain is formed from a V gene segment and a J gene segment. In this context, numerous different V and J segments are available, which can be combined with one another virtually as desired. In this context, the variable region of a heavy chain is composed of three different gene segments. In addition to the V and J segments, additional D segments are also found here. The $V_H$, $D_H$ and $J_H$ segments can likewise be combined with one another virtually as desired to form the variable region of the heavy chain (cf. FIG. 2). The mechanism by which the various gene segments are combined to form complete antibody genes is called immunoglobulin rearrangement or somatic recombination. It takes place exclusively in B lymphocytes at certain times of cell development.

In addition to pure gene rearrangement, further mechanisms for increasing the antibody diversity also exist. Two mechanisms which are accompanied by somatic recombination are first to be mentioned in this context: The junctional diversity in this context describes controlled imprecise joining together of the rearranged gene segments, as a result of which random removal and insertion of nucleotides occurs at the cleavage sites. A further combinatorial diversity results from the possibility of combining a particular rearranged light chain with a particular rearranged heavy chain. Finally, the diversity of antibodies is also additionally increased after successful rearrangement and later activation of B cells, in that an affinity maturation of antibodies occurs due to an increased rate of mutation in the region of the variable regions of activated B cells (somatic hypermutation).

In addition to the formation of antibodies which takes place naturally by the immune system of the particular organism, antibodies can also be generated by molecular biology methods. However, in order to utilize the system elaborated for specification of antibody formation and specification thereof for particular antigens or nucleic acids, the formation of antibodies is at present typically induced in selected organisms by injection of a particular antigen, and the antibody is then isolated from the organism for further use. In this context, the B lymphocytes of the organism are conventionally purified selectively and fused with an immortal myeloma cell to form a hybridoma cell. Those cells which secrete the corresponding antigen-specific antibodies are then determined by selection methods.

In addition to use of hybridoma cells, recombinant preparation of these antibodies with the desired specificity is also possible after isolation and sequencing. Cells which provide the required posttranslational modifications are typically used for this. On the basis of the immune reaction with formation of human anti-mouse antibodies in the human organism in the case of native antibodies produced in the mouse (or in other hosts), chimeric, humanized or human antibodies are preferably prepared here.

After expression, these antibodies, optionally prepared by recombinant methods, can be employed as agents both in biochemical and molecular biology research, and in diagnostics and for medical uses.

In medical uses, however, in many cases antibodies can be employed directly only with difficulty, since these usually have only a very short half-life in vivo and therefore, possibly, cannot reach their target antigen or their target nucleic acid at all. This requires either high active compound concentrations of the desired antibody, or alternative methods which are suitable for providing large amounts of antibodies in vivo.

Such methods include, e.g. molecular medicine methods of gene therapy and genetic vaccination which, when used generally in the therapy and prevention of diseases, have considerable effects on medical practice. Both methods are based on the introduction of nucleic acids into cells or into tissue of the patient and on subsequent processing by the cells or, respectively, tissue of the information coded by the nucleic acids introduced, i.e. expression of the desired polypeptides, e.g. antibodies, in the cells or respectively, the tissue.

The conventional procedure of methods of gene therapy and of genetic vaccination is based on the use of DNA to sluice the required genetic information into the cell. Various methods for introducing DNA into cells have been developed in this connection, such as, for example, calcium phosphate transfection, polyprene transfection, protoplast fusion, electroporation, microinjection, lipofection and the use of gene canons, lipofection in particular having emerged as a suitable method.

A further method which has been proposed in particular in the case of genetic vaccination methods is the use of DNA viruses as DNA vehicles. Such viruses have the advantage that because of their infectious properties a very high transfection rate can be achieved. The viruses used are genetically modified, so that no functional infectious particles are formed in the transfected cell. The use of DNA viruses as DNA vehicles, however, has been criticized in recent years because of the risk of recombination of non-active viruses to give active viruses.

The use of DNA as an agent in gene therapy and genetic vaccination or for passive immunization (by passive vaccines), e.g. by using coding sequences for antibodies, may, however, also be less advantageous from some points of view. DNA is degraded only relatively slowly in the bloodstream, so that when (foreign) DNA is used as the coding sequence for a desired protein, a formation of anti-DNA antibodies may occur, which has been confirmed in an animal model in the mouse (Gilkeson et al., J. Clin. Invest. 1995, 95: 1398-1402). The possible persistence of (foreign) DNA in the organism can thus lead to a hyperactivation of the immune system, which as is known results in splenomegaly in mice (Montheith et al., Anticancer Drug Res. 1997, 12(5): 421-432). Furthermore, (foreign) DNA can interact with the host genome, and in particular cause mutations by integration into the host genome. Thus, for example, the (foreign) DNA introduced may be inserted into an intact gene, which represents a mutation which can impede or even completely switch off the function of the endogenous gene. On the one hand enzyme systems which are vital for the cell may be destroyed by such integration events, and on the other hand there is also the danger of a transformation of the cell modified in this way into a degenerated state if a gene which is decisive for regulation of cell growth is modified by the integration of the foreign DNA. With the methods to date of gene therapy and genetic vaccination and also of passive immunization, a risk of development of cancer therefore cannot necessarily be ruled out when (foreign) DNA is used. In this context, passive immunization (by so-called "passive vaccines") is to be strictly differentiated from so-called active immunization. In active immunization, an antigen ("active vaccine") is typically administered, after which the organism forms antibodies against this antigen. Active immunization thus creates a permanent immunization of the organism against the particular antigen, which can be associated with the disadvantages described above. In passive immunization, in contrast, only an antiserum or the purified antibody itself ("passive vaccine") is administered to the organism. The coding sequence for the antibody can likewise be administered, as described above, as a so-called passive vaccine for passive immunization.

Summarizing, in the prior art there is an increased demand for and a considerable interest in agents which are suitable for employing antibodies effectively in vivo, in particular for providing increased active compound amounts of antibodies in vivo, without the risks hitherto associated with the use of DNA.

It is thus an object of the present invention to provide an RNA encoding an antibody or a fragment thereof. In particular, it is an object to provide a system for expressing an antibody. It is a further object of the invention to provide such a system, which allows treatment and/or prophylaxis of a variety of diseases with antibodies in a safe and effective manner. It is thus a particular object of the present invention to provide a composition, in particular a passive vaccine, for treatment or prophylaxis of a variety of diseases, such as cancer, cardiovascular diseases, infectious diseases, autoimmune diseases, virus diseases and monogenetic diseases.

The object underlying the present invention is solved by the claimed subject matter.

The present application is filed together with a sequence listing in electronic format. The sequence listing is provided as a file entitled CU01P215WO1_Sequence listing.txt, created on Apr. 26, 2017, which is 50,982 KB in size. The information contained in the electronic format of the sequence listing is incorporated herein by reference in its entirety.

For the sake of clarity and readability the following definitions are provided. Any technical feature mentioned for these definitions may be read on each and every embodiment of the invention. Additional definitions and explanations may be specifically provided in the context of these embodiments.

Adaptive immune response: The adaptive immune response is typically understood to be an antigen-specific response of the immune system. Antigen specificity allows for the generation of responses that are tailored, for example, to specific pathogens or pathogen-infected cells. The ability to mount these tailored responses is usually maintained in the body by "memory cells". Should a pathogen infect the body more than once, these specific memory cells are used to quickly eliminate it. In this context, the first step of an adaptive immune response is the activation of naïve antigen-specific T cells or different immune cells able to induce an antigen-specific immune response by antigen-presenting cells. This occurs in the lymphoid tissues and organs through which naïve T cells are constantly passing. The three cell types that may serve as antigen-presenting cells are dendritic cells, macrophages, and B cells. Each of these cells has a distinct function in eliciting immune responses. Dendritic cells may take up antigens by phagocytosis and macropinocytosis and may become stimulated by contact with e.g. a foreign antigen to migrate to the local lymphoid tissue, where they differentiate into mature dendritic cells. Macrophages ingest particulate antigens such as bacteria and are induced by infectious agents or other appropriate stimuli to express MHC molecules. The unique ability of B cells to bind and internalize soluble protein antigens via their receptors may also be important to induce T cells. MHC-molecules are, typically, responsible for presentation of an antigen to T-cells. Therein, presenting the antigen on MHC molecules leads to activation of T cells, which induces their proliferation and differentiation into armed effector T cells. The most important function of effector T cells is the killing of infected cells by CD8+ cytotoxic T cells and the activation of macrophages by Th1 cells, which together make up cell-mediated immunity, and the activation of B cells by both Th2 and Th1 cells to produce different classes of antibody, thus driving the humoral immune response. T cells recognize an antigen by their T cell receptors which do not recognize and bind the antigen directly, but instead recognize short peptide fragments e.g. of pathogen-derived protein antigens, e.g. so-called epitopes, which are bound to MHC molecules on the surfaces of other cells.

Adaptive immune system: The adaptive immune system is essentially dedicated to eliminate or prevent pathogenic growth. It typically regulates the adaptive immune response by providing the vertebrate immune system with the ability to recognize and remember specific pathogens (to generate immunity), and to mount stronger attacks each time the pathogen is encountered. The system is highly adaptable because of somatic hypermutation (a process of accelerated somatic mutations), and V(D)J recombination (an irreversible genetic recombination of antigen receptor gene segments). This mechanism allows a small number of genes to generate a vast number of different antigen receptors, which are then uniquely expressed on each individual lymphocyte. Because the gene rearrangement leads to an irreversible change in the DNA of each cell, all of the progeny (offspring) of such a cell will then inherit genes encoding the same receptor specificity, including the Memory B cells and Memory T cells that are the keys to long-lived specific immunity.

Adjuvant/adjuvant component: An adjuvant or an adjuvant component in the broadest sense is typically a pharmacological and/or immunological agent that may modify, e.g. enhance, the effect of other agents, such as a drug or vaccine. It is to be interpreted in a broad sense and refers to a broad spectrum of substances. Typically, these substances are able to increase the immunogenicity of antigens. For example, adjuvants may be recognized by the innate immune systems and, e.g., may elicit an innate immune response. "Adjuvants" typically do not elicit an adaptive immune response. Insofar, "adjuvants" do not qualify as antigens. Their mode of action is distinct from the effects triggered by antigens resulting in an adaptive immune response.

Antibody: As used herein, the term "antibody" encompasses various forms of antibodies, preferably monoclonal antibodies, including but not being limited to whole antibodies, antibodies of any (recombinant or naturally occurring) antibody format, human antibodies, chimeric antibodies, humanized antibodies and genetically engineered antibodies (variant or mutant antibodies) as long as the characteristic properties of an antibody are retained. Namely, an antibody recognizes a unique molecule of an antigen via its variable region. In particular, the antibody mediates this function by binding to the antigen. In particular, the term "antibody" refers to both, glycosylated and non-glycosylated immunoglobulins of any isotype or subclass (preferably IgG). An antibody may also be derived from an immunoglobulin, however, an antibody typically comprises an antigen-binding region (of an immunoglobulin) that is in particular able to compete with the "intact" immunoglobulin antibody for specific binding, unless otherwise specified. Preferred examples of antibodies include monoclonal antibodies, bispecific antibodies, minibodies, domain antibodies, synthetic antibodies, antibody mimetics, chimeric antibodies, humanized antibodies, human antibodies, antibody fusions, antibody conjugates, single chain antibodies, antibody derivatives, and antibody analogues. Unless otherwise indicated, the term "antibody" includes, in addition to antibodies comprising two full-length heavy chains and two full-length light chains, derivatives, variants, and antibodies of any formats, which do not comprise two full-length heavy chains and two full-length light chains. In some instances an "antibody" may thus include fewer chains, for example a single chain only. Especially preferred are human or humanized monoclonal antibodies and/or recombinant antibodies, especially as recombinant human monoclonal antibodies. Particularly preferred are human IgG-type antibodies.

Human antibody: The term "human antibody", as used herein, is intended to include antibodies having variable and constant regions derived from human (germ line) immunoglobulin sequences. In other words, the term "human antibodies" refers to antibodies which have human sequences, that is to say in the constant regions (if present) and in the variable regions. Human antibodies are well-known in the state of the art (van Dijk, M. A., and van de Winkel, J. G., *Curr. Opin. Chem. Biol.* 5 (2001) 368-374). Human antibodies can also be produced in transgenic animals (e.g., mice) that are capable, upon immunization, of producing a full repertoire or a selection of human antibodies in the absence of endogenous immunoglobulin production. Transfer of the human germ-line immunoglobulin gene array in such germ-line mutant mice will result in the production of human antibodies upon antigen challenge (see, e.g., Jakobovits, A., et al., *Proc. Natl. Acad. Sci. USA* 90 (1993) 2551-2555; Jakobovits, A., et al., *Nature* 362 (1993) 255-258; Bruggemann, M., et al., *Year Immunol.* 7 (1993) 3340). Human antibodies can also be produced in phage display libraries (Hoogenboom, H. R., and Winter, G., *J. Mol. Biol.* 227 (1992) 381-388; Marks, J. D., et al., *J. Mol. Biol.* 222 (1991) 581-597). The techniques of Cole et al. and Boerner et al. are also available for the preparation of human monoclonal antibodies (Cole et al., *Monoclonal Antibodies and Cancer Therapy*, Alan R. Liss, p. 77 (1985); and Boerner, P., et al., *J. Immunol.* 147 (1991) 86-95). In particular, the term "human antibody" as used herein also comprises antibodies of recombinant antibody formats as long as the variable regions (including the hypervariable regions) have human (germ line) immunoglobulin sequences.

Antigen: In the context of the present invention, the term "antigen" typically refers to a substance, which is capable of being recognized by the immune system, preferably by the adaptive immune system, and which is capable of eliciting an antigen-specific immune response, e.g. by formation of antibodies and/or antigen-specific T cells as part of an adaptive immune response. Typically, an antigen may be or may comprise a peptide or protein, which may be presented by the MHC to T-cells. In the sense of the present invention an antigen may be the product of translation of a provided nucleic acid molecule, preferably an RNA comprising at least one coding sequence as defined herein. In this context, also fragments, variants and derivatives of an antigen, such as a peptide or a protein, comprising at least one epitope are understood as antigens.

Artificial nucleic acid molecule: An artificial nucleic acid molecule may typically be understood to be a nucleic acid molecule, e.g. a DNA or an RNA, that does not occur naturally. In other words, an artificial nucleic acid molecule may be understood as a non-natural nucleic acid molecule. Such nucleic acid molecule may be non-natural due to its individual sequence (which does not occur naturally) and/or due to other modifications, e.g. structural modifications of nucleotides, which do not occur naturally. An artificial nucleic acid molecule may be a DNA molecule, an RNA molecule or a hybrid-molecule comprising DNA and RNA portions. Typically, artificial nucleic acid molecules may be designed and/or generated by genetic engineering methods to correspond to a desired artificial sequence of nucleotides (heterologous sequence). In this context an artificial sequence is usually a sequence that may not occur naturally, i.e. it differs from the wild type sequence by at least one nucleotide. The term "wild type" may be understood as a sequence occurring in nature. Further, the term "artificial nucleic acid molecule" is not restricted to mean "one single molecule" but is, typically, understood to comprise an ensemble of identical molecules. Accordingly, it may relate to a plurality of identical molecules contained in an aliquot.

Bicistronic RNA, multicistronic RNA: A bicistronic or multicistronic RNA is typically an RNA, preferably an mRNA, that typically may have two (bicistronic) or more (multicistronic) open reading frames (ORF). An open reading frame in this context is a sequence of codons that is translatable into a peptide or protein.

Carrier/polymeric carrier: A carrier in the context of the invention may typically be a compound that facilitates transport and/or complexation of another compound (cargo). A polymeric carrier is typically a carrier that is formed of a polymer. A carrier may be associated to its cargo by covalent or non-covalent interaction. A carrier may transport nucleic acids, e.g. RNA or DNA, to the target cells. The carrier may—for some embodiments—be a cationic component.

Cationic component: The term "cationic component" typically refers to a charged molecule, which is positively charged (cation) at a pH value typically from 1 to 9, preferably at a pH value of or below 9 (e.g. from 5 to 9), of or below 8 (e.g. from 5 to 8), of or below 7 (e.g. from 5 to 7), most preferably at a physiological pH, e.g. from 7.3 to 7.4. Accordingly, a cationic component may be any positively charged compound or polymer, preferably a cationic peptide or protein, which is positively charged under physiological conditions, particularly under physiological conditions in vivo. A "cationic peptide or protein" may contain at least one positively charged amino acid, or more than one positively charged amino acid, e.g. selected from Arg, His, Lys or Orn. Accordingly, "polycationic" components are also within the scope exhibiting more than one positive charge under the conditions given.

5'-cap: A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an RNA. Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety.

Cellular immunity/cellular immune response: Cellular immunity relates typically to the activation of macrophages, natural killer cells (NK), antigen-specific cytotoxic T-lymphocytes, and the release of various cytokines in response to an antigen. In more general terms, cellular immunity is not based on antibodies, but on the activation of cells of the immune system. Typically, a cellular immune response may be characterized e.g. by activating antigen-specific cytotoxic T-lymphocytes that are able to induce apoptosis in cells, e.g. specific immune cells like dendritic cells or other cells, displaying epitopes of foreign antigens on their surface. Such cells may be virus-infected or infected with intracellular bacteria, or cancer cells displaying antibodies. Further characteristics may be activation of macrophages and natural killer cells, enabling them to destroy pathogens and stimulation of cells to secrete a variety of cytokines that influence the function of other cells involved in adaptive immune responses and innate immune responses.

DNA: DNA is the usual abbreviation for deoxy-ribonucleic acid. It is a nucleic acid molecule, i.e. a polymer consisting of nucleotides. These nucleotides are usually deoxy-adenosine-monophosphate, deoxy-thymidine-monophosphate, deoxy-guanosine-monophosphate and deoxy-cytidine-monophosphate monomers which are—by themselves—composed of a sugar moiety (deoxyribose), a base moiety and a phosphate moiety, and polymerise by a characteristic backbone structure. The backbone structure is, typically, formed by phosphodiester bonds between the sugar moiety of the nucleotide, i.e. deoxyribose, of a first and a phosphate moiety of a second, adjacent monomer. The specific order of the monomers, i.e. the order of the bases linked to the sugar/phosphate-backbone, is called the DNA sequence. DNA may be single stranded or double stranded. In the double stranded form, the nucleotides of the first strand typically hybridize with the nucleotides of the second strand, e.g. by KT-base-pairing and G/C-base-pairing.

Epitope: In the context of the present invention, the term 'epitope' typically refers to a fragment of an antigen or a variant of an antigen, wherein said fragment is presented by an MHC complex. Such a fragment comprising or consisting of an epitope as used herein may typically comprise from about 5 to about 20 amino acids. An epitope may also be referred to herein as 'antigen determinant'. Epitopes can be distinguished in T cell epitopes and B cell epitopes. T cell epitopes or parts of the proteins in the context of the present invention may comprise fragments preferably having a length of about 6 to about 20 or even more amino acids, e.g. fragments as processed and presented by MHC class I molecules, preferably having a length of about 8 to about 10 amino acids, e.g. 8, 9, or 10, (or even 11, or 12 amino acids), or fragments as processed and presented by MHC class II molecules, preferably having a length of about 13 or more amino acids, e.g. 13, 14, 15, 16, 17, 18, 19, 20 or even more amino acids, wherein these fragments may be selected from any part of the amino acid sequence. These fragments are typically recognized by T cells in form of a complex consisting of the peptide fragment and an MHC molecule, i.e. the fragments are typically not recognized in their native form. B cell epitopes are typically fragments located on the outer surface of (native) protein or peptide antigens as defined herein, preferably having 5 to 15 amino acids, more preferably having 5 to 12 amino acids, even more preferably having 6 to 9 amino acids, which may be recognized by antibodies, i.e. in their native form. Such epitopes of proteins or peptides may furthermore be selected from any of the herein mentioned variants of such proteins or peptides. In this context, antigenic determinants can be conformational or discontinuous epitopes, which are composed of segments of the proteins or peptides as defined herein that are discontinuous in the amino acid sequence of the proteins or peptides as defined herein but are brought together in the three-dimensional structure or continuous or linear epitopes, which are composed of a single polypeptide chain.

Fragment of a sequence: A fragment of a sequence may typically be a shorter portion of a full-length sequence of e.g. a nucleic acid molecule or an amino acid sequence. Accordingly, a fragment, typically, consists of a sequence that is identical to the corresponding stretch within the full-length sequence. A preferred fragment of a sequence in the context of the present invention, consists of a continuous stretch of entities, such as nucleotides or amino acids corresponding to a continuous stretch of entities in the molecule the fragment is derived from, which represents at least 20%, preferably at least 30%, more preferably at least 40%, more preferably at least 50%, even more preferably at least 60%, even more preferably at least 70%, and most preferably at least 80% of the total (i.e. full-length) molecule from which the fragment is derived.

G/C modified: A G/C-modified nucleic acid may typically be a nucleic acid, preferably an artificial nucleic acid molecule as defined herein, based on a modified wild-type sequence comprising a preferably increased number of guanosine and/or cytosine nucleotides as compared to the wild-type sequence. Such an increased number may be generated by substitution of codons containing adenosine or thymidine nucleotides by codons containing guanosine or cytosine nucleotides. If the enriched G/C content occurs in a coding region of DNA or RNA, it makes use of the degeneracy of the genetic code. Accordingly, the codon substitutions preferably do not alter the encoded amino acid residues, but exclusively increase the G/C content of the nucleic acid molecule. As used herein, the term 'G/C modification' comprises, in particular, the modifications of the number of guanosine and/or cytosine nucleotides in the RNA according to the invention, such as GC optimization of sequences, adaptation of sequences to human codon usage, codon optimization or C-optimization of sequences.

Gene therapy: Gene therapy may typically be understood to mean a treatment of a patient's body or isolated elements of a patient's body, for example isolated tissues/cells, by nucleic acids encoding a peptide or protein. It typically may comprise at least one of the steps of a) administration of a nucleic acid, preferably an RNA as defined herein, directly to the patient—by whatever administration route—or in vitro to isolated cells/tissues of the patient, which results in transfection of the patient's cells either in vivo/ex vivo or in vitro; b) transcription and/or translation of the introduced nucleic acid molecule; and optionally c) re-administration of isolated, transfected cells to the patient, if the nucleic acid has not been administered directly to the patient.

Genetic vaccination: Genetic vaccination may typically be understood to be vaccination by administration of a nucleic acid molecule encoding an antigen or an immunogen or fragments thereof. The nucleic acid molecule may be administered to a subject's body or to isolated cells of a subject. Upon transfection of certain cells of the body or upon transfection of the isolated cells, the antigen or immunogen may be expressed by those cells and subsequently presented to the immune system, eliciting an adaptive, i.e. antigen-specific immune response. Accordingly, genetic vaccination typically comprises at least one of the steps of a) administration of a nucleic acid, preferably an artificial nucleic acid molecule as defined herein, to a subject, preferably a patient, or to isolated cells of a subject, preferably a patient, which usually results in transfection of the subject's cells either in vivo or in vitro; b) transcription and/or translation of the introduced nucleic acid molecule; and optionally c) re-administration of isolated, transfected cells to the subject, preferably the patient, if the nucleic acid has not been administered directly to the patient.

Heterologous sequence: Two sequences are typically understood to be 'heterologous' if they are not derivable from the same gene. I.e., although heterologous sequences may be derivable from the same organism, they naturally (in nature) do not occur in the same nucleic acid molecule, such as in the same mRNA.

Humoral immunity/humoral immune response: Humoral immunity refers typically to antibody production and optionally to accessory processes accompanying antibody production. A humoral immune response may be typically characterized, e.g., by Th2 activation and cytokine production, germinal center formation and isotype switching, affinity maturation and memory cell generation. Humoral immunity also typically may refer to the effector functions of antibodies, which include pathogen and toxin neutralization, classical complement activation, and opsonin promotion of phagocytosis and pathogen elimination.

Immunogen: In the context of the present invention, an immunogen may be typically understood to be a compound that is able to stimulate an immune response. Preferably, an immunogen is a peptide, polypeptide, or protein. In a particularly preferred embodiment, an immunogen in the sense of the present invention is the product of translation of a provided nucleic acid molecule, preferably an artificial nucleic acid molecule as defined herein. Typically, an immunogen elicits at least an adaptive immune response.

Immunostimulatory composition: In the context of the invention, an immunostimulatory composition may be typically understood to be a composition containing at least one component which is able to induce an immune response or from which a component, which is able to induce an immune response, is derivable. Such immune response may be preferably an innate immune response or a combination of an adaptive and an innate immune response. Preferably, an immunostimulatory composition in the context of the invention contains at least one artificial nucleic acid molecule, more preferably an RNA, for example an mRNA molecule. The immunostimulatory component, such as the mRNA may be complexed with a suitable carrier. Thus, the immunostimulatory composition may comprise an mRNA/carrier-complex. Furthermore, the immunostimulatory composition may comprise an adjuvant and/or a suitable vehicle for the immunostimulatory component, such as the mRNA.

Immune response: An immune response may typically be a specific reaction of the adaptive immune system to a particular antigen (so called specific or adaptive immune response) or an unspecific reaction of the innate immune system (so called unspecific or innate immune response), or a combination thereof.

Immune system: The immune system may protect organisms from infection. If a pathogen succeeds in passing a physical barrier of an organism and enters this organism, the innate immune system provides an immediate, but non-specific response. If pathogens evade this innate response, vertebrates possess a second layer of protection, the adaptive immune system. Here, the immune system adapts its response during an infection to improve its recognition of the pathogen. This improved response is then retained after the pathogen has been eliminated, in the form of an immunological memory, and allows the adaptive immune system to mount faster and stronger attacks each time this pathogen is encountered. According to this, the immune system comprises the innate and the adaptive immune system. Each of these two parts typically contains so called humoral and cellular components.

Immunostimulatory RNA: An immunostimulatory RNA (isRNA) in the context of the invention may typically be an RNA that is able to induce an innate immune response. It usually does not have an open reading frame and thus does not provide a peptide-antigen or immunogen but elicits an immune response e.g. by binding to a specific kind of Toll-like-receptor (TLR) or other suitable receptors. However, of course also mRNAs having an open reading frame and coding for a peptide/protein may induce an innate immune response and, thus, may be immunostimulatory RNAs.

Innate immune system: The innate immune system, also known as non-specific (or unspecific) immune system, typically comprises the cells and mechanisms that defend the host from infection by other organisms in a non-specific manner. This means that the cells of the innate system may recognize and respond to pathogens in a generic way, but unlike the adaptive immune system, it does not confer long-lasting or protective immunity to the host. The innate immune system may be, e.g., activated by ligands of Toll-like receptors (TLRs) or other auxiliary substances such as lipopolysaccharides, TNF-alpha, CD40 ligand, or cytokines, monokines, lymphokines, interleukins or chemokines, IL-1, IL-2, IL-3, IL-4, IL-5, IL-6, IL-7, IL-8, IL-9, IL-10, IL-11, IL-12, IL-13, IL-14, IL-15, IL-16, IL-17, IL-18, IL-19, IL-20, IL-21, IL-22, IL-23, IL-24, IL-25, IL-26, IL-27, IL-28, IL-29, IL-30, IL-31, IL-32, IL-33, IFN-alpha, IFN-beta, IFN-gamma, GM-CSF, G-CSF, M-CSF, LT-beta, TNF-alpha, growth factors, and hGH, a ligand of human Toll-like receptor TLR1, TLR2, TLR3, TLR4, TLR5, TLR6, TLR7, TLR8, TLR9, TLR10, a ligand of murine Toll-like receptor TLR1, TLR2, TLR3, TLR4, TLR5, TLR6, TLR7, TLR8, TLR9, TLR10, TLR11, TLR12 or TLR13, a ligand of a NOD-like receptor, a ligand of a RIG-I like receptor, an immunostimulatory nucleic acid, an immunostimulatory RNA (isRNA), a CpG-DNA, an antibacterial agent, or an anti-viral agent. The pharmaceutical composition according to the present invention may comprise one or more such substances. Typically, a response of the innate immune system includes recruiting immune cells to sites of infection, through the production of chemical factors, including specialized chemical mediators, called cytokines; activation of the complement cascade; identification and removal of foreign substances present in organs, tissues, the blood and lymph, by specialized white blood cells; activation of the adaptive immune system; and/or acting as a physical and chemical barrier to infectious agents.

Cloning site: A cloning site is typically understood to be a segment of a nucleic acid molecule, which is suitable for insertion of a nucleic acid sequence, e.g., a nucleic acid sequence comprising an open reading frame. Insertion may be performed by any molecular biological method known to the one skilled in the art, e.g. by restriction and ligation. A cloning site typically comprises one or more restriction enzyme recognition sites (restriction sites). These one or more restrictions sites may be recognized by restriction enzymes which cleave the DNA at these sites. A cloning site which comprises more than one restriction site may also be termed a multiple cloning site (MCS) or a polylinker.

Nucleic acid molecule: A nucleic acid molecule is a molecule comprising, preferably consisting of nucleic acid components. The term nucleic acid molecule preferably refers to DNA or RNA molecules. It is preferably used synonymous with the term "polynucleotide". Preferably, a nucleic acid molecule is a polymer comprising or consisting of nucleotide monomers, which are covalently linked to each other by phosphodiester-bonds of a sugar/phosphate-backbone. The term "nucleic acid molecule" also encompasses modified nucleic acid molecules, such as base-modified, sugar-modified or backbone-modified etc. DNA or RNA molecules.

Open reading frame: An open reading frame (ORF) in the context of the invention may typically be a sequence of several nucleotide triplets, which may be translated into a peptide or protein. An open reading frame preferably contains a start codon, i.e. a combination of three subsequent nucleotides coding usually for the amino acid methionine (ATG), at its 5'-end and a subsequent region, which usually exhibits a length which is a multiple of 3 nucleotides. An ORF is preferably terminated by a stop-codon (e.g., TAA, TAG, TGA). Typically, this is the only stop-codon of the open reading frame. Thus, an open reading frame in the context of the present invention is preferably a nucleotide sequence, consisting of a number of nucleotides that may be divided by three, which starts with a start codon (e.g. ATG) and which preferably terminates with a stop codon (e.g., TAA, TGA, or TAG). The open reading frame may be isolated or it may be incorporated in a longer nucleic acid sequence, for example in a vector or an mRNA. An open reading frame may also be termed "(protein) coding region" or, preferably, "coding sequence".

Peptide: A peptide or polypeptide is typically a polymer of amino acid monomers, linked by peptide bonds. It typically contains less than 50 monomer units. Nevertheless, the term peptide is not a disclaimer for molecules having more than 50 monomer units. Long peptides are also called polypeptides, typically having between 50 and 600 monomeric units.

Pharmaceutically effective amount: A pharmaceutically effective amount in the context of the invention is typically understood to be an amount that is sufficient to induce a pharmaceutical effect, such as an immune response, altering a pathological level of an expressed peptide or protein, or substituting a lacking gene product, e.g., in case of a pathological situation.

Protein: A protein typically comprises one or more peptides or polypeptides. A protein is typically folded into 3-dimensional form, which may be required for the protein to exert its biological function.

Poly(A) sequence: A poly(A) sequence, also called poly (A) tail or 3'-poly(A) tail, is typically understood to be a sequence of adenosine nucleotides, e.g., of up to about 400 adenosine nucleotides, e.g. from about 5 to about 400, preferably from about 10 to about 200, more preferably from about 10 to about 100, even more preferably from about 40 to about 80, most preferably from about 50 to about 70 adenosine nucleotides. A poly(A) sequence is typically located at the 3'end of an mRNA. In the context of the present invention, a poly(A) sequence may be located within an mRNA or any other nucleic acid molecule, such as, e.g., in a vector, for example, in a vector serving as template for the generation of an RNA, preferably an mRNA, e.g., by transcription of the vector.

Polyadenylation: Polyadenylation is typically understood to be the addition of a poly(A) sequence to a nucleic acid molecule, such as an RNA molecule, e.g. to a premature mRNA. Polyadenylation may be induced by a so-called polyadenylation signal. This signal is preferably located within a stretch of nucleotides at the 3'-end of a nucleic acid molecule, such as an RNA molecule, to be polyadenylated. A polyadenylation signal typically comprises a hexamer consisting of adenine and uracil/thymine nucleotides, preferably the hexamer sequence AAUAAA. Other sequences, preferably hexamer sequences, are also conceivable. Polyadenylation typically occurs during processing of a pre-mRNA (also called premature-mRNA). Typically, RNA maturation (from pre-mRNA to mature mRNA) comprises the step of polyadenylation.

Restriction site: A restriction site, also termed restriction enzyme recognition site, is a nucleotide sequence recognized by a restriction enzyme. A restriction site is typically a short, preferably palindromic nucleotide sequence, e.g. a sequence comprising 4 to 8 nucleotides. A restriction site is preferably specifically recognized by a restriction enzyme. The restriction enzyme typically cleaves a nucleotide sequence comprising a restriction site at this site. In a double-stranded nucleotide sequence, such as a double-stranded DNA sequence, the restriction enzyme typically cuts both strands of the nucleotide sequence.

RNA, mRNA: RNA is the usual abbreviation for ribo-nucleic-acid. It is a nucleic acid molecule, i.e. a polymer consisting of nucleotides. These nucleotides are usually adenosine-monophosphate, uridine-monophosphate, guanosine-monophosphate and cytidine-monophosphate monomers which are connected to each other along a so-called backbone. The backbone is formed by phosphodiester bonds between the sugar, i.e. ribose, of a first and a phosphate moiety of a second, adjacent monomer. The specific succession of the monomers is called the RNA-sequence. Usually RNA may be obtainable by transcription of a DNA-sequence, e.g., inside a cell. In eukaryotic cells, transcription is typically performed inside the nucleus or the mitochondria. In vivo, transcription of DNA usually results in the so-called premature RNA which has to be processed into so-called messenger-RNA, usually abbreviated as mRNA. Processing of the premature RNA, e.g. in eukaryotic organisms, comprises a variety of different posttranscriptional-modifications such as splicing, 5'-capping, polyadenylation, export from the nucleus or the mitochondria and the like. The sum of these processes is also called maturation of RNA. The mature messenger RNA usually provides the nucleotide sequence that may be translated into an amino-acid sequence of a particular peptide or protein. Typically, a mature mRNA comprises a 5'-cap, a 5'-UTR, an open reading frame, a 3'-UTR and a poly(A) sequence. Aside from messenger RNA, several non-coding types of RNA exist which may be involved in regulation of transcription and/or translation.

Sequence of a nucleic acid molecule: The sequence of a nucleic acid molecule is typically understood to be the particular and individual order, i.e. the succession of its nucleotides. The sequence of a protein or peptide is typically understood to be the order, i.e. the succession of its amino acids.

Sequence identity: Two or more sequences are identical if they exhibit the same length and order of nucleotides or amino acids. The percentage of identity typically describes the extent to which two sequences are identical, i.e. it typically describes the percentage of nucleotides that correspond in their sequence position with identical nucleotides of a reference-sequence. For determination of the degree of identity, the sequences to be compared are considered to exhibit the same length, i.e. the length of the longest sequence of the sequences to be compared. This means that a first sequence consisting of 8 nucleotides is 80% identical to a second sequence consisting of 10 nucleotides comprising the first sequence. In other words, in the context of the present invention, identity of sequences preferably relates to the percentage of nucleotides of a sequence which have the same position in two or more sequences having the same length. Gaps are usually regarded as non-identical positions, irrespective of their actual position in an alignment.

Stabilized nucleic acid molecule: A stabilized nucleic acid molecule is a nucleic acid molecule, preferably a DNA or RNA molecule that is modified such, that it is more stable to disintegration or degradation, e.g., by environmental factors or enzymatic digest, such as by an exo- or endonuclease degradation, than the nucleic acid molecule without the modification. Preferably, a stabilized nucleic acid molecule in the context of the present invention is stabilized in a cell, such as a prokaryotic or eukaryotic cell, preferably in a mammalian cell, such as a human cell. The stabilization effect may also be exerted outside of cells, e.g. in a buffer solution etc., for example, in a manufacturing process for a pharmaceutical composition comprising the stabilized nucleic acid molecule.

Transfection: The term "transfection" refers to the introduction of nucleic acid molecules, such as DNA or RNA (e.g. mRNA) molecules, into cells, preferably into eukaryotic cells. In the context of the present invention, the term "transfection" encompasses any method known to the skilled person for introducing nucleic acid molecules into cells, preferably into eukaryotic cells, such as into mammalian cells. Such methods encompass, for example, electroporation, lipofection, e.g. based on cationic lipids and/or liposomes, calcium phosphate precipitation, nanoparticle based transfection, virus based transfection, or transfection based on cationic polymers, such as DEAE-dextran or polyethylenimine etc. Preferably, the introduction is non-viral.

Vaccine: A vaccine is typically understood to be a prophylactic or therapeutic material providing at least one antigen, preferably an immunogen. The antigen or immunogen may be derived from any material that is suitable for vaccination. For example, the antigen or immunogen may be derived from a pathogen, such as from bacteria or virus particles etc., or from a tumor or cancerous tissue. The antigen or immunogen stimulates the body's adaptive immune system to provide an adaptive immune response.

Vector: The term "vector" refers to a nucleic acid molecule, preferably to an artificial nucleic acid molecule. A vector in the context of the present invention is suitable for incorporating or harboring a desired nucleic acid sequence, such as a nucleic acid sequence comprising an open reading frame. Such vectors may be storage vectors, expression vectors, cloning vectors, transfer vectors etc. A storage vector is a vector, which allows the convenient storage of a nucleic acid molecule, for example, of an mRNA molecule. Thus, the vector may comprise a sequence corresponding, e.g., to a desired mRNA sequence or a part thereof, such as a sequence corresponding to the coding sequence and the 3'-UTR of an mRNA. An expression vector may be used for production of expression products such as RNA, e.g. mRNA, or peptides, polypeptides or proteins. For example, an expression vector may comprise sequences needed for transcription of a sequence stretch of the vector, such as a promoter sequence, e.g. an RNA polymerase promoter sequence. A cloning vector is typically a vector that contains a cloning site, which may be used to incorporate nucleic acid sequences into the vector. A cloning vector may be, e.g., a plasmid vector or a bacteriophage vector. A transfer vector may be a vector, which is suitable for transferring nucleic acid molecules into cells or organisms, for example, viral vectors. A vector in the context of the present invention may be, e.g., an RNA vector or a DNA vector. Preferably, a vector is a DNA molecule. Preferably, a vector in the sense of the present application comprises a cloning site, a selection marker, such as an antibiotic resistance factor, and a sequence suitable for multiplication of the vector, such as an origin of replication. Preferably, a vector in the context of the present application is a plasmid vector.

Vehicle: A vehicle is typically understood to be a material that is suitable for storing, transporting, and/or administering a compound, such as a pharmaceutically active compound. For example, it may be a physiologically acceptable liquid, which is suitable for storing, transporting, and/or administering a pharmaceutically active compound.

3'-untranslated region (3'-UTR): Generally, the term "3'-UTR" refers to a part of the artificial nucleic acid molecule, which is located 3' (i.e. "downstream") of an open reading frame and which is not translated into protein. Typically, a 3'-UTR is the part of an mRNA which is located between the protein coding region (open reading frame (ORF) or coding sequence (CDS)) and the poly(A) sequence of the mRNA. In the context of the invention, the term 3'-UTR may also comprise elements, which are not encoded in the template, from which an RNA is transcribed, but which are added after transcription during maturation, e.g. a poly(A) sequence. A 3'-UTR of the mRNA is not translated into an amino acid sequence. The 3'-UTR sequence is generally encoded by the gene, which is transcribed into the respective mRNA during the gene expression process. The genomic sequence is first transcribed into pre-mature mRNA, which comprises optional introns. The pre-mature mRNA is then further processed into mature mRNA in a maturation process. This maturation process comprises the steps of 5'capping, splicing the pre-mature mRNA to excise optional introns and modifications of the 3'-end, such as polyadenylation of the 3'-end of the pre-mature mRNA and optional endo-/or exonuclease cleavages etc. In the context of the present invention, a 3'-UTR corresponds to the sequence of a mature mRNA, which is located between the stop codon of the protein coding region, preferably immediately 3' to the stop codon of the protein coding region, and the poly(A) sequence of the mRNA. The term "corresponds to" means that the 3'-UTR sequence may be an RNA sequence, such as in the mRNA sequence used for defining the 3'-UTR sequence, or a DNA sequence, which corresponds to such RNA sequence. In the context of the present invention, the term "a 3'-UTR of a gene", such as "a 3'-UTR of a ribosomal protein gene", is the sequence, which corresponds to the 3'-UTR of the mature mRNA derived from this gene, i.e. the mRNA obtained by transcription of the gene and maturation of the pre-mature mRNA. The term "3'-UTR of a gene" encompasses the DNA sequence and the RNA sequence (both sense and antisense strand and both mature and immature) of the 3'-UTR.

5'-untranslated region (5'-UTR): A 5'-UTR is typically understood to be a particular section of messenger RNA (mRNA). It is located 5' of the open reading frame of the mRNA. Typically, the 5'-UTR starts with the transcriptional start site and ends one nucleotide before the start codon of the open reading frame. The 5'-UTR may comprise elements for controlling gene expression, also called regulatory elements. Such regulatory elements may be, for example, ribosomal binding sites. The 5'-UTR may be post-transcriptionally modified, for example by addition of a 5'-CAP. In the context of the present invention, a 5'-UTR corresponds to the sequence of a mature mRNA, which is located between the 5'-CAP and the start codon. Preferably, the 5'-UTR corresponds to the sequence, which extends from a nucleotide located 3' to the 5'-CAP, preferably from the nucleotide located immediately 3' to the 5'-CAP, to a nucleotide located 5' to the start codon of the protein coding region, preferably to the nucleotide located immediately 5' to the start codon of the protein coding region. The nucleotide located immediately 3' to the 5'-CAP of a mature mRNA typically corresponds to the transcriptional start site. The term "corresponds to" means that the 5'-UTR sequence may be an RNA sequence, such as in the mRNA sequence used for defining the 5'-UTR sequence, or a DNA sequence, which corresponds to such RNA sequence. In the context of the present invention, the term "a 5'-UTR of a gene" is the sequence, which corresponds to the 5'-UTR of the mature mRNA derived from this gene, i.e. the mRNA obtained by transcription of the gene and maturation of the pre-mature mRNA. The term "5'-UTR of a gene" encompasses the DNA sequence and the RNA sequence of the 5'-UTR. By the inventive embodiments such a 5'-UTR may be provided 5'-terminal to the coding sequence. Its length is typically less than 500, 400, 300, 250 or less than 200 nucleotides. In other embodiments its length may be in the range of at least 10, 20, 30 or 40, preferably up to 100 or 150, nucleotides.

5'Terminal Oligopyrimidine Tract (TOP): The 5'terminal oligopyrimidine tract (TOP) is typically a stretch of pyrimidine nucleotides located in the 5' terminal region of a nucleic acid molecule, such as the 5' terminal region of certain mRNA molecules or the 5' terminal region of a functional entity, e.g. the transcribed region, of certain genes. The sequence starts with a cytidine, which usually corresponds to the transcriptional start site, and is followed by a stretch of usually about 3 to 30 pyrimidine nucleotides. For example, the TOP may comprise 3, 4, 5, 6, 7, 8, 9, 10, 11, 12, 13, 14, 15, 16, 17, 18, 19, 20, 21, 22, 23, 24, 25, 26, 27, 28, 29, 30 or even more nucleotides. The pyrimidine stretch and thus the 5' TOP ends one nucleotide 5' to the first purine nucleotide located downstream of the TOP. Messenger RNA that contains a 5'terminal oligopyrimidine tract is often referred to as TOP mRNA. Accordingly, genes that provide such messenger RNAs are referred to as TOP genes. TOP sequences have, for example, been found in genes and mRNAs encoding peptide elongation factors and ribosomal proteins.

TOP motif: In the context of the present invention, a TOP motif is a nucleic acid sequence which corresponds to a 5'TOP as defined above. Thus, a TOP motif in the context of the present invention is preferably a stretch of pyrimidine nucleotides having a length of 3-30 nucleotides. Preferably, the TOP-motif consists of at least 3 pyrimidine nucleotides, preferably at least 4 pyrimidine nucleotides, preferably at least 5 pyrimidine nucleotides, more preferably at least 6 nucleotides, more preferably at least 7 nucleotides, most preferably at least 8 pyrimidine nucleotides, wherein the stretch of pyrimidine nucleotides preferably starts at its 5'end with a cytosine nucleotide. In TOP genes and TOP mRNAs, the TOP-motif preferably starts at its 5'end with the transcriptional start site and ends one nucleotide 5' to the first purin residue in said gene or mRNA. A TOP motif in the sense of the present invention is preferably located at the 5'end of a sequence, which represents a 5'UTR, or at the 5'end of a sequence, which codes for a 5'UTR. Thus, preferably, a stretch of 3 or more pyrimidine nucleotides is called "TOP motif" in the sense of the present invention if this stretch is located at the 5'end of a respective sequence, such as the artificial nucleic acid molecule, the 5'UTR element of the artificial nucleic acid molecule, or the nucleic acid sequence which is derived from the 5'UTR of a TOP gene as described herein. In other words, a stretch of 3 or more pyrimidine nucleotides, which is not located at the 5'-end of a 5'UTR or a 5'UTR element but anywhere within a 5'UTR or a 5'UTR element, is preferably not referred to as "TOP motif".

TOP gene: TOP genes are typically characterised by the presence of a 5' terminal oligopyrimidine tract. Furthermore, most TOP genes are characterized by a growth-associated translational regulation. However, also TOP genes with a tissue specific translational regulation are known. As defined above, the 5'UTR of a TOP gene corresponds to the sequence of a 5'UTR of a mature mRNA derived from a TOP gene, which preferably extends from the nucleotide located 3' to the 5'-CAP to the nucleotide located 5' to the start codon. A 5'UTR of a TOP gene typically does not comprise any start codons, preferably no upstream AUGs (uAUGs) or upstream open reading frames (uORFs). Therein, upstream AUGs and upstream open reading frames are typically understood to be AUGs and open reading frames that occur 5' of the start codon (AUG) of the open reading frame that should be translated. The 5'UTRs of TOP genes are generally rather short. The lengths of 5'UTRs of TOP genes may vary between 20 nucleotides up to 500 nucleotides, and are typically less than about 200 nucleotides, preferably less than about 150 nucleotides, more preferably less than about 100 nucleotides. Exemplary 5'UTRs of TOP genes in the sense of the present invention are the nucleic acid sequences extending from the nucleotide at position 5 to the nucleotide located immediately 5' to the start codon (e.g. the ATG) in the sequences according to SEQ ID NOs: 1-1363 of the patent application WO2013/143700, whose disclosure is incorporated herewith by reference. In this context, a particularly preferred fragment of a 5'UTR of a TOP gene is a 5'UTR of a TOP gene lacking the 5'TOP motif. The terms "5'UTR of a TOP gene" or "5'-TOP UTR" preferably refer to the 5'UTR of a naturally occurring TOP gene.

RNA Encoding an Antibody or a Fragment Thereof

In a first aspect, the present invention provides an RNA comprising at least one coding sequence encoding an antibody, or a fragment or variant of an antibody.

As used herein, the term "antibody" refers to antibodies of any antibody format. Typically, an antibody recognizes (and binds to) an antigen. To this end, an antibody usually comprises at least one antigen-binding site, which is also referred to as "paratope" and which recognizes (and binds to) an epitope on the antigen. A paratope typically comprises a set of complementary determining regions (CDRs) and usually contains parts of the light chain and parts of the heavy chain of the antibody. For example, a paratope of native IgG comprises three CDRs of the heavy chain (CDRH1, CDRH2 and CDRH3) and three CDRs of the light chain (CDRL1, CDRL2, and CDRL3). The CDRs of an antibody are arranged in the antibody's variable region: CDRH1, CDRH2 and CDRH3 in the heavy chain variable region ($V_H$) and CDRL1, CDRL2, and CDRL3 in the light chain variable region ($V_L$). In addition, an antibody may comprise a constant region (on heavy and light chain: $C_H$ and $C_L$, respectively). In native IgG the heavy chain constant region comprises three domains (CH1, CH2 and CH3), whereas the light chain constant region comprises one domain only (see also FIG. 1). Accordingly, an antibody is typically an immunoglobulin or is derived from an immunoglobulin. An antibody may fulfil different functions by recognizing (and binding to) an antigen, such as neutralization, agglutination, precipitation and/or complement activation. Neutralizing antibodies typically block parts of the surface of a bacterial cell or virion to render its attack ineffective. In agglutination antibodies "glue together" (foreign) cells into clumps that are attractive targets for phagocytosis. In precipitation antibodies "glue together" serum-soluble antigens, forcing them to precipitate out of solution in clumps that are attractive targets for phagocytosis. In complement activation antibodies that are latched onto a (foreign) cell encourage complement to attack it with a membrane attack complex, thereby leading to lysis of the (foreign) cell or to encouragement of inflammation by chemotactically attracting inflammatory cells.

In the context of the present invention, an "RNA comprising at least one coding sequence encoding an antibody, or a fragment or variant of an antibody" includes any RNA which encodes an antibody or a fragment or variant of an antibody. More generally, the RNA of the present invention contains at least one coding region, wherein the at least one coding region codes for at least one antibody or a fragment or variant of an antibody. If more than one coding region is contained in the RNA molecule of the invention, the second, third etc. coding region may code for other peptides/proteins and/or may code for antibodies or fragments or variants thereof as well, which may be the same or distinct from the first antibody coding region. In a preferred embodiment, the inventive RNA contains at least two coding regions, all of them coding for identical or distinct antibodies or fragments or variants thereof. For example, distinct fragments of an antibody may be encoded by different coding regions on the same RNA molecule. In still another embodiment of the present invention, an inventive RNA may code for more than one antibody or a fragment or variant of an antibody within the same coding region. In summary, the inventive RNA may be mono-, bi- or multicistronic.

The RNA according to the invention can be single-stranded or double-stranded, linear or circular, or in particular in the form of mRNA. The RNA according to the invention is particularly preferably in the form of single-stranded RNA, even more preferably in the form of mRNA.

The RNA according to the invention preferably has a length of from 50 to 15,000 nucleotides, more preferably a length of from 50 to 10,000 nucleotides, even more preferably a length of from 500 to 10,000 nucleotides and most preferably a length of from 500 to 7,000, 500 to 5,000 or 700 to 3,000 nucleotides.

In the context of the present invention, the antibodies coded by the RNA according to the invention can be chosen from all antibodies, e.g. from all antibodies which are generated by recombinant methods or are naturally occurring and are known to a person skilled in the art from the prior art, in particular antibodies which are (can be) employed for therapeutic purposes or for diagnostic or for research purposes or have been found with particular diseases, e.g. cancer diseases, infectious diseases etc.

In the context of the present invention, antibodies or fragments or variants thereof, which are encoded by the RNA according to the invention, typically include all antibodies or fragments or variants thereof which are known to a person skilled in the art, e.g. naturally occurring antibodies or antibodies generated in a host organism by immunization, antibodies or fragments or variants thereof prepared by recombinant methods which have been isolated and identified from naturally occurring antibodies or antibodies generated in a host organism by (conventional) immunization or have been generated with the aid of molecular biology methods, as well as chimeric antibodies or fragments or variants thereof, human antibodies or fragments or variants thereof, humanized antibodies or fragments or variants thereof, bispecific antibodies or fragments or variants thereof, and intrabodies or fragments or variants thereof, i.e. antibodies expressed in cells and possibly localized in particular cell compartments.

RNA molecules according to the invention can also be prepared on the basis of polyclonal antibodies or fragments or variants thereof or, as an antibody-coding RNA cocktail, can have a polyclonal character. In the context of this invention, polyclonal antibodies are typically mixtures of antibodies against a specific antigen or immunogen or epitope of a protein which have been generated by immunization of a host organism, for example mammals, i.e. animals, including cattle, pigs, dogs, cats, donkeys, monkeys, including rodents, e.g. mice, hamsters, rabbits etc., and man. Polyclonal antibodies conventionally recognize different epitopes or regions of the same specific antigen, each of these epitopes in turn being capable of generating a clone of B lymphocytes which produces an antibody against this epitope. From such polyclonal antibodies or from the antibody sera obtained from the host organism, the individual antibodies specific against the particular epitopes can be obtained by individualization to monoclonal antibodies. The present invention accordingly also provides RNA which codes for a monoclonal antibody, or a fragment or variant thereof, obtained by individualization of polyclonal antibodies.

Monoclonal antibodies in the context of this invention are therefore typically antibodies which are specific for a particular antigen or epitope (of a protein), i.e. bind this antigen or epitope (of a protein) with a high affinity, and conventionally are expressed by a hybridoma cell. For the preparation of such monoclonal antibodies, the corresponding antigen or immunogen or epitope of a protein is typically injected at least once, but typically several times, into a host organism as described here, as a result of which the immune system of the host organism, in the presence of suitable adjuvants, is preferably stimulated to antibody production via activation of correspondingly specific B cells. The B lymphocytes are then conventionally selectively purified from the spleen or other organs or fluids suitable for this from an animal immunized in this manner, and are fused with an immortal myeloma cell to give the so-called hybridoma cell. After selection methods and cloning of the hybridomas or hybridoma cells formed, those clones which secernate, i.e. express and secrete, antibodies of the desired specificity can be determined. These clones can be isolated and sequenced with known molecular biology methods. The data obtained from such a sequencing can serve further in a nucleic acid synthesis for generation of synthetic DNA sequences or for screening a cDNA library and isolation of the cDNA fragments and generation of a DNA or nucleic acid template for in vitro or in vivo synthesis of the RNA according to the invention which codes for an antibody. Where appropriate, the RNA contained in the hybridomas can also be isolated, for example by fractionation, and subsequently the RNA molecules according to the invention which code for the hybridoman antibody can be purified by methods known to the person skilled in the art.

Nevertheless, RNA molecules which code for non-human monoclonal or polyclonal antibody or fragments or variants thereof, e.g. murine monoclonal antibodies or monoclonal antibodies from other, as described here, non-human host organisms or hybridoma cells are of only limited suitability for therapeutic use in humans, since in the human organism itself they conventionally cause an immune reaction with formation of human anti-antibodies directed against these non-human host antibodies. As a result, such non-human monoclonal or polyclonal antibodies as a rule can be administered to a person only a single time. To by-pass this problem, RNA molecules which code for chimeric, humanized and human antibodies can also be provided according to the invention.

Chimeric antibodies in the context of the present invention are preferably antibodies in which the constant domains of an antibody as described here have been replaced by human sequences. Preferably, chimeric antibodies are formed from monoclonal or polyclonal antibodies as described here.

Humanized antibodies in the context of the present invention are antibodies in which the constant and variable regions described above of the non-human monoclonal or polyclonal antibodies, with the exception of the hypervariable regions, have been replaced by human sequences.

RNA molecules which code for human antibodies, i.e. antibodies which have human sequences, that is to say in the constant regions (if present) and in the variable regions, including the hypervariable regions, or fragments or variants thereof can furthermore be used in the context of the present invention. Such RNA molecules which code for human antibodies can be isolated from human tissue or originate from immunized host organisms as described here, e.g. mice, which are then transgenic for the human IgG gene locus.

Preferably, the at least one coding sequence of the RNA according to the invention encodes an antibody, preferably as defined herein, or a fragment or variant thereof, wherein the antibody is preferably selected from the group consisting of AAB-003; Abagovomab; Abciximab; Abituzumab; Abrilumab; Actoxumab; Adalimumab; Aducanumab; Afasevikumab; Aflibercept; Afutuzuab; Afutuzumab; Alacizumab_pegol; Alemtuzumab; Alirocumab; ALX-0061; Amatuximab; Anetumab_ravtansine; Anifrolumab; Anrukinzumab; Apolizumab; Apomab; Aquaporumab; Arcitumomab_99tc; Ascrinvacumab; Aselizuab; Atezolizumab; Atinumab; Atlizuab; Aurograb; Avelumab; Bapineuzumab; Basiliximab; Bavituximab; Begelomab; Benralizumab; Betalutin; Bevacituzeab; Bevacizumab_154-aspartic_acid; Bevacizumab_154-substitution; Bevacizumab_180-serine; Bevacizumab_180-substitution; Bevacizumab_beta; Bevacizumab; Bevacizumab-rhuMAb-VEGF; Bezlotoxumab; Bimagrumab; Bimekizumab; Bleselumab; Blinatumomab; Blinatumumab; Blontuvetmab; Blosozumab; Bococizumab; Brentuximab_vedotin; Briakinumab; Brodalumab; Brolucizumab; Brontictuzumab; BTT-1023; Burosumab; Canakinumab; Cantuzumab; Cantuzumab_mertansine; Cantuzumab_ravtansine; Caplacizumab; Carlumab; Cergutuzumab_amunaleukin; Certolizumab_pegol; Cetuximab; Citatuzumab_bogatox; Cixutumumab; Clazakizumab; Clivatuzumab_tetraxetan; Codrituzumab; Coltuximab_ravtansine; Conatumumab_CV; Conatumumab; Concizumab; Crenezumab; Crotedumab; Dacetuzumab; Dacliximab; Daclizumab; Dalotuzumab; Dapirolizumab_pegol; Daratumumab; Dectrekumab; Demcizumab; Denintuzumab_mafodotin; Denosumab; Depatuxizumab; Depatuxizumab_mafodotin; Dinutuximab_beta; Dinutuximab; Diridavumab; Domagrozumab; Drozituab; Drozitumab; Duligotumab; Duligotuzumab; Dupilumab; Durvalumab; Dusigitumab; Ecromeximab; Eculizumab; Efalizumab; Efungumab; Eldelumab; Elgemtumab; Elotuzumab; Emactuzumab; Emibetuzumab; Emicizumab; Enavatuzumab; Enfortumab; Enfortumabvedotin; Enoblituzumab; Enokizumab; Enoticumab; Ensituximab; Entolimod; Epratuzumab; Eptacog_beta; Erlizuab; Etaracizumab; Etrolizuab; Etrolizumab; Evinacumab; Evolocumab; Exbivirumab; Farletuzumab; Fasinumab; Fezakinumab; FG-3019; Fibatuzumab; Ficlatuzumab; Figitumumab; Firivumab; Flanvotumab; Fletikumab; Fontolizumab; Foralumab; Foravirumab; Fresolimumab; Fulranumab; Futuximab; Galcanezumab; Galiximab; Ganitumab; Gantenerumab; Gemtuzumab; Gemtuzumab_ozogamicin; Gevokizumab; Girentuximab; Glembatumumab; Goilixiab; Guselkumab; HuMab-001; HuMab-005; HuMab-006; HuMab-019; HuMab-021; HuMab-025; HuMab-027; HuMab-032; HuMab-033; HuMab-035; HuMab-036; HuMab-041; HuMab-044; HuMab-049; HuMab-050; HuMab-054; HuMab-055; HuMab-059; HuMab-060; HuMab-067; HuMab-072; HuMab-084; HuMab-091; HuMab-093; HuMab-098; HuMab-100; HuMab-106; HuMab_10F8; HuMab-111; HuMab-123; HuMab-124; HuMab-125; HuMab-127; HuMab-129; HuMab-132; HuMab-143; HuMab-150; HuMab-152; HuMab-153; HuMab-159; HuMab-160; HuMab-162; HuMab-163; HuMab-166; HuMab-167; HuMab-169; HuMab-7D8; huMAb-anti-MSP10.1; huMAb-anti-MSP10.2; HUMAB-Clone_18; HUMAB-Clone_22; HuMab-L612; HuMab_LC5002-002; HuMab_LC5002-003; HuMab_LC5002-005; HuMab_LC5002-007; HuMab_LC5002-018; Ibalizumab; Ibritumomab_tiuxetan; Icrucumab; Idarucizumab; Igatuzuab; IGF-IR_HUMAB-1A; IGF-IR_HUMAB-23; IGF-IR_HUMAB-8; ImAb1; Imalumab; Imgatuzumab; Inclacumab; Indatuximab_ravtansine; Indusatumab_vedotin; Inebilizumab; Insulin_peglispro; Interferon_beta-1b; Intetumumab; Iodine_(124I)_Girentuximab; Iodine_(131I)_Derlotuxiab_biotin; Iodine_(131I)_Derlotuximab_biotin; Ipilimumab; Iratumumab; Isatuximab; Itolizumab; Ixekizumab; Labetuzumab_govitecan; Lambrolizumab; Lampalizumab; Lanadelumab; Landogrozumab; Laprituximab_emtansine; Lealeosab; Lebrikizumab; Lenercept_chain1; Lenzilumab; Lerdelimumab; Lexatumumab; Libivirumab; Lifastuzumab; Lifastuzumab_vedotin; Ligelizumab; Lilotomab; Lintuzumab; Lirilumab; Lodelcizumab; Lokivetmab; Lorvotuzumab_mertansine; Lpathomab; Lucatumumab; Lulizumab_pegol; Lumiliximab; Lumretuzumab; Lutetium_(177Lu)_lilotomab_satetraxetan; Margetuximab; Marzeptacog_alfa; Matuzumab; Mavrilimumab; MDX-1303; Mepolizumab; Metelimumab; Milatuzumab; Mirvetuximab; Modotuximab; Mogamulizumab; Monalizumab; Motavizumab; Moxetumomab_pasudotox; Muromonab-CD3; Namilumab; Naptumomab_estafenatox; Narnatumab; Natalizumab; Navicixizumab; Navivumab; Ndimab-varB; Necitumumab; Nelixizumab; Nemolizumab; Nesvacumab; Neuradiab; Nimotuzumab; Nivolumab; Obiltoxaximab; Obinutuzumab; Ocaratuzumab; Ocrelizumab; Ofatumumab; Olaratumab; Olizuab; Olokizumab; Omalizumab; Onartuzumab; Ontuxizumab; Opicinumab; Oportuzumab_monatox; Oreptacog_alfa; Orticumab; Otelixizumab; Otlertuzumab; Oxelumab; Ozanezumab; Ozoralizumab; Palivizumab; Pamrevlumab; Panitumumab; Pankoab; PankoMab; Panobacumab; Parsatuzumab; Pascolizumab; Pasotuxizumab; Pateclizumab; Patritumab; Pembrolizumab; Perakizumab; Pertuzuab; Pertuzumab; Pexelizumab_h5g1.1-scFv; Pexelizumab; PF-05082566; PF-05082568; Pidilizumab; Pinatuzumab_vedotin; Placulumab; Plozalizumab; Pogalizumab; Polatuzumab_vedotin; Ponezumab; Pritoxaximab; Pritumumab; Quilizumab; Racotumomab; Radretumab; Rafivirumab; Ralpancizumab; Ramucirumab; Ranibizivab; Ranibizumab; Refanezumab; REGN2810; rhuMab_HER2 (9CI); rhuMab_HER2; rhuMAb-VEGF; Rilotumumab; Rinucumab; Risankizumab; Rituximab; Rivabazumab_pegol; Robatumumab; Roledumab; Romosozumab; Rontalizuab; Rontalizumab; Rovalpituzumab_tesirine; Rovelizumab; Ruplizumab; Sacituzumab_govitecan; Samalizumab; Sarilumab; Satumomab_pendetide; Secukinumab; Seribantumab; Setoxaximab; Sifalimumab; Siltuximab; Simtuzumab; Sirukumab; Sofituzumab_vedotin; Solanezumab; Solitomab; Sonepcizumab; Stamulumab; Suptavumab; Suvizumab; Tabalumab; Tacatuzuab; Tadocizumab; Talizumab; Tamtuvetmab; Tanezumab; Tarextumab; Tefibazumab; Tenatumomab; Teneliximab; Teplizumab; Teprotumumab; Tesidolumab; Tezepelumab; ThioMAb-chMA79b-HC(A118C); ThioMab-hu10A8.v1-HC(A118C); ThioMab-hu10A8.v1-HC(V205C); ThioMab-hu10A8.v1-LC(A118C); ThioMab-hu10A8.v1-LC(V205C); ThioMAb-huMA79b.v17-HC(A118C); ThioMAb-huMA79b.v18-HC(A118C); ThioMAb-huMA79b.v28-HC(A118C); ThioMAb-huMA79b.v28-LC(V205C); Ticilivab; Tigatuzumab; Tildrakizumab; Tisotumab_vedotin; Tocilizumab; Tosatoxumab; Tositumomab; Tovetumab; Tralokinumab; Trastuzuab; Trastuzumab_emtansine; Trastuzumab; TRC-105; Tregalizumab; Tremelimumab; Trevogrumab; Tucotuzumab_celmoleukin; Ublituximab;

Ulocuplumab; Urelumab; Urtoxazumab; Ustekinumab; Vadastuximab_talirine; Vandortuzumab_vedotin; Vantictumab; Vanucizumab; Varlilumab; Vatelizumab; Vedolizumab; Veltuzumab; Vesencumab; Visilizumab; Volociximab; Vorsetuzumab; Vorsetuzumab_mafodotin; Yttrium_(90Y)_clivatuzumab_tetraxetan; Yttrium_Y_90_epratuzumab_tetraxetan; Yttrium_Y_90_epratuzumab; Zalutumumab; Zanolimumab; Zatuximab; Andecaliximab; Aprutumab; Azintuxizumab; Brazikumab; Cabiralizumab; Camrelizumab; Cosfroviximab; Crizanlizumab; Dezamizumab; Duvortuxizumab; Elezanumab; Emapalumab; Eptinezumab; Erenumab; Fremanezumab; Frunevetmab; Gatipotuzumab; Gedivumab; Gemetuzumab; Gilvetmab; Ifabotuzumab; Lacnotuzumab; Larcaviximab; Lendalizumab; Lesofavumab; Letolizumab; Losatuxizumab; Lupartumab; Lutikizumab; Oleclumab; Porgaviximab; Prezalumab; Ranevetmab; Remtolumab; Rosmantuzumab; Rozanolixizumab; Sapelizumab; Selicrelumab; Suvratoxumab; Tavolixizumab; Telisotuzumab; Telisotuzumab_vedotin; Timigutuzumab; Timolumab; Tomuzotuximab; Trastuzumab_duocarmazine; Varisacumab; Vunakizumab; Xentuzumab; anti-rabies_SO57; anti-rabies_SOJB; anti-rabies_SOJA; anti-rabies; anti-RSV_5ITB; anti-alpha-toxin_4U6V; anti-IsdB_5D1Q; anti-IsdB_5D1X; anti-IsdB_5D1Z; anti-HIV_b12; anti-HIV_2G12; anti-HIV_4E10; anti-HIV_VRC01; anti-HIV_PG9; anti-HIV_VRC07; anti-HIV_3BNC117; anti-HIV_10-1074; anti-HIV_PGT121; anti-HIV_PGDM1400; anti-HIV_N6; anti-HIV_10E8; anti-HIV_12A12; anti-HIV_12A21; anti-HIV_35022; anti-HIV_3BC176; anti-HIV_3BNC55; anti-HIV_3BNC60; anti-HIV_447-52D; anti-HIV_5H/I1-BMV-D5; anti-HIV_8ANC195; anti-HIV_CAP256-VRC26.01; anti-HIV_CAP256-VRC26.02; anti-HIV_CAP256-VRC26.03; anti-HIV_CAP256-VRC26.04; anti-HIV_CAP256-VRC26.05; anti-HIV_CAP256-VRC26.06; anti-HIV_CAP256-VRC26.07; anti-HIV_CAP256-VRC26.08; anti-HIV_CAP256-VRC26.09; anti-HIV_CAP256-VRC26.10; anti-HIV_CAP256-VRC26.11; anti-HIV_CAP256-VRC26.12; anti-HIV_CAP256-VRC26.I1; anti-HIV_CAP256-VRC26.I2; anti-HIV_CAP256-VRC26.UCA; anti-HIV_CH01; anti-HIVCH02; anti-HIV_CH03; anti-HIV_CH04; anti-HIV_CH103; anti-HIV_M66.6; anti-HIV_NIH45-46; anti-HIV_PG16; anti-HIV_PGT122; anti-HIV_PGT123; anti-HIV_PGT125; anti-HIV_PGT126; anti-HIV_PGT127; anti-HIV_PGT128; anti-HIV_PGT130; anti-HIV_PGT131; anti-HIV_PGT135; anti-HIV_PGT136; anti-HIV_PGT137; anti-HIV_PGT141; anti-HIV_PGT142; anti-HIV_PGT143; anti-HIV_PGT144; anti-HIV_PGT145; anti-HIV_PGT151; anti-HIV_PGT152; anti-HIV_VRC-CH30; anti-HIV_VRC-CH31; anti-HIV_VRC-CH32; anti-HIV_VRC-CH33; anti-HIV_VRC-CH34; anti-HIV_VRC-PG04; anti-HIV_VRC-PG04b; anti-HIV_VRC-PG20; anti-HIV_VRC02; anti-HIV_VRC03; anti-HIV_VRC23; anti-HIV_SCCK; anti-HIV_SAWN; anti-HIV_3QEG; anti-HIV_1N0X; anti-HIV_3QEH; anti-HIV_2B1H; anti-HIV_3TNM; anti-HIV_3UJJ; anti-HIV_3UJI; anti-HIV_2QSC; anti-HIV_3MLZ; anti-HIV_3MLX; anti-HIV_3MLW; anti-HIV_3MLV; anti-HIV_3MLU; anti-HIV_3MLT; anti-HIV_3GO1; anti-HIV_4XCY; anti-HIV_4YBL; anti-HIV_4R4N; anti-HIV_4R4B; anti-HIV_3JUY; anti-HIV_4KG5; anti-HIV-1; anti-HIV_V3; anti-HIV_CD4bs; anti-HIV_V2; anti-HIV_C38-VRC18.02; anti-HIV_44-VRC13.02; anti-HIV_45; anti-HIV_cap256-206-252885; anti-HIV_cap256-206-249183; anti-HIV_cap256-206-220956; anti-HIV_cap256-206-220629; anti-HIV_cap256-206-200599; anti-HIV_cap256-206-186347; anti-HIV_cap256-206-186226; anti-HIV_cap256-206-179686; anti-HIV_cap256-206-173707; anti-HIV_cap256-206-173339; anti-HIV_cap256-206-172689; anti-HIV_cap256-206-162744; anti-HIV_cap256-206-146057; anti-HIV_cap256-206-139519; anti-HIV_cap256-206-136316; anti-HIV_cap256-206-116098; anti-HIV_cap256-206-115862; anti-HIV_cap256-206-107018; anti-HIV_cap256-206-098644; anti-HIV_cap256-206-098135; anti-HIV_cap256-206-096276; anti-HIV_cap256-206-092794; anti-HIV_cap256-206-086817; anti-HIV_cap256-206-086446; anti-HIV_cap256-206-086180; anti-HIV_cap256-206-083708; anti-HIV_cap256-206-079556; anti-HIV_cap256-206-078657; anti-HIV_cap256-206-075802; anti-HIV_cap256-206-069097; anti-HIV_cap256-206-067758; anti-HIV_cap256-206-057019; anti-HIV_cap256-206-055385; anti-HIV_cap256-206-053187; anti-HIV_cap256-206-053139; anti-HIV_cap256-206-050350; anti-HIV_cap256-206-046207; anti-HIV_cap256-206-043389; anti-HIV_cap256-206-042555; anti-HIV_cap256-206-029720; anti-HIV_cap256-206-028848; anti-HIV_cap256-206-027652; anti-HIV_cap256-206-024075; anti-HIV_cap256-206-008748; anti-HIV_cap256-206-008530; anti-HIV_cap256-176-723043; anti-HIV_cap256-176-600049; anti-HIV_cap256-176-531926; anti-HIV_cap256-176-504134; anti-HIV_cap256-119-186229; anti-HIV_cap256-119-183891; anti-HIV_cap256-119-183631; anti-HIV_cap256-119-182676; anti-HIV_cap256-119-180772; anti-HIV_cap256-119-180508; anti-HIV_cap256-119-180260; anti-HIV_cap256-119-180173; anti-HIV_cap256-119-179839; anti-HIV_cap256-119-179262; anti-HIV_cap256-119-178995; anti-HIV_cap256-119-178455; anti-HIV_cap256-119-177993; anti-HIV_cap256-119-177727; anti-HIV_cap256-119-176746; anti-HIV_cap256-119-176241; anti-HIV_cap256-119-175215; anti-HIV_cap256-119-173928; anti-HIV_cap256-119-173495; anti-HIV_cap256-119-172882; anti-HIV_cap256-119-172429; anti-HIV_cap256-119-172223; anti-HIV_cap256-119-171838; anti-HIV_cap256-119-171587; anti-HIV_cap256-119-169596; anti-HIV_cap256-119-169523; anti-HIV_cap256-119-169462; anti-HIV_cap256-119-169092; anti-HIV_cap256-119-168680; anti-HIV_cap256-119-166385; anti-HIV_cap256-119-165943; anti-HIV_cap256-119-165738; anti-HIV_cap256-119-164913; anti-HIV_cap256-119-164167; anti-HIV_cap256-119-163558; anti-HIV_cap256-119-162043; anti-HIV_cap256-119-161718; anti-HIV_cap256-119-161675; anti-HIV_cap256-119-161053; anti-HIV_cap256-119-159499; anti-HIV_cap256-119-159114; anti-HIV_cap256-119-156751; anti-HIV_cap256-119-155656; anti-HIV_cap256-119-154420; anti-HIV_cap256-119-153954; anti-HIV_cap256-119-153864; anti-HIV_cap256-119-153793; anti-HIV_cap256-119-153462; anti-HIV_cap256-119-153124; anti-HIV_cap256-119-153025; anti-HIV_cap256-119-152713; anti-HIV_cap256-119-151794; anti-HIV_cap256-119-150980; anti-HIV_cap256-119-148895; anti-HIV_cap256-119-148848; anti-HIV_cap256-119-148743; anti-HIV_cap256-119-148595; anti-HIV_cap256-119-148490; anti-HIV_cap256-119-148470; anti-HIV_cap256-119-148107; anti-HIV_cap256-119-147933; anti-HIV_cap256-119-147434; anti-HIV_cap256-119-146106; anti-HIV_cap256-119-145604; anti-HIV_cap256-119-143998; anti-HIV_cap256-119-143441; anti-HIV_cap256-119-141307; anti-HIV_cap256-119-140896; anti-HIV_cap256-119-140090; anti-HIV_cap256-119-140037; anti-HIV_cap256-119-139135; anti-HIV_cap256-119-137881; anti-HIV_cap256-119-137643; anti- HIV_cap256-119-137170; anti-HIV_cap256-119-136616; anti-HIV_cap256-119-136206; anti-HIV_cap256-119-135565; anti-HIV_cap256-119-135025; anti-HIV_cap256-119-133983; anti-HIV_cap256-119-133917; anti-HIV_cap256-119-132663; anti-HIV_cap256-119-132113; anti-HIV_cap256-119-131839; anti-HIV_cap256-119-130626; anti-HIV_cap256-119-130191; anti-HIV_cap256-119-129798; anti-HIV_cap256-119-128745; anti-HIV_cap256-119-128593; anti-HIV_cap256-119-128152; anti-HIV_cap256-119-127693; anti-HIV_cap256-119-126684; anti-HIV_cap256-119-126056; anti-HIV_cap256-119-125765; anti-HIV_cap256-119-125106; anti-HIV_cap256-119-124026; anti-HIV_cap256-119-121783; anti-HIV_cap256-119-121208; anti-HIV_cap256-119-120945; anti-HIV_cap256-119-118229; anti-HIV_cap256-119-118025; anti-HIV_cap256-119-117418; anti-HIV_cap256-119-117250; anti-HIV_cap256-119-117230; anti-HIV_cap256-119-116999; anti-HIV_cap256-119-116558; anti-HIV_cap256-119-116484; anti-HIV_cap256-119-114844; anti-HIV_cap256-119-114141; anti-HIV_cap256-119-111917; anti-HIV_cap256-119-111862; anti-HIV_cap256-119-110064; anti-HIV_cap256-119-109192; anti-HIV_cap256-119-108793; anti-HIV_cap256-119-108127; anti-HIV_cap256-119-107758; anti-HIV_cap256-119-107209; anti-HIV_cap256-119-107184; anti-HIV_cap256-119-106827; anti-HIV_cap256-119-106511; anti-HIV_cap256-119-106327; anti-HIV_cap256-119-105486; anti-HIV_cap256-119-105197; anti-HIV_cap256-119-104946; anti-HIV_cap256-119-103667; anti-HIV_cap256-119-103385; anti-HIV_cap256-119-103267; anti-HIV_cap256-119-103011; anti-HIV_cap256-119-102072; anti-HIV_cap256-119-101945; anti-HIV_cap256-119-101319; anti-HIV_cap256-119-100871; anti-HIV_cap256-119-100838; anti-HIV_cap256-119-100025; anti-HIV_cap256-119-100000; anti-HIV_cap256-119-098890; anti-HIV_cap256-119-098715; anti-HIV_cap256-119-098632; anti-HIV_cap256-119-097199; anti-HIV_cap256-119-096189; anti-HIV_cap256-119-094581; anti-HIV_cap256-119-094200; anti-HIV_cap256-119-094158; anti-HIV_cap256-119-092814; anti-HIV_cap256-119-092808; anti-HIV_cap256-119-092573; anti-HIV_cap256-119-090815; anti-HIV_cap256-119-090368; anti-HIV_cap256-119-089710; anti-HIV_cap256-119-088555; anti-HIV_cap256-119-087962; anti-HIV_cap256-119-086903; anti-HIV_cap256-119-086804; anti-HIV_cap256-119-085910; anti-HIV_cap256-119-085772; anti-HIV_cap256-119-084603; anti-HIV_cap256-119-084276; anti-HIV_cap256-119-082288; anti-HIV_cap256-119-080383; anti-HIV_cap256-119-079333; anti-HIV_cap256-119-078618; anti-HIV_cap256-119-077466; anti-HIV_cap256-119-076284; anti-HIV_cap256-119-074680; anti-HIV_cap256-119-074081; anti-HIV_cap256-119-071704; anti-HIV_cap256-119-071266; anti-HIV_cap256-119-069667; anti-HIV_cap256-119-069591; anti-HIV_cap256-119-068691; anti-HIV_cap256-119-068488; anti-HIV_cap256-119-067536; anti-HIV_cap256-119-065852; anti-HIV_cap256-119-065457; anti-HIV_cap256-119-064501; anti-HIV_cap256-119-063568; anti-HIV_cap256-119-063103; anti-HIV_cap256-119-061027; anti-HIV_cap256-119-058232; anti-HIV_cap256-119-057341; anti-HIV_cap256-119-056895; anti-HIV_cap256-119-056402; anti-HIV_cap256-119-056034; anti-HIV_cap256-119-055042; anti-HIV_cap256-119-054776; anti-HIV_cap256-119-054539; anti-HIV_cap256-119-054112; anti-HIV_cap256-119-053339; anti-HIV_cap256-119-052404; anti-HIV_cap256-119-051123; anti-HIV_cap256-119-051077; anti-HIV_cap256-119-050442; anti-HIV_cap256-119-049433; anti-HIV_cap256-119-047532; anti-HIV_cap256-119-047489; anti-HIV_cap256-119-046020; anti-HIV_cap256-119-044746; anti-HIV_cap256-119-044740; anti-HIV_cap256-119-043790; anti-HIV_cap256-119-042880; anti-HIV_cap256-119-042606; anti-HIV_cap256-119-042444; anti-HIV_cap256-119-040328; anti-HIV_cap256-119-040164; anti-HIV_cap256-119-039130; anti-HIV_cap256-119-038138; anti-HIV_cap256-119-037868; anti-HIV_cap256-119-037102; anti-HIV_cap256-119-036683; anti-HIV_cap256-119-036495; anti-HIV_cap256-119-035375; anti-HIV_cap256-119-035165; anti-HIV_cap256-119-035109; anti-HIV_cap256-119-033789; anti-HIV_cap256-119-033641; anti-HIV_cap256-119-032113; anti-HIV_cap256-119-031739; anti-HIV_cap256-119-030932; anti-HIV_cap256-119-030740; anti-HIV_cap256-119-030197; anti-HIV_cap256-119-027047; anti-HIV_cap256-119-026950; anti-HIV_cap256-119-026279; anti-HIV_cap256-119-025355; anti-HIV_cap256-119-025301; anti-HIV_cap256-119-025010; anti-HIV_cap256-119-024631; anti-HIV_cap256-119-024467; anti-HIV_cap256-119-023805; anti-HIV_cap256-119-021736; anti-HIV_cap256-119-021203; anti-HIV_cap256-119-020569; anti-HIV_cap256-119-019432; anti-HIV_cap256-119-018827; anti-HIV_cap256-119-018483; anti-HIV_cap256-119-018118; anti-HIV_cap256-119-017782; anti-HIV_cap256-119-017669; anti-HIV_cap256-119-016976; anti-HIV_cap256-119-015432; anti-HIV_cap256-119-015281; anti-HIV_cap256-119-014957; anti-HIV_cap256-119-014777; anti-HIV_cap256-119-014313; anti-HIV_cap256-119-014219; anti-HIV_cap256-119-013631; anti-HIV_cap256-119-012924; anti-HIV_cap256-119-011793; anti-HIV_cap256-119-011413; anti-HIV_cap256-119-011323; anti-HIV_cap256-119-011233; anti-HIV_cap256-119-009038; anti-HIV_cap256-119-008756; anti-HIV_cap256-119-008055; anti-HIV_cap256-119-006949; anti-HIV_cap256-119-006685; anti-HIV_cap256-119-006015; anti-HIV_cap256-119-005841; anti-HIV_cap256-119-005824; anti-HIV_cap256-119-005494; anti-HIV_cap256-119-004949; anti-HIV_cap256-119-004422; anti-HIV_cap256-119-003932; anti-HIV_cap256-119-003577; anti-HIV_cap256-119-002155; anti-HIV_cap256-119-002017; anti-HIV_cap256-119-001312; anti-HIV_cap256-119-001017; anti-HIV_cap256-119-000594; anti-HIV_cap256-059-241099; anti-HIV_cap256-059-207529; anti-HIV_cap256-059-205541; anti-HIV_cap256-059-188439; anti-HIV_cap256-059-187234; anti-HIV_cap256-059-187047; anti-HIV_cap256-059-186068; anti-HIV_cap256-059-182835; anti-HIV_cap256-059-176659; anti-HIV_cap256-059-172956; anti-HIV_cap256-059-171272; anti-HIV_cap256-059-168734; anti-HIV_cap256-059-155838; anti-HIV_cap256-059-149799; anti-HIV_cap256-059-148168; anti-HIV_cap256-059-144685; anti-HIV_cap256-059-140017; anti-HIV_cap256-059-137547; anti-HIV_cap256-059-131908; anti-HIV_cap256-059-116006; anti-HIV_cap256-059-115783; anti-HIV_cap256-059-114609; anti-HIV_cap256-059-113952; anti-HIV_cap256-059-113878; anti-HIV_cap256-059-113622; anti-HIV_cap256-059-109427; anti-HIV_cap256-059-109081; anti-HIV_cap256-059-107590; anti-HIV_cap256-059-107504; anti-HIV_cap256-059-099614; anti-HIV_cap256-059-098972; anti-HIV_cap256-059-097236; anti-HIV_cap256-059-091487; anti-HIV_cap256-059-089812; anti-HIV_cap256-059-088468; anti-HIV_cap256-059-088341; anti-HIV_cap256-059-086533; anti-HIV_cap256-059-086043; anti-HIV_cap256-059-084191; anti-HIV_cap256-059-

082135; anti-HIV_cap256-059-079417; anti-HIV_cap256-059-076027; anti-HIV_cap256-059-075082; anti-HIV_cap256-059-072575; anti-HIV_cap256-059-071926; anti-HIV_cap256-059-069638; anti-HIV_cap256-059-069165; anti-HIV_cap256-059-068956; anti-HIV_cap256-059-068876; anti-HIV_cap256-059-067733; anti-HIV_cap256-059-067450; anti-HIV_cap256-059-065694; anti-HIV_cap256-059-065109; anti-HIV_cap256-059-065060; anti-HIV_cap256-059-064001; anti-HIV_cap256-059-063270; anti-HIV_cap256-059-061357; anti-HIV_cap256-059-059834; anti-HIV_cap256-059-059313; anti-HIV_cap256-059-057130; anti-HIV_cap256-059-050520; anti-HIV_cap256-059-049839; anti-HIV_cap256-059-048503; anti-HIV_cap256-059-045516; anti-HIV_cap256-059-044188; anti-HIV_cap256-059-044105; anti-HIV_cap256-059-042100; anti-HIV_cap256-059-040742; anti-HIV_cap256-059-040554; anti-HIV_cap256-059-039660; anti-HIV_cap256-059-039298; anti-HIV_cap256-059-037873; anti-HIV_cap256-059-037633; anti-HIV_cap256-059-036817; anti-HIV_cap256-059-032787; anti-HIV_cap256-059-032427; anti-HIV_cap256-059-029390; anti-HIV_cap256-059-027877; anti-HIV_cap256-059-026640; anti-HIV_cap256-059-026017; anti-HIV_cap256-059-024100; anti-HIV_cap256-059-023966; anti-HIV_cap256-059-020534; anti-HIV_cap256-059-019513; anti-HIV_cap256-059-012963; anti-HIV_cap256-059-010396; anti-HIV_cap256-059-008136; anti-HIV_cap256-059-006147; anti-HIV_cap256-059-005081; anti-HIV_cap256-059-005006; anti-HIV_cap256-059-004451; anti-HIV_cap256-059-003571; anti-HIV_cap256-059-003449; anti-HIV_cap256-059-002712; anti-HIV_cap256-059-001573; anti-HIV_cap256-059-001379; anti-HIV_cap256-059-001029; anti-HIV_cap256-048-165087; anti-HIV_cap256-048-158861; anti-HIV_cap256-048-158280; anti-HIV_cap256-048-157928; anti-HIV_cap256-048-157056; anti-HIV_cap256-048-156422; anti-HIV_cap256-048-152863; anti-HIV_cap256-048-152770; anti-HIV_cap256-048-150027; anti-HIV_cap256-048-148246; anti-HIV_cap256-048-147428; anti-HIV_cap256-048-146603; anti-HIV_cap256-048-145735; anti-HIV_cap256-048-145116; anti-HIV_cap256-048-144077; anti-HIV_cap256-048-142876; anti-HIV_cap256-048-140582; anti-HIV_cap256-048-139355; anti-HIV_cap256-048-139151; anti-HIV_cap256-048-137672; anti-HIV_cap256-048-137506; anti-HIV_cap256-048-137270; anti-HIV_cap256-048-135447; anti-HIV_cap256-048-131966; anti-HIV_cap256-048-131008; anti-HIV_cap256-048-129369; anti-HIV_cap256-048-128476; anti-HIV_cap256-048-128270; anti-HIV_cap256-048-126220; anti-HIV_cap256-048-125713; anti-HIV_cap256-048-123934; anti-HIV_cap256-048-122673; anti-HIV_cap256-048-122208; anti-HIV_cap256-048-121552; anti-HIV_cap256-048-120643; anti-HIV_cap256-048-118458; anti-HIV_cap256-048-118112; anti-HIV_cap256-048-116469; anti-HIV_cap256-048-113917; anti-HIV_cap256-048-112368; anti-HIV_cap256-048-112047; anti-HIV_cap256-048-112029; anti-HIV_cap256-048-110957; anti-HIV_cap256-048-110526; anti-HIV_cap256-048-109336; anti-HIV_cap256-048-108152; anti-HIV_cap256-048-107799; anti-HIV_cap256-048-107384; anti-HIV_cap256-048-106530; anti-HIV_cap256-048-106464; anti-HIV_cap256-048-106411; anti-HIV_cap256-048-106306; anti-HIV_cap256-048-104496; anti-HIV_cap256-048-103074; anti-HIV_cap256-048-100832; anti-HIV_cap256-048-100188; anti-HIV_cap256-048-099645; anti-HIV_cap256-048-098137; anti-HIV_cap256-048-097878; anti-HIV_cap256-048-097510; anti-HIV_cap256-048-097313; anti-HIV_cap256-048-096626; anti-HIV_cap256-048-096483; anti-HIV_cap256-048-095691; anti-HIV_cap256-048-095525; anti-HIV_cap256-048-094783; anti-HIV_cap256-048-094356; anti-HIV_cap256-048-090756; anti-HIV_cap256-048-089065; anti-HIV_cap256-048-084986; anti-HIV_cap256-048-083355; anti-HIV_cap256-048-082462; anti-HIV_cap256-048-082246; anti-HIV_cap256-048-080752; anti-HIV_cap256-048-078409; anti-HIV_cap256-048-078273; anti-HIV_cap256-048-078062; anti-HIV_cap256-048-077798; anti-HIV_cap256-048-073853; anti-HIV_cap256-048-071661; anti-HIV_cap256-048-071360; anti-HIV_cap256-048-070955; anti-HIV_cap256-048-070061; anti-HIV_cap256-048-069669; anti-HIV_cap256-048-069205; anti-HIV_cap256-048-068882; anti-HIV_cap256-048-067764; anti-HIV_cap256-048-066845; anti-HIV_cap256-048-065226; anti-HIV_cap256-048-063717; anti-HIV_cap256-048-063150; anti-HIV_cap256-048-062431; anti-HIV_cap256-048-060745; anti-HIV_cap256-048-060420; anti-HIV_cap256-048-060014; anti-HIV_cap256-048-059747; anti-HIV_cap256-048-058393; anti-HIV_cap256-048-058159; anti-HIV_cap256-048-057127; anti-HIV_cap256-048-056251; anti-HIV_cap256-048-055421; anti-HIV_cap256-048-054989; anti-HIV_cap256-048-054759; anti-HIV_cap256-048-052573; anti-HIV_cap256-048-051477; anti-HIV_cap256-048-051299; anti-HIV_cap256-048-050815; anti-HIV_cap256-048-049884; anti-HIV_cap256-048-049170; anti-HIV_cap256-048-048531; anti-HIV_cap256-048-048259; anti-HIV_cap256-048-047313; anti-HIV_cap256-048-046596; anti-HIV_cap256-048-044781; anti-HIV_cap256-048-042599; anti-HIV_cap256-048-041276; anti-HIV_cap256-048-040200; anti-HIV_cap256-048-039061; anti-HIV_cap256-048-038515; anti-HIV_cap256-048-038255; anti-HIV_cap256-048-038177; anti-HIV_cap256-048-035513; anti-HIV_cap256-048-034112; anti-HIV_cap256-048-033983; anti-HIV_cap256-048-032688; anti-HIV_cap256-048-031092; anti-HIV_cap256-048-030464; anti-HIV_cap256-048-030289; anti-HIV_cap256-048-030261; anti-HIV_cap256-048-029362; anti-HIV_cap256-048-027638; anti-HIV_cap256-048-027613; anti-HIV_cap256-048-026627; anti-HIV_cap256-048-026239; anti-HIV_cap256-048-025518; anti-HIV_cap256-048-024854; anti-HIV_cap256-048-024537; anti-HIV_cap256-048-021781; anti-HIV_cap256-048-021758; anti-HIV_cap256-048-020988; anti-HIV_cap256-048-020663; anti-HIV_cap256-048-020590; anti-HIV_cap256-048-019765; anti-HIV_cap256-048-019254; anti-HIV_cap256-048-018073; anti-HIV_cap256-048-016775; anti-HIV_cap256-048-016069; anti-HIV_cap256-048-015867; anti-HIV_cap256-048-015673; anti-HIV_cap256-048-015156; anti-HIV_cap256-048-014521; anti-HIV_cap256-048-014475; anti-HIV_cap256-048-013798; anti-HIV_cap256-048-013271; anti-HIV_cap256-048-013180; anti-HIV_cap256-048-012148; anti-HIV_cap256-048-011870; anti-HIV_cap256-048-011530; anti-HIV_cap256-048-010968; anti-HIV_cap256-048-010224; anti-HIV_cap256-048-009749; anti-HIV_cap256-048-009623; anti-HIV_cap256-048-008234; anti-HIV_cap256-048-008149; anti-HIV_cap256-048-007301; anti-HIV_cap256-048-007174; anti-HIV_cap256-048-007079; anti-HIV_cap256-048-007033; anti-HIV_cap256-048-006128; anti-HIV_cap256-048-005999; anti-HIV_cap256-048-005394; anti-HIV_cap256-048-004226; anti-HIV_cap256-048-004097; anti-HIV_cap256-048-003289; anti-HIV_cap256-048-002601; anti-HIV_cap256-048-002129; anti-HIV_cap256-048-001875; anti- HIV_cap256-048-001302; anti-HIV_cap256-048-001203; anti-HIV_cap256-048-000383; anti-HIV_cap256-038-261791; anti-HIV_cap256-038-241540; anti-HIV_cap256-038-235677; anti-HIV_cap256-038-234314; anti-HIV_cap256-038-234273; anti-HIV_cap256-038-223164; anti-HIV_cap256-038-220289; anti-HIV_cap256-038-220020; anti-HIV_cap256-038-216853; anti-HIV_cap256-038-213466; anti-HIV_cap256-038-213212; anti-HIV_cap256-038-213120; anti-HIV_cap256-038-212592; anti-HIV_cap256-038-211790; anti-HIV_cap256-038-209916; anti-HIV_cap256-038-207938; anti-HIV_cap256-038-202245; anti-HIV_cap256-038-197721; anti-HIV_cap256-038-196679; anti-HIV_cap256-038-196118; anti-HIV_cap256-038-195382; anti-HIV_cap256-038-180001; anti-HIV_cap256-038-178021; anti-HIV_cap256-038-177104; anti-HIV_cap256-038-171261; anti-HIV_cap256-038-169090; anti-HIV_cap256-038-168705; anti-HIV_cap256-038-167685; anti-HIV_cap256-038-158775; anti-HIV_cap256-038-157318; anti-HIV_cap256-038-153058; anti-HIV_cap256-038-150027; anti-HIV_cap256-038-146372; anti-HIV_cap256-038-141868; anti-HIV_cap256-038-141616; anti-HIV_cap256-038-127989; anti-HIV_cap256-038-118109; anti-HIV_cap256-038-112226; anti-HIV_cap256-038-105918; anti-HIV_cap256-038-104487; anti-HIV_cap256-038-102308; anti-HIV_cap256-038-091115; anti-HIV_cap256-038-090262; anti-HIV_cap256-038-083260; anti-HIV_cap256-038-080981; anti-HIV_cap256-038-080873; anti-HIV_cap256-038-074413; anti-HIV_cap256-038-073153; anti-HIV_cap256-038-064227; anti-HIV_cap256-038-061640; anti-HIV_cap256-038-059482; anti-HIV_cap256-038-054000; anti-HIV_cap256-038-050554; anti-HIV_cap256-038-044256; anti-HIV_cap256-038-040944; anti-HIV_cap256-038-040090; anti-HIV_cap256-038-032874; anti-HIV_cap256-038-025899; anti-HIV_cap256-038-024581; anti-HIV_cap256-038-013345; anti-HIV_cap256-038-011559; anti-HIV_cap256-038-009634; anti-HIV_cap256-038-006730; anti-HIV_cap256-038-004887; anti-HIV_cap256-038-004840; anti-HIV_cap256-038-002181; anti-HIV_cap256-038-001902; anti-HIV_cap256-038-000976; anti-HIV_cap256-038-000384; anti-HIV_206-314431; anti-HIV_206-247594; anti-HIV_206-116890; anti-HIV_206-072383; anti-HIV_206-037527; anti-HIV_206-009095; anti-HIV_176-503620; anti-HIV_176-478726; anti-HIV_276-245056; anti-HIV_176-164413; anti-HIV_176-094308; anti-HIV_176-065321; anti-HIV_119-099719; anti-HIV_119-099536; anti-HIV_119-098907; anti-HIV_119-098555; anti-HIV_119-097828; anti-HIV_119-096480; anti-HIV_119-095664; anti-HIV_119-095212; anti-HIV_119-094773; anti-HIV_119-094508; anti-HIV_119-093795; anti-HIV_119-093732; anti-HIV_119-092903; anti-HIV_119-092284; anti-HIV_119-091586; anti-HIV_119-091023; anti-HIV_119-090334; anti-HIV_119-088694; anti-HIV_119-088499; anti-HIV_119-088298; anti-HIV_119-087488; anti-HIV_119-087423; anti-HIV_119-087371; anti-HIV_119-087279; anti-HIV_119-087146; anti-HIV_119-087048; anti-HIV_119-085802; anti-HIV_119-085784; anti-HIV_119-085370; anti-HIV_119-085276; anti-HIV_119-084885; anti-HIV_119-084874; anti-HIV_119-084691; anti-HIV_119-083793; anti-HIV_119-083163; anti-HIV_119-082331; anti-HIV_119-082070; anti-HIV_119-081512; anti-HIV_119-080816; anti-HIV_119-079302; anti-HIV_119-079292; anti-HIV_119-079289; anti-HIV_119-078935; anti-HIV_119-078702; anti-HIV_119-078593; anti-HIV_119-077708; anti-HIV_119-076904; anti-HIV_119-075862; anti-HIV_119-075465; anti-HIV_119-074822; anti-HIV_119-074629; anti-HIV_119-074500; anti-HIV_119-073911; anti-HIV_119-072765; anti-HIV_119-072313; anti-HIV_119-072280; anti-HIV_119-071693; anti-HIV_119-071353; anti-HIV_119-069711; anti-HIV_119-069061; anti-HIV_119-068202; anti-HIV_119-068063; anti-HIV_119-067980; anti-HIV_119-067866; anti-HIV_119-067756; anti-HIV_119-066859; anti-HIV_119-065821; anti-HIV_119-065191; anti-HIV_119-064667; anti-HIV_119-063791; anti-HIV_119-062989; anti-HIV_119-062286; anti-HIV_119-061416; anti-HIV_119-061344; anti-HIV_119-060240; anti-HIV_119-060184; anti-HIV_119-058035; anti-HIV_119-057858; anti-HIV_119-057473; anti-HIV_119-057090; anti-HIV_119-055754; anti-HIV_119-054899; anti-HIV_119-054501; anti-HIV_119-051867; anti-HIV_119-051814; anti-HIV_119-051567; anti-HIV_119-051483; anti-HIV_119-050913; anti-HIV_119-050187; anti-HIV_119-049069; anti-HIV_119-048517; anti-HIV_119-048470; anti-HIV_119-048303; anti-HIV_119-048021; anti-HIV_119-047928; anti-HIV_119-047384; anti-HIV_119-047145; anti-HIV_119-046752; anti-HIV_119-046660; anti-HIV_119-046202; anti-HIV_119-045790; anti-HIV_119-044670; anti-HIV_119-044140; anti-HIV_119-042776; anti-HIV_119-042581; anti-HIV_119-040905; anti-HIV_119-040322; anti-HIV_119-039892; anti-HIV_119-039764; anti-HIV_119-039188; anti-HIV_119-039058; anti-HIV_119-038837; anti-HIV_119-038396; anti-HIV_119-036918; anti-HIV_119-036592; anti-HIV_119-036310; anti-HIV_119-035618; anti-HIV_119-035569; anti-HIV_119-035466; anti-HIV_119-035157; anti-HIV_119-035121; anti-HIV_119-035046; anti-HIV_119-034754; anti-HIV_119-034318; anti-HIV_119-033780; anti-HIV_119-033632; anti-HIV_119-033183; anti-HIV_119-030696; anti-HIV_119-030059; anti-HIV_119-029589; anti-HIV_119-029448; anti-HIV_119-029220; anti-HIV_119-028317; anti-HIV_119-028165; anti-HIV_119-027147; anti-HIV_119-026743; anti-HIV_119-026508; anti-HIV_119-025683; anti-HIV_119-025614; anti-HIV_119-025548; anti-HIV_119-025526; anti-HIV_119-023552; anti-HIV_119-023092; anti-HIV_119-022793; anti-HIV_119-022395; anti-HIV_119-022334; anti-HIV_119-021866; anti-HIV_119-021278; anti-HIV_119-021183; anti-HIV_119-019376; anti-HIV_119-019238; anti-HIV_119-018500; anti-HIV_119-018318; anti-HIV_119-018218; anti-HIV_119-017876; anti-HIV_119-017740; anti-HIV_119-017128; anti-HIV_119-017044; anti-HIV_119-016644; anti-HIV_119-015878; anti-HIV_119-015538; anti-HIV_119-015455; anti-HIV_119-014425; anti-HIV_119-013582; anti-HIV_119-013364; anti-HIV_119-012886; anti-HIV_119-012249; anti-HIV_119-012161; anti-HIV_119-012110; anti-HIV_119-012100; anti-HIV_119-011651; anti-HIV_119-011479; anti-HIV_119-011232; anti-HIV_119-011175; anti-HIV_119-008396; anti-HIV_119-007148; anti-HIV_119-007029; anti-HIV_119-004707; anti-HIV_119-003910; anti-HIV_119-002450; anti-HIV_119-001552; anti-HIV_059-188169; anti-HIV_059-183739; anti-HIV_059-182376; anti-HIV_059-182199; anti-HIV_059-169202; anti-HIV_059-155645; anti-HIV_059-151619; anti-HIV_059-146503; anti-HIV_059-136098; anti-HIV_059-105516; anti-HIV_059-095709; anti-HIV_059-069468; anti-HIV_059-060026; anti-HIV_059-053668; anti-HIV_059-052864; anti-HIV_059-050968; anti-HIV_059-046422; anti-HIV_059-045120; anti-HIV_059-039932; anti-HIV_059-038595; anti-HIV_059-035082; anti-HIV_059-029204; anti-HIV_059-025235; anti-HIV_059-015192;

anti-HIV_059-007060; anti-HIV_059-006953; anti-HIV_059-005953; anti-HIV_059-003725; anti-HIV_059-002618; anti-HIV_059-001522; anti-HIV_059-000731; anti-HIV_059-000634; anti-HIV_048-250757; anti-HIV_048-250716; anti-HIV_048-250463; anti-HIV_048-248153; anti-HIV_048-247532; anti-HIV_048-245846; anti-HIV_048-244016; anti-HIV_048-243682; anti-HIV_048-243588; anti-HIV_048-241775; anti-HIV_048-237996; anti-HIV_048-237730; anti-HIV_048-237253; anti-HIV_048-234100; anti-HIV_048-230882; anti-HIV_048-229473; anti-HIV_048-228238; anti-HIV_048-228027; anti-HIV_048-227795; anti-HIV_048-227770; anti-HIV_048-225298; anti-HIV_048-225090; anti-HIV_048-224187; anti-HIV_048-223055; anti-HIV_048-222711; anti-HIV_048-221209; anti-HIV_048-220629; anti-HIV_048-219430; anti-HIV_048-216250; anti-HIV_048-216133; anti-HIV_048-214886; anti-HIV_048-214709; anti-HIV_048-214001; anti-HIV_048-213230; anti-HIV_048-212574; anti-HIV_048-212207; anti-HIV_048-209146; anti-HIV_048-208206; anti-HIV_048-208194; anti-HIV_048-207744; anti-HIV_048-206501; anti-HIV_048-204221; anti-HIV_048-204015; anti-HIV_048-201240; anti-HIV_048-200455; anti-HIV_048-200319; anti-HIV_048-197896; anti-HIV_048-193813; anti-HIV_048-192098; anti-HIV_048-191786; anti-HIV_048-188746; anti-HIV_048-185937; anti-HIV_048-184849; anti-HIV_048-183089; anti-HIV_048-181509; anti-HIV_048-180990; anti-HIV_048-177532; anti-HIV_048-177426; anti-HIV_048-177389; anti-HIV_048-174266; anti-HIV_048-172847; anti-HIV_048-172845; anti-HIV_048-172363; anti-HIV_048-171609; anti-HIV_048-170705; anti-HIV_048-168381; anti-HIV_048-166619; anti-HIV_048-162036; anti-HIV_048-160042; anti-HIV_048-159676; anti-HIV_048-159500; anti-HIV_048-159421; anti-HIV_048-159333; anti-HIV_048-158932; anti-HIV_048-155811; anti-HIV_048-155464; anti-HIV_048-155392; anti-HIV_048-155389; anti-HIV_048-154449; anti-HIV_048-153379; anti-HIV_048-153171; anti-HIV_048-152324; anti-HIV_048-146102; anti-HIV_048-145984; anti-HIV_048-145371; anti-HIV_048-144907; anti-HIV_048-142298; anti-HIV_048-142277; anti-HIV_048-141934; anti-HIV_048-141207; anti-HIV_048-140796; anti-HIV_048-139893; anti-HIV_048-138820; anti-HIV_048-135858; anti-HIV_048-134968; anti-HIV_048-134312; anti-HIV_048-132253; anti-HIV_048-130710; anti-HIV_048-128564; anti-HIV_048-126702; anti-HIV_048-124521; anti-HIV_048-122740; anti-HIV_048-119536; anti-HIV_048-116929; anti-HIV_048-116577; anti-HIV_048-116046; anti-HIV_048-115875; anti-HIV_048-115599; anti-HIV_048-113988; anti-HIV_048-112989; anti-HIV_048-112435; anti-HIV_048-111339; anti-HIV_048-111055; anti-HIV_048-111027; anti-HIV_048-109721; anti-HIV_048-109666; anti-HIV_048-109196; anti-HIV_048-109051; anti-HIV_048-108570; anti-HIV_048-108033; anti-HIV_048-107279; anti-HIV_048-106271; anti-HIV_048-106054; anti-HIV_048-104848; anti-HIV_048-104638; anti-HIV_048-104567; anti-HIV_048-102804; anti-HIV_048-101676; anti-HIV_048-097603; anti-HIV_048-097107; anti-HIV_048-096871; anti-HIV_048-096668; anti-HIV_048-095236; anti-HIV_048-094155; anti-HIV_048-093219; anti-HIV_048-092976; anti-HIV_048-090866; anti-HIV_048-090650; anti-HIV_048-089009; anti-HIV_048-088654; anti-HIV_048-086513; anti-HIV_048-086024; anti-HIV_048-085857; anti-HIV_048-084277; anti-HIV_048-084245; anti-HIV_048-082487; anti-HIV_048-081787; anti-HIV_048-081062; anti-HIV_048-079639; anti-HIV_048-079126; anti-HIV_048-073118; anti-HIV_048-070264; anti-HIV_048-069426; anti-HIV_048-068564; anti-HIV_048-068345; anti-HIV_048-067337; anti-HIV_048-067180; anti-HIV_048-063017; anti-HIV_048-061885; anti-HIV_048-061671; anti-HIV_048-060700; anti-HIV_048-060592; anti-HIV_048-060300; anti-HIV_048-059141; anti-HIV_048-057777; anti-HIV_048-056928; anti-HIV_048-056131; anti-HIV_048-055864; anti-HIV_048-055094; anti-HIV_048-054343; anti-HIV_048-054193; anti-HIV_048-052521; anti-HIV_048-049037; anti-HIV_048-048720; anti-HIV_048-048542; anti-HIV_048-047777; anti-HIV_048-046841; anti-HIV_048-046202; anti-HIV_048-046059; anti-HIV_048-043568; anti-HIV_048-042713; anti-HIV_048-042440; anti-HIV_048-040511; anti-HIV_048-039195; anti-HIV_048-036935; anti-HIV_048-034478; anti-HIV_048-031641; anti-HIV_048-029760; anti-HIV_048-027970; anti-HIV_048-027337; anti-HIV_048-027217; anti-HIV_048-026760; anti-HIV_048-024800; anti-HIV_048-024313; anti-HIV_048-021748; anti-HIV_048-020991; anti-HIV_048-020340; anti-HIV_048-019993; anti-HIV_048-019947; anti-HIV_048-017871; anti-HIV_048-015931; anti-HIV_048-015920; anti-HIV_048-013898; anti-HIV_048-013429; anti-HIV_048-012358; anti-HIV_048-011158; anti-HIV_048-010720; anti-HIV_048-009445; anti-HIV_048-006126; anti-HIV_048-005652; anti-HIV_048-005532; anti-HIV_048-005189; anti-HIV_048-005088; anti-HIV_048-004023; anti-HIV_048-001580; anti-HIV_038-221120; anti-HIV_038-197677; anti-HIV_038-196765; anti-HIV_038-186200; anti-HIV_038-126170; anti-HIV_038-108545; anti-HIV_038-107263; anti-HIV_038-104530; anti-HIV_038-099169; anti-HIV_038-075067; anti-HIV_038-072368; anti-HIV_038-068503; anti-HIV_038-068016; anti-HIV_038-063958; anti-HIV_038-033733; anti-HIV_038-030557; anti-HIV_038-024298; anti-HIV_038-011154; anti-HIV_5CIN; anti-HIV_5CIL; anti-HIV_5CIP; anti-HIV_4JKP; anti-HIV_3TNN; anti-HIV_3BQU; anti-HIV_IgG; anti-HIV_4P9M; anti-HIV_4P9H; anti-HIV_Ig; anti-HIV; anti-influenza; anti-influenza_Apo; anti-influenza-A; anti-OX40.

Preferably, the antibody or the fragment of variant thereof, which is encoded by the at least one coding sequence of the RNA according to the present invention, is selected from the group consisting of antibodies having an amino acid sequence according to any of the amino acid sequences SEQ ID NO: 1-7642, 61212-61214, 61236-61238, 61245-61247, 61269-61271, 61279-61281, 61303-61305, 61312, 61320, 61324, 61332, 61338, 61346, 61349, 61357, 61362, 61370, 61373, 61381, 61384, 61385, 61400, 61401, 61418, 61426, 61429, 61437, 61440, 61441, 61456, 61457, 61469, 61470, 61475, 61476, 61481, 61482, 61487, 61488, 61493, 61494, 61499, 61500, 61515, 61516, 61521, 61522, 61537, 61538, 61543, 61544, 61559, 61560, 61565, 61573, 61576, 61584, 61587, 61588, 61603, 61606, 61609, 61612, 61618, 61619, 61634, 61635, 61639, 61640, 61644, 61645, 61660, 61661, 61667, 61675, 61678, 61686, 61689, 61697, 61700, 61708, 61711, 61719, 61722, 61730 or a fragment or variant of any one of said amino acid sequences.

The at least one coding sequence of the RNA according to the invention preferably comprises a nucleic acid sequence encoding a full-length antibody or a full-length variant of an antibody as defined herein. The term 'full-length antibody' or 'full-length variant of an antibody' as used herein typically refers to an antibody that substantially comprises the entire amino acid sequence of the antibody. For example, the RNA preferably comprises a nucleic acid sequence encoding all chains of the antibody, in particular if the antibody comprises more than one chain (a "multiple-chain antibody").

It is also preferred that the at least one coding sequence of the RNA according to the invention comprises a nucleic acid sequence encoding a fragment of an antibody. In the context of the present invention, a 'fragment' of an antibody or of a variant thereof may comprise a sequence of an antibody or of a variant thereof as defined herein, which is, with regard to its amino acid sequence (or its encoded nucleic acid sequence), N-terminally, C-terminally and/or intrasequentially truncated compared to the amino acid sequence of the full-length antibody or a variant thereof (or its encoded nucleic acid sequence). Such truncation may thus occur either on the amino acid level or on the nucleic acid level, respectively. A sequence identity with respect to such a fragment as defined herein therefore preferably refers to the entire antibody or a variant thereof as defined herein or to the entire (coding) nucleic acid sequence of such an antibody or of a variant thereof.

Preferably, a fragment or a variant of an antibody is a functional fragment or a functional variant, which comprises at least one functional CDR of the corresponding antibody capable of recognizing (and binding to) an antigen.

Such a fragment has preferably a length of at least 3 amino acids. More preferably, such a fragment has a length of at least 4, 5, 6, 7, 8, 9, 10, 11, 12, 13, 14, 15, 16, 17, 18, 19 or 20 amino acids.

Examples of such antibody fragments are any antibody fragments known to a person skilled in the art, e.g. Fab, Fab', F(ab')$_2$, Fc, Facb, pFc', Fd, and Fv fragments of the above-mentioned antibodies etc. A diagram of the structure of such exemplified antibody fragments is shown by way of example in FIG. 4. For example, a Fab (fragment antigen binding) fragment typically comprises the variable and a constant domain of a light and a heavy chain, e.g. the $C_H1$ and the $V_H$ domain of the heavy chain and the complete light chain. The two chains are bonded to one another via a disulfide bridge. A Fab fragment thus conventionally contains the complete antigen-binding region of the original antibody and usually has the same affinity for the antigen, the immunogen or an epitope of a protein. Antibody fragments, as also described above for antibodies, can be prepared with the aid of molecular biology methods. In this context, the DNA sequences which code for the various domains of the antibody fragment are cloned into a specific expression vector. The RNA which codes for these antibody fragments can then be expressed e.g. in suitable host cells. Suitable host cells in connection with the present invention include, inter alia, *E. coli*, yeasts, transgenic plants or mammalian cells etc. (see below). Moreover, antibody fragments consisting of the minimal binding subunit of antibodies are known as single-chain antibodies (scFvs) and have excellent binding specificity and affinity for their ligands. An scFv fragment (single chain variable fragment) typically comprises the variable domain of the light and of the heavy chain, which are bonded to one another via an artificial polypeptide linker. In the cloning of such scFv fragments, RNAs which code for a $V_H$ and $V_L$, these being linked to one another by a polypeptide linker, are preferably provided. As a rule, a polypeptide built up from 15-25 glycine, proline and/or serine residues (cf. FIG. 5) or the associated nucleotide sequence is used at the RNA level for the provision of this component.

Preferably, the antibody fragment, which is encoded by the coding sequence of the RNA according to the invention, is an antigen-binding fragment. Such an antigen-binding fragment typically comprises at least one CDR. More preferably, the antibody fragment, which is encoded by the coding sequence of the RNA according to the invention, comprises a heavy chain variable region ($V_H$) and/or a light chain variable region ($V_L$). Even more preferably, the antibody fragment, which is encoded by the coding sequence of the RNA according to the invention, comprises a complete (full-length) heavy chain or a complete (full-length) light chain of an antibody.

It is also preferred that the RNA comprises at least one coding sequence encoding a variant of an antibody as defined herein, or a fragment of a variant of an antibody. Preferably, such variants have the same biological function as or, respectively, the specific activity of the corresponding full length antibody or of the corresponding antibody fragment, e.g. the specific binding of particular antigens or nucleic acids. Accordingly, it is preferred, if the hypervariable region(s) are conserved or are modified by merely conservative mutations.

The biological function of antibodies described here which are coded by the RNA according to the invention includes e.g. neutralization of antigens, complement activation or opsonization. In the case of neutralization of antigens, the antibody can bind to an antigen and thereby neutralize this. The antibody is conventionally blocked by the binding of the antigen, and can therefore display its action only against one antigen, or two antigens in the case of bispecific antibodies. scFv antibody fragments are suitable above all for this (neutralization) function of an antibody, since they do not include the functions of the constant domains of an antibody. In the case of complement activation, the complex system of complement proteins which are dependent upon the Fc part of the antibody can be activated via binding of antibodies. End products of the complement cascade typically lead to lysis of cells and to the creation of a phlogistic (inflammatory) milieu. In the case of opsonization, pathogens or foreign particles are rendered accessible to phagocytes by binding by an antibody via the constant domains of the antibody. Alternatively, the opsonized cells, which are recognized as foreign, can be lysed via an antibody-dependent, cell-mediated cytotoxicity (ADCC). In this context, NK cells in particular can perform lytic functions in this manner via activation of their Fc receptors.

In certain embodiments of the present invention, a 'variant' of an antibody or a fragment thereof as defined herein may be encoded by the RNA comprising at least one coding sequence as defined herein, wherein the amino acid sequence encoded by the at least one coding sequence differs in at least one amino acid residue from the antibody's reference amino acid sequence. Exemplified reference amino acid sequences of antibodies are shown below in Table 3.

In this context, the 'change' in at least one amino acid residue may consist, for example, in a mutation of an amino acid residue to another amino acid, a deletion or an insertion. More preferably, the term 'variant' as used in the context of the amino acid sequence encoded by the at least one coding sequence of the RNA according to the invention comprises any homolog, isoform or transcript variant of the antibody or a fragment thereof as defined herein, wherein the homolog, isoform or transcript variant is preferably characterized by a degree of identity or homology, respectively, as defined herein.

Preferably, a variant of an antibody or a fragment thereof may be encoded by the RNA comprising at least one coding sequence as defined herein, wherein at least one amino acid residue of the amino acid sequence encoded by the at least one coding sequence is substituted. Substitutions, wherein amino acids, which originate from the same class, are exchanged for one another, are called conservative substitutions. In particular, these are amino acids having aliphatic side chains, positively or negatively charged side chains, aromatic groups in the side chains or amino acids, the side chains of which can form hydrogen bridges, e.g. side chains which have a hydroxyl function. By conservative constitution, e.g. an amino acid having a polar side chain may be replaced by another amino acid having a corresponding polar side chain, or, for example, an amino acid characterized by a hydrophobic side chain may be substituted by another amino acid having a corresponding hydrophobic side chain (e.g. serine (threonine) by threonine (serine) or leucine (isoleucine) by isoleucine (leucine)). In a preferred embodiment, a variant of an antibody or a fragment thereof may be encoded by the RNA according to the invention, wherein at least one amino acid residue of the amino acid sequence encoded by the at least one coding sequence comprises at least one conservative substitution compared to the respective reference sequence. These amino acid sequences as well as their encoding nucleic acid sequences in particular are comprised by the term 'variant' as defined herein.

Insertions, deletions and/or non-conservative substitutions are also possible, in particular, at those sequence positions, which cause no modification to the three-dimensional structure or do not affect the binding region. Modifications to a three-dimensional structure by insertion(s) or deletion(s) can easily be determined e.g. using CD spectra (circular dichroism spectra) (Urry, 1985, Absorption, Circular Dichroism and ORD of Polypeptides, in: Modern Physical Methods in Biochemistry, Neuberger et al. (ed.), Elsevier, Amsterdam).

In order to determine the percentage, to which two sequences (nucleic acid sequences, e.g. RNA or mRNA sequences as defined herein, or amino acid sequences, preferably the amino acid sequence encoded by the RNA according to the invention) are identical, the sequences can be aligned in order to be subsequently compared to one another. For this purpose, e.g. gaps can be inserted into the sequence of the first sequence and the component at the corresponding position of the second sequence can be compared. If a position in the first sequence is occupied by the same component as is the case at a corresponding position in the second sequence, the two sequences are identical at this position. The percentage, to which two sequences are identical, is a function of the number of identical positions divided by the total number of positions. The percentage, to which two sequences are identical, can be determined using a mathematical algorithm. A preferred, but not limiting, example of a mathematical algorithm, which can be used is the algorithm of Karlin et al. (1993), PNAS USA, 90:5873-5877 or Altschul et al. (1997), Nucleic Acids Res., 25:3389-3402. Such an algorithm is integrated, for example, in the BLAST program. Sequences, which are identical to the sequences of the present invention to a certain extent, can be identified by this program. Typically, "% sequence identity" is calculated in respect to a reference sequence. Exemplified reference sequences in the context of the present invention are the sequences according to SEQ ID NO: 1-61734, in particular the protein and RNA sequences shown in Table 3 below.

A fragment of an antibody or a variant thereof encoded by the at least one coding sequence of the RNA according to the invention may typically comprise an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence of the respective reference full-length antibody or a fragment thereof.

More preferably, a fragment of an antibody or a variant thereof encoded by the at least one coding sequence of the RNA according to the invention may typically comprise or consist of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence selected from the group consisting of SEQ ID NOs: 1-7642, 61212-61214, 61236-61238, 61245-61247, 61269-61271, 61279-61281, 61303-61305, 61312, 61320, 61324, 61332, 61338, 61346, 61349, 61357, 61362, 61370, 61373, 61381, 61384, 61385, 61400, 61401, 61418, 61426, 61429, 61437, 61440, 61441, 61456, 61457, 61469, 61470, 61475, 61476, 61481, 61482, 61487, 61488, 61493, 61494, 61499, 61500, 61515, 61516, 61521, 61522, 61537, 61538, 61543, 61544, 61559, 61560, 61565, 61573, 61576, 61584, 61587, 61588, 61603, 61606, 61609, 61612, 61618, 61619, 61634, 61635, 61639, 61640, 61644, 61645, 61660, 61661, 61667, 61675, 61678, 61686, 61689, 61697, 61700, 61708, 61711, 61719, 61722, 61730; or a fragment or variant of any one of said amino acid sequences.

Most preferably, a fragment of an antibody or a variant thereof encoded by the at least one coding sequence of the RNA according to the invention typically comprises or consists of an amino acid sequence having a sequence identity of at least 80% with an amino acid sequence selected from the group consisting of SEQ ID NOs: 1-7642, 61212-61214, 61236-61238, 61245-61247, 61269-61271, 61279-61281, 61303-61305, 61312, 61320, 61324, 61332, 61338, 61346, 61349, 61357, 61362, 61370, 61373, 61381, 61384, 61385, 61400, 61401, 61418, 61426, 61429, 61437, 61440, 61441, 61456, 61457, 61469, 61470, 61475, 61476, 61481, 61482, 61487, 61488, 61493, 61494, 61499, 61500, 61515, 61516, 61521, 61522, 61537, 61538, 61543, 61544, 61559, 61560, 61565, 61573, 61576, 61584, 61587, 61588, 61603, 61606, 61609, 61612, 61618, 61619, 61634, 61635, 61639, 61640, 61644, 61645, 61660, 61661, 61667, 61675, 61678, 61686, 61689, 61697, 61700, 61708, 61711, 61719, 61722, 61730; or a fragment or variant of any one of said amino acid sequences.

Without being limited thereto, according to the present invention RNAs which code for antibodies inter alia code for those antibodies which bind antigens or specific nucleic acids. Antigens in the context of the present invention are typically molecules which are recognized as exogenous by the immune system and conventionally cause an immune reaction or immune response with the formation of antibodies directed specifically against them. However, antigens can also include, especially in the case of autoimmune diseases, endogenous molecules or structures which are incorrectly recognized as exogenous by the immune system and thereby trigger an immune reaction. Alternatively formulated, antigens are therefore all molecules which are recognized by an antibody in the context of the present invention. Antigens substantially comprise proteins, peptides or epitopes of these proteins or peptides. In this context, epitopes (also called "antigenic determinants") are typically small regions (molecular sections) lying on the surface of such protein or peptide structures and having a length of from 5 to 15, in rare case also to 25, preferably 6 to 9 amino acids. Antigens can furthermore also include lipids, carbohydrates etc. In the context of the present invention, antigens also include, for example, so-called immunogens, i.e. antigens which lead to an immunity of the organism transfected therewith. Antigens by way of example include, without being limited thereto, surface antigens of cells, tumour antigens etc. For example, according to the present invention antibodies can bind the following antigens (which typically occur in vertebrates), e.g. tumour-specific surface antigens (TSSA), e.g. 5T4, α5β1-integrin, 707-AP, AFP, ART-4, B7H4, BAGE, β-catenin/m, Bcr-abl, MN/C IX-antigen, CA125, CAMEL, CAP-1, CASP-8, CD4, CD19, CD20, CD22, CD25, CDC27/m, CD 30, CD33, CD52, CD56, CD80, CDK4/m, CEA, CT, Cyp-B, DAM, EGFR, ErbB3, ELF2M, EMMPRIN, EpCam, ETV6-AML1, G250, GAGE, GnT-V, Gp100, HAGE, HER-2/neu, HLA-A*0201-R170I, HPV-E7, HSP70-2M, HAST-2, hTERT (or hTRT), iCE, IGF-1R, IL-2R, IL-5, KIAA0205, LAGE, LDLR/FUT, MAGE, MART-1/Melan-A, MART-2/Ski, MC1R, myosin/m, MUC1, MUM-1, -2, -3, NA88-A, NY-ESO1, PAP, proteinase-3, p190 minor bcr-abl, Pml/RARα, PRAME, PSA, PSM, PSMA, RAGE, RU1 or RU2, SAGE, SART-1 or SART-3, survivin, TEL/AML1, TGFβ, TPI/m, TRP-1, TRP-2, TRP-2/INT2, VEGF and WT1, or sequences, such as e.g. NY-Eso-1 or NY-Eso-B. Tumour antigens can, for example, typically be responsible for metastasing, that is to say dissolving of tumour cells out of their native tissue, transfer into the vascular system (lymph or blood vessel system), exit from the vascular system and colonization in a new tissue. In this context, such tumour antigens which cause modified cell-cell interactions compared with the native state are of interest in particular.

Antibodies encoded by the inventive RNA may also be directed against tumour antigens listed by Table 1 or Table 2. In particular, RNA encoding those antibodies may be used to treat (or, may be used to prepare a medicament to treat, respectively) the cancer diseases given in the last column of Tables 1 and 2.

TABLE 1

Antigens expressed in cancer diseases

| Tumor antigen | Name of tumor antigen | Cancers or cancer diseases related thereto |
|---|---|---|
| 5T4 | | colorectal cancer, gastric cancer, ovarian cancer |
| 707-AP | 707 alanine proline | melanoma |
| 9D7 | | renal cell carcinoma |
| AFP | alpha-fetoprotein | hepatocellular carcinoma, gallbladder cancer, testicular cancer, ovarian cancer, bladder cancer |
| AlbZIP HPG1 | | prostate cancer |
| alpha5beta1-Integrin | | |
| alpha5beta6-Integrin | | colon cancer |
| alpha-methylacyl-coenzyme A racemase | | prostate cancer |
| ART-4 | adenocarcinoma antigen recognized by T cells 4 | lung cancer, head and neck cancer, leukemia, esophageal cancer, gastric cancer, cervical cancer, ovarian cancer, breast cancer, squamous cell carcinoma |
| B7H4 | | ovarian cancer |
| BAGE-1 | B antigen | bladder cancer, head and neck cancer, lung cancer, melanoma, squamous cell carcinoma |
| BCL-2 | | leukemia |
| BING-4 | | melanoma |
| CA 15-3/CA 27-29 | | breast cancer, ovary cancer, lung cancer, prostate cancer |
| CA 19-9 | | gastric cancer, pancreatic cancer, liver cancer, breast cancer, gallbladder cancer, colon cancer, ovary cancer, lung cancer |
| CA 72-4 | | ovarian cancer |
| CA125 | | ovarian cancer, colorectal cancer, gastric cancer, liver cancer, pancreatic cancer, uterus cancer, cervix carcinoma, colon cancer, breast cancer, lung cancer |
| calreticulin | | bladder cancer |
| CAMEL | CTL-recognized antigen on melanoma | melanoma |
| CASP-8 | caspase-B | head and neck cancer |
| cathepsin B | | breast cancer |
| cathepsin L | | breast cancer |
| CD19 | | B-cell malignancies |
| CD20 | | |
| CD22 | | |
| CD25 | | |
| CD30 | | |
| CD33 | | |
| CD4 | | |
| CD52 | | |
| CD55 | | |
| CD56 | | |
| CD80 | | |
| CEA | carcinoembryonic antigen | gut carcinoma, colorectal cancer, colon cancer, hepatocellular cancer, lung cancer, breast cancer, thyroid cancer, pancreatic cancer, liver cancer cervix cancer, bladder cancer, melanoma |
| CLCA2 | calcium-activated chloride channel-2 | lung cancer |
| CML2B | | leukemia |
| Coactosin-like protein | | pancreatic cancer |

TABLE 1-continued

Antigens expressed in cancer diseases

| Tumor antigen | Name of tumor antigen | Cancers or cancer diseases related thereto |
| --- | --- | --- |
| Collagen XXIII | | prostate cancer |
| COX-2 | | ovarian cancer, breast cancer, colorectal cancer |
| CT-9/BRD6 | bromodomain testis-specific protein | |
| Cten | C-terminal tensin-like protein | prostate cancer |
| cyclin B1 | | |
| cyclin D1 | | ovarian cancer |
| cyp-B | cyclophilin B | bladder cancer, lung cancer, T-cell leukemia, squamous cell carcinoma, |
| CYPB1 | cytochrom P450 1B1 | leukemia |
| DAM-10/MAGE-B1 | differentiation antigen melanoma 10 | melanoma, skin tumors, ovarian cancer, lung cancer |
| DAM-6/MAGE-B2 | differentiation antigen melanoma 6 | melanoma, skin tumors, ovarian cancer, lung cancer |
| EGFR/Her1 | | lung cancer, ovarian cancer, head and neck cancer, colon cancer, pancreatic cancer, breast cancer |
| EMMPRIN | tumor cell-associated extracellular matrix metalloproteinase inducer/ | lung cancer, breast cancer, bladder cancer, ovarian cancer, brain cancer, lymphoma |
| EpCam | epithelial cell adhesion molecule | ovarian cancer, breast cancer, colon cancer, lung cancer |
| EphA2 | ephrin type-A receptor 2 | glioma |
| EphA3 | ephrin type-A receptor 2 | melanoma, sarcoma, lung cancer |
| ErbB3 | | breast cancer |
| EZH2 | (enhancer of Zeste homolog 2) | endometrium cancer, melanoma, prostate cancer, breast cancer |
| FGF-5 | fibroblast growth factor-5 | renal cell carcinoma, breast cancer, prostate cancer |
| FN | fibronectin | melanoma |
| Fra-1 | Fos-related antigen-1 | breast cancer, esophageal cancer, renal cell carcinoma, thyroid cancer |
| G250/CAIX | glycoprotein 250 | leukemia, renal cell carcinoma, head and neck cancer, colon cancer, ovarian cancer, cervical cancer |
| GAGE-1 | G antigen 1 | bladder cancer, lung cancer, sarcoma, melanoma, head and neck cancer |
| GAGE-2 | G antigen 2 | bladder cancer, lung cancer, sarcoma, melanoma, head and neck cancer |
| GAGE-3 | G antigen 3 | bladder cancer, lung cancer, sarcoma, melanoma, head and neck cancer |
| GAGE-4 | G antigen 4 | bladder cancer, lung cancer, sarcoma, melanoma, head and neck cancer |
| GAGE-5 | G antigen 5 | bladder cancer, lung cancer, sarcoma, melanoma, head and neck cancer |
| GAGE-6 | G antigen 6 | bladder cancer, lung cancer, sarcoma, melanoma, head and neck cancer |
| GAGE-7b | G antigen 7b | bladder cancer, lung cancer, sarcoma, melanoma, head and neck cancer |
| GAGE-8 | G antigen 8 | bladder cancer, lung cancer, sarcoma, melanoma, head and neck cancer |
| GDEP | gene differentially expressed in prostate | prostate cancer |
| GnT-V | N-acetylglucosaminyltransferase V | glioma, melanoma |
| gp100 | glycoprotein 100 kDa | melanoma |
| GPC3 | glypican 3 | hepatocellular carcinoma, melanoma |
| HAGE | helicase antigen | bladder cancer |
| HAST-2 | human signet ring tumor-2 | |
| hepsin | | prostate |
| Her2/neu/ErbB2 | human epidermal receptor-2/ neurological | breast cancer, bladder cancer, melanoma, ovarian cancer, pancreas cancer, gastric cancer |
| HERV-K-MEL | | melanoma |
| HNE | human neutrophil elastase | leukemia |
| homeobox NKX 3.1 | | prostate cancer |
| HOM-TES-14/SCP-1 | | ovarian cancer |
| HOM-TES-85 | | |
| HPV-E6 | | cervical cancer |
| HPV-E7 | | cervical cancer |
| HST-2 | | gastric cancer |
| hTERT | human telomerase reverse transcriptase | breast cancer, melanoma, lung cancer, ovarian cancer, sarcoma, Non-Hodgkin-lymphoma, acute leukemia |
| iCE | intestinal carboxyl esterase | renal cell carcinoma |
| IGF-1R | | colorectal cancer |
| IL-13Ra2 | interleukin 13 receptor alpha 2 chain | glioblastoma |
| IL-2R | | colorectal cancer |
| IL-5 | | |
| immature laminin receptor | | renal cell carcinoma |
| kallikrein 2 | | prostate cancer |
| kallikrein 4 | | prostate cancer |
| Ki67 | | prostate cancer, breast cancer, Non-Hodgkin-lymphoma, melanoma |
| KIAA0205 | | bladder cancer |
| KK-LC-1 | Kita-kyushu lung cancer antigen 1 | lung cancer |
| KM-HN-1 | | tongue cancer, hepatocellular carcinomas, melanoma, gastric cancer, esophageal, colon cancer, pancreatic cancer |

TABLE 1-continued

Antigens expressed in cancer diseases

| Tumor antigen | Name of tumor antigen | Cancers or cancer diseases related thereto |
| --- | --- | --- |
| LAGE-1 | L antigen | bladder cancer, head and neck cancer, melanoma |
| livin | | bladder cancer, melanoma |
| MAGE-A1 | melanoma antigen-A1 | bladder cancer, head and neck cancer, melanoma, colon cancer, lung cancer, sarcoma, leukemia |
| MAGE-A10 | melanoma antigen-A10 | bladder cancer, head and neck cancer, melanoma, colon cancer, lung cancer, sarcoma, leukemia |
| MAGE-A12 | melanoma antigen-A12 | bladder cancer, head and neck cancer, melanoma, colon cancer, lung cancer, sarcoma, leukemia, prostate cancer, myeloma, brain tumors |
| MAGE-A2 | melanoma antigen-A2 | bladder cancer, head and neck cancer, melanoma, colon cancer, lung cancer, sarcoma, leukemia |
| MAGE-A3 | melanoma antigen-A3 | bladder cancer, head and neck cancer, melanoma, colon cancer, lung cancer, sarcoma, leukemia |
| MAGE-A4 | melanoma antigen-A4 | bladder cancer, head and neck cancer, melanoma, colon cancer, lung cancer, sarcoma, leukemia |
| MAGE-A6 | melanoma antigen-A6 | bladder cancer, head and neck cancer, melanoma, colon cancer, lung cancer, sarcoma, leukemia |
| MAGE-A9 | melanoma-antigen-A9 | bladder cancer, head and neck cancer, melanoma, colon cancer, lung cancer, sarcoma, leukemia |
| MAGE-B1 | melanoma-antigen-B1 | melanoma |
| MAGE-B10 | melanoma-antigen-B10 | melanoma |
| MAGE-B16 | melanoma-antigen-B16 | melanoma |
| MAGE-B17 | melanoma-antigen-B17 | melanoma |
| MAGE-B2 | melanoma-antigen-B2 | melanoma |
| MAGE-B3 | melanoma-antigen-B3 | melanoma |
| MAGE-B4 | melanoma-antigen-B4 | melanoma |
| MAGE-B5 | melanoma-antigen-B5 | melanoma |
| MAGE-B6 | melanoma-antigen-B6 | melanoma |
| MAGE-C1 | melanoma-antigen-C1 | bladder cancer, melanoma |
| MAGE-C2 | melanoma-antigen-C2 | melanoma |
| MAGE-C3 | melanoma-antigen-C3 | melanoma |
| MAGE-D1 | melanoma-antigen-D1 | melanoma |
| MAGE-D2 | melanoma-antigen-D2 | melanoma |
| MAGE-D4 | melanoma-antigen-D4 | melanoma |
| MAGE-E1 | melanoma-antigen-E1 | bladder cancer, melanoma |
| MAGE-E2 | melanoma-antigen-E2 | melanoma |
| MAGE-F1 | melanoma-antigen-F1 | melanoma |
| MAGE-H1 | melanoma-antigen-H1 | melanoma |
| MAGEL2 | MAGE-like 2 | melanoma |
| mammaglobin A | | breast cancer |
| MART-1/Melan-A | melanoma antigen recognized by T cells-1/melanoma antigen A | melanoma |
| MART-2 | melanoma antigen recognized by T cells-2 | melanoma |
| matrix protein 22 | | bladder cancer |
| MCIR | melanocortin I receptor | melanoma |
| M-CSF | macrophage colony-stimulating factor gene | ovarian cancer |
| mesothelin | | ovarian cancer |
| MG5D/PXDN | | breast cancer, glioblastoma, melanoma |
| MMP 11 | M-phase phosphoprotein 11 | leukemia |
| MN/CA IX-antigen | | renal cell carcinoma |
| MRP-3 | multidrug resistance-associated protein 3 | lung cancer |
| MUC1 | mucin 1 | breast cancer |
| MUC2 | mucin 2 | breast cancer, ovarian cancer, pancreatic cancer |
| NA 88-A | NA cDNA clone of patient M88 | melanoma |
| N-acetylglucosaminyltransferase-V | | |
| Neo-PAP | Neo-poly(A) polymerase | |
| NGEP | | prostate cancer |
| NMP22 | | bladder cancer |
| NPM/ALK | nucleophosmin/anaplastic lymphoma kinase fusion protein | |
| NSE | neuron-specific enolase | small cell cancer of lung, neuroblastoma, Wilm' tumor, melanoma, thyroid cancer, kidney cancer, testicle cancer, pancreas cancer |
| NY-ESO-1 | New York esophageous 1 | bladder cancer, head and neck cancer, melanoma, sarcoma, B-lymphoma, hepatoma, pancreatic cancer, ovarian cancer, breast cancer |
| NY-ESO-B | | |
| OA1 | ocular albinism type 1 protein | melanoma |
| OFA-iLRP | oncofetal antigen-immature laminin receptor | leukemia |
| OGT | O-linked N-acetylglucosamine transferase gene | |

TABLE 1-continued

Antigens expressed in cancer diseases

| Tumor antigen | Name of tumor antigen | Cancers or cancer diseases related thereto |
|---|---|---|
| OS-9 | | |
| osteocalcin | | prostate cancer |
| osteopontin | | prostate cancer, breast cancer, ovarian cancer |
| p15 | protein 15 | |
| p15 | | melanoma |
| p190 minor bcr-abl | | |
| p53 | | |
| PAGE-4 | prostate GAGE-like protein-4 | prostate cancer |
| PAI-1 | plasminogen acitvator inhibitor 1 | breast cancer |
| PAI-2 | plasminogen acitvator inhibitor 2 | breast cancer |
| PAP | prostate acic phosphatase | prostate cancer |
| PART-1 | | prostate cancer |
| PATE | | prostate cancer |
| PDEF | | prostate cancer |
| Pim-I-Kinase | | |
| PinI | Propyl isomerase | prostate cancer |
| PDTE | | prostate cancer |
| PRAME | preferentially expressed antigen of melanoma | melanoma, lung cancer, leukemia, head and neck cancer, renal cell carcinoma, sarcoma |
| prostein | | prostate cancer |
| proteinase-3 | | |
| PSA | prostate-specific antigen | prostate cancer |
| PSCA | | prostate cancer |
| PSGR | | prostate cancer |
| PSM | | |
| PSMA | prostate-specific membrane antigen | prostate cancer |
| RAGE-1 | renal antigen | bladder cancer, renal cancer, sarcoma, colon cancer |
| RHAMM/CD168 | receptor for hyaluronic acid mediated motility | leukemia |
| RU1 | renal ubiquitous 1 | bladder cancer, melanoma, renal cancer |
| RU2 | renal ubiquitous 1 | bladder cancer, melanoma, sarcoma, brain tumor, esophagel cancer, renal cancer, colon cancer, breast cancer |
| S-100 | | melanoma |
| SAGE | sarcoma antigen | |
| SART-1 | squamous antigen rejecting tumor 1 | esophageal cancer, head and neck cancer, lung cancer, uterine cancer |
| SART-2 | squamous antigen rejecting tumor 1 | head and neck cancer, lung cancer, renal cell carcinoma, melanoma, brain tumor |
| SART-3 | squamous antigen rejecting tumor 1 | head and neck cancer, lung cancer, leukemia, melanoma, esophageal cancer |
| SCC | squamous cell carcinoma antigen | lung cancer |
| Sp17 | sperm protein 17 | multiple myeloma |
| SSX-1 | synovial sarcoma X breakpoint 1 | hepatocellular cell carcinom, breast cancer |
| SSX-2/HOM-MEL-40 | synovial sarcoma X breakpoint 2 | breast cancer |
| SSX-4 | synovial sarcoma X breakpoint 4 | bladder cancer, hepatocellular cell carcinoma, breast cancer |
| STAMP-1 | | prostate cancer |
| STEAP | six transmembrane epithelial antigen prostate | prostate cancer |
| survivin | | bladder cancer |
| survivin-2B | intron 2-retaining survivin | bladder cancer |
| TA-90 | | melanoma |
| TAG-72 | | prostate carcinoma |
| TARP | | prostate cancer |
| TGFb | TGFbeta | |
| TGFbRII | TGFbeta receptor II | |
| TGM-4 | prostate-specific transglutaminase | prostate cancer |
| TRAG-3 | taxol resistant associated protein 3 | breast cancer, leukemia, and melanoma |
| TRG | testin-related gene | |
| TRP-1 | tyrosine related protein 1 | melanoma |
| TRP-2/6b | TRP-2/novel exon 6b | melanoma, glioblastoma |
| TRP-2/INT2 | TRP-2/intron 2 | melanoma, glioblastoma |
| Trp-p8 | | prostate cancer |
| Tyrosinase | | melanoma |
| UPA | urokinase-type plasminogen activator | breast cancer |
| VEGF | vascular endothelial growth factor | |
| VEGFR-2/FLK-1 | vascular endothelial growth factor receptor-2 | |
| WTI | Wilm' tumor gene | gastric cancer, colon cancer, lung cancer, breast cancer, ovarian cancer, leukemia |

TABLE 2

Mutant antigens expressed in cancer diseases

| Mutant antigen | Name of mutant antigen | Cancers or cancer diseases related thereto |
|---|---|---|
| alpha-actinin-4/m | | lung carcinoma |
| ARTC1/m | | melanoma |
| bcr/abl | breakpoint cluster region-Abelson fusion protein | CML |
| beta-Catenin/m | beta-Catenin | melanoma |
| BRCA1/m | | breast cancer |
| BRCA2/m | | breast cancer |
| CASP-5/m | | colorectal cancer, gastric cancer, endometrial carcinoma |
| CASP-8/m | | head and neck cancer, squamous cell carcinoma |
| CDC27/m | cell-division-cycle 27 | |
| CDK4/m | cyclin-dependent kinase 4 | melanoma |
| CDKN2A/m | | melanoma |
| CML66 | | CML |
| CDA-1/m | | colorectal cancer |
| DEK-CAN | fusion protein | AML |
| EFTUD2/m | | melanoma |
| ELF2/m | Elongation factor 2 | lung squamous cell carcinoma |
| ETV6-AML1 | Ets variant gene6/acute myeloid leukemia 1 gene fusion protein | ALL |
| FN1/m | fibronectin 1 | melanoma |
| GPNMB/m | | melanoma |
| HLA-A*0201-R170I | arginine to isoleucine exchange at residue 170 of the alpha-helix of the alpha2-domain in the HLA-A2 gene | renal cell carcinoma |
| HLA-A11/m | | melanoma |
| HLA-A2/m | | renal cell carcinoma |
| HSP70-2M | heat shock protein 70-2 mutated | renal cell carcinoma, melanoma, neuroblastoma |
| KIAA0205/m | | bladder tumor |
| K-Ras/m | | pancreatic carcinoma, colorectal carcinoma |
| LDLR-FUT | LDR-Fucosyltransferase fusion protein | melanoma |
| MART2/m | | melanoma |
| ME1/m | | non-small cell lung carcinoma |
| MUM-1/m | melanoma ubiquitous mutated 1 | melanoma |
| MUM-2/m | melanoma ubiquitous mutated 2 | melanoma |
| MUM-3/m | melanoma ubiquitous mutated 3 | melanoma |
| Myosin class I/m | | melanoma |
| neo-PAP/m | | melanoma |
| NFYC/m | | lung squamous cell carcinoma |
| N-Ras/m | | melanoma |
| OGT/m | | colorectal carcinoma |
| OS-9/m | | melanoma |
| p53/m | | |
| Pml/RARa | promyelocytic leukemia/retinoic acid receptor alpha | APL, PML |
| PRDX5/m | | melanoma |
| PTPRK/m | receptor-type protein-tyrosine phosphatase kappa | melanoma |
| RBAF600/m | | melanoma |
| SIRT2/m | | melanoma |
| SYT-SSX-1 | synaptotagmin I/synovial sarcoma X fusion protein | sarcoma |
| SYT-SSX-2 | synaptotagmin I/synovial sarcoma X fusion protein | sarcoma |
| TEL-AML1 | translocation Ets-family leukemia/acute myeloid leukemia I fusion protein | AML |
| TGFbRII | TGFbeta receptor II | colorectal carcinoma |
| TPI/m | triosephosphate isomerase | melanoma |

In a preferred embodiment according to the invention, antibodies encoded by the inventive RNA are directed against the following (protein) antigens (whereby the RNA molecules may be used for the preparation of a medicament, e.g. a pharmaceutical composition or more preferably a (passive) vaccine in the meaning of the present inventino), are selected from the group consisting of 5T4, 707-AP, 9D7, AFP, AlbZIP HPG1, alpha-5-beta-1-integrin, alpha-5-beta-6-integrin, alpha-actinin-4/m, alpha-methylacyl-coenzyme A racemase, ART-4, ARTC1/m, B7H4, BAGE-1, BCL-2, bcr/abl, beta-catenin/m, BING-4, BRCA1/m, BRCA2/m, CA 15-3/CA 27-29, CA 19-9, CA72-4, CA125, calreticulin, CAMEL, CASP-8/m, cathepsin B, cathepsin L, CD19, CD20, CD22, CD25, CDE30, CD33, CD4, CD52, CD55, CD56, CD80, CDC27/m, CDK4/m, CDKN2A/m, CEA, CLCA2, CML28, CML66, COA-1/m, coactosin-like protein, collage XXIII, COX-2, CT-9/BRD6, Cten, cyclin B1, cyclin D1, cyp-B, CYPB1, DAM-10, DAM-6, DEK-CAN, EFTUD2/m, EGFR, ELF2/m, EMMPRIN, EpCam, EphA2, EphA3, ErbB3, ETV6-AML1, EZH2, FGF-5, FN, Frau-1, G250, GAGE-1, GAGE-2, GAGE-3, GAGE-4, GAGE-5, GAGE-6, GAGE7b, GAGE-8, GDEP, GnT-V, gp100, GPC3, GPNMB/m, HAGE, HAST-2, hepsin, Her2/neu, HERV-K-MEL, HLA-A*0201-R17I, HLA-A11/m, HLA-A2/m, HNE, homeobox NKX3.1, HOM-TES-14/SCP-1, HOM-TES-85, HPV-E6, HPV-E7, HSP70-2M, HST-2, hTERT, iCE, IGF-1R, IL-13Ra2, IL-2R, IL-5, immature laminin receptor, kallikrein-2, kallikrein-4, Ki67, KIAA0205, KIAA0205/m, KK-LC-1, K-Ras/m, LAGE-A1, LDLR-FUT, MAGE-A1, MAGE-A2, MAGE-A3, MAGE-A4, MAGE-A6, MAGE-A9, MAGE-A10, MAGE-A12, MAGE-B1, MAGE-B2, MAGE-B3, MAGE-B4, MAGE-B5, MAGE-B6, MAGE-B10, MAGE-B16, MAGE-B17, MAGE-C1, MAGE-C2, MAGE-C3, MAGE-D1, MAGE-D2, MAGE-D4, MAGE-E1, MAGE-E2, MAGE-F1, MAGE-H1, MAGEL2, mammaglobin A, MART-1/melan- A, MART-2, MART-2/m, matrix protein 22, MC1R, M-CSF, ME1/m, mesothelin, MG50/PXDN, MMP11, MN/CA IX-antigen, MRP-3, MUC-1, MUC-2, MUM-1/m, MUM-2/m, MUM-3/m, myosin class I/m, NA88-A, N-acetylglucosaminyltransferase-V, Neo-PAP, Neo-PAP/m, NFYC/m, NGEP, NMP22, NPM/ALK, N-Ras/m, NSE, NY-ESO-1, NY-ESO-B, OA1, OFA-iLRP, OGT, OGT/m, OS-9, OS-9/m, osteocalcin, osteopontin, p15, p190 minor bcr-abl, p53, p53/m, PAGE-4, PAI-1, PAI-2, PART-1, PATE, PDEF, Pim-1-Kinase, Pin-1, Pml/PARalpha, POTE, PRAME, PRDX5/m, prostein, proteinase-3, PSA, PSCA, PSGR, PSM, PSMA, PTPRK/m, RAGE-1, RBAF600/m, RHAMM/CD168, RU1, RU2, S-100, SAGE, SART-1, SART-2, SART-3, SCC, SIRT2/m, Sp17, SSX-1, SSX-2/HOM-MEL-40, SSX-4, STAMP-1, STEAP, survivin, survivin-2B, SYT-SSX-1, SYT-SSX-2, TA-90, TAG-72, TARP, TEL-AML1, TGFbeta, TGFbetaRII, TGM-4, TPI/m, TRAG-3, TRG, TRP-1, TRP-2/6b, TRP/INT2, TRP-p8, tyrosinase, UPA, VEGF, VEGFR-2/FLK-1, and WT1.

In a particularly preferred embodiment, the RNA codes for antibodies which are directed against protein antigens selected from the group consisting of MAGE-A1, MAGE-A6, melan-A, GP100, tyrosinase, survivin, CEA, Her-2/neu, WT1, PRAME, EGFRI (epidermal growth factor receptor 1), mucin-1 and SEC61G, hTERT, 5T4, NY-Eso1, and TRP-2, more preferably from sequences of group consisting of MAGE-A1 [accession number M77481], MAGE-A6 [accession number NM_005363], melan-A [accession number NM_005511], GP100 [accession number M77348], tyrosinase [accession number NM_000372], survivin [accession number AF077350], CEA [accession number NM_004363], Her-2/neu [accession number M11730], WT1 [accession number NM_000378], PRAME [accession number NM_006115], EGFRI (epidermal growth factor receptor 1) [accession number AF288738], mucin-1 [accession number NM_002456] and SEC61G [accession number NM_014302], hTERT [accession number NM_198253], 5T4 [accession number NM_006670], NY-Eso1 [accession number NM_001327], and TRP-2 [accession number NM_001922].

Antibodies (and therefore also the RNAs according to the invention on which these antibodies are based) which bind the antigens described here and, possibly, other antigens or nucleic acids can be identified e.g. by means of the method of phage display developed by George P. Smith. In this context, antibodies or antibody fragments are typically expressed on the surface of filamentous phages (Smith, G. P., 1985, "Filamentous fusion phage: novel expression vectors that display cloned antigens on the virion surface", Science 228; 1315-1317). For this there are conventionally 3 to 5 copies of the surface protein gpIII on the proximal end of the phage, with the aid of which the phage infects bacteria cells via the F pilus thereof. In phage display, for example, the DNA for an antibody fragment which codes the antigen-binding variable domain is then cloned in-frame before the gpIII gene. In protein biosynthesis, a fusion protein is formed therefrom, which is expressed on the virus surface without the phage losing its infectiousness. With the aid of the phage display technique, it is possible to generate large antibody libraries, each phage expressing a different antibody fragment on the surface. To this extent, the underlying RNA is therefore also available. A particular antibody fragment can be isolated from such a library by a method called "phage panning". For this, the corresponding antigen is bound to a matrix and incubated with the phage suspension. The phages which present an appropriate antibody fragment interact with the fixed antigen, while the other phages are removed by a washing step. The phages isolated are multiplied, for example, in E. coli. The DNA is isolated accordingly and the gene sequence is determined. Expression constructs which contain the cDNA coding for the entire antibody or antibody fragments can then be developed with the aid of genetic engineering methods. An RNA (mRNA) which codes for the antibody can be generated from this cDNA by means of in vitro transcription (see below). Nucleic acids or, respectively, mRNA coding for monoclonal antibodies which are entirely of human origin are obtained in this manner.

In the context of the present invention, RNA according to the invention which codes for antibodies as described above is also suitable for coding so-called intrabodies or for rendering possible an expression of intrabodies. Intrabodies in the context of the present invention can include any of the antibodies or antibody fragments described here. Intrabodies are intracellularly expressed antibodies, i.e. antibodies which are coded by nucleic acids localized in the cell and are expressed there. For this, an RNA according to the invention which encodes the antibodies or antibody fragments as described above is introduced into cells beforehand, for example with the aid of transfection methods according to the invention or other suitable transfection methods and, where appropriate, thereafter transplanted into an organism or being or introduced directly as nucleic acids into an organism or being. In this context (irrespective of whether an intrabody or a secreted antibody shall be introduce into the cell), the RNA according to the invention (or a corresponding nucleic acid) can be introduced in the naked form or as a complex with suitable carriers (e.g. liposomes) into the organism or the being or can have such modifications (of the RNA) which, where appropriate together with one of the transfection methods mentioned, lead to a better cell uptake, e.g. any of the RNA modifications mentioned here, such as, for example, lipid modifications of the RNA according to the invention. An organism or a being in connection with the present invention typically means mammals, i.e. animals, including cattle, pig, dog, cat, donkey, monkey, rodents, e.g. mouse, hamster, rabbit etc., and humans. Intrabodies can be localized and expressed at certain sites in the cell. For example, intrabodies can be expressed in the cytoplasm, the formation of disulfide bridges usually being decreased under the reducing conditions of the cytoplasm. It has been possible to demonstrate, however, that cytoplasmic intrabodies, and in particular scFv fragments, can be functional. Cytoplasmic expression by the RNA according to the invention opens up the possibility of also inhibiting cytoplasmic proteins. This is not possible with treatment with monoclonal antibodies from the prior art, since these antibodies can reach only secreted and membrane-located (extracellular) proteins due to their secretion from the cell after intracellular expression (which represents the major difference between antibodies and intrabodies). By expression of a signal peptide, intrabodies can be transported into the endoplasmic reticulum (ER) and then secreted as with regular antibodies. In this case, typically only secreted or membrane-located proteins are a target for these antibodies. By additional coding of a C-terminal ER retention signal (for example KDEL) by the RNA according to the invention, the intrabody can remain in the ER (where it may bind to specific antigen located in the ER) and prevent secretion of its antigen and/or transport of its antigen or its target molecule to the plasma membrane. Depending on the requirement, intrabodies can include full length antibodies or antibody fragments as described above. Intrabodies in the context of the present invention preferably initially include full length antibodies, which are retained in the cell and not secreted from the cell (by whatever technique, e.g. retention signal sequences etc.). However, if e.g. intracellular expression of full length antibodies is technically not possible or not appropriate, antibody fragments as described above can also be employed as intrabodies.

Preferably, the antibody encoded by the at least one coding sequence of the RNA is an antibody as defined herein, which is encoded by a nucleic acid sequence selected from the group consisting of SEQ ID NOs: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734.

In a preferred embodiment, the present invention thus provides an RNA comprising at least one coding sequence, wherein the coding sequence comprises a nucleic acid sequence selected from the group consisting of nucleic acid sequences according to SEQ ID NOs: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant of any one of said nucleic acid sequences.

In certain embodiments, the RNA according to the invention, preferably the at least one coding sequence of the RNA according to the invention, may comprise or consist of a fragment of a nucleic acid sequence encoding an antibody or a fragment or variant thereof as defined herein. Preferably, the RNA according to the invention, preferably the at least one coding sequence of the RNA according to the invention, comprises or consists of a fragment of a nucleic acid sequence selected from the group consisting of SEQ ID NOs: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or of a variant of any one of said nucleic acid sequences.

In this context, a 'fragment of a nucleic acid sequence' is preferably a nucleic acid sequence encoding a fragment of an antibody or of a variant thereof as described herein. More preferably, the expression 'fragment of a nucleic acid sequence' refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a respective full-length nucleic acid sequence.

In another preferred embodiment, the RNA according to the invention, preferably the at least one coding sequence of the RNA according to the invention, may comprise or consist of a variant of a nucleic acid sequence as defined herein, preferably of a nucleic acid sequence encoding an antibody or a fragment thereof as defined herein. The expression 'variant of a nucleic acid sequence' as used herein in the context of a nucleic acid sequence encoding an antibody or a fragment thereof, typically refers to a nucleic acid sequence, which differs by at least one nucleic acid residue from the respective reference nucleic acid sequence encoding an antibody or a fragment thereof. More preferably, the expression 'variant of a nucleic acid sequence' refers to a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence, from which it is derived.

Preferably, the RNA according to the invention, more preferably the at least one coding sequence of the RNA according to the invention, encodes a variant of an antibody or a fragment thereof, preferably as defined herein.

In a preferred embodiment, the RNA according to the invention, more preferably the at least one coding sequence of the RNA according to the invention, comprises or consists of a variant of a nucleic acid sequence encoding an antibody or a fragment thereof as defined herein, wherein the variant of the nucleic acid sequence encodes an amino acid sequence comprising at least one conservative substitution of an amino acid residue.

In another embodiment, the RNA according to the invention, more preferably the at least one coding sequence of the RNA according to the invention, comprises or consists of a variant of a nucleic acid sequence encoding an antibody or a fragment thereof as defined herein, wherein the nucleic acid sequence of the variant differs from the respective reference nucleic acid sequence in at least one nucleic acid residue, preferably without resulting—due to the degenerated genetic code—in an alteration of the encoded amino acid sequence, i.e. the amino acid sequence encoded by the variant or at least part thereof may preferably not differ from the reference amino acid sequence in one or more mutation(s) within the above meaning.

Furthermore, a 'variant' of a nucleic acid sequence encoding an antibody or a fragment or variant thereof as defined herein, may also comprise DNA sequences, which correspond to RNA sequences as defined herein and may also comprise further RNA sequences, which correspond to DNA sequences as defined herein. Those skilled in the art are familiar with the translation of an RNA sequence into a DNA sequence (or vice versa) or with the creation of the complementary strand sequence (i.e. by substitution of U residues with T residues and/or by constructing the complementary strand with respect to a given sequence).

According to a preferred embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence encoding a reference full-length antibody as defined herein, or a variant thereof.

In a further preferred embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant of any one of said nucleic acid sequences.

According to a particularly preferred embodiment, the at least one coding sequence of the RNA according to the invention comprises or consists of a nucleic acid sequence having a sequence identity of at least 80% with a nucleic acid sequence selected from the group consisting of SEQ ID NOs: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment of any one of said nucleic acid sequences.

Table 3 below shows the assignment of amino acid sequences and RNA sequences of exemplified antibodies, which are preferably encoded by the RNA according to the present invention as described herein. In particular, the first column of Table 3 ("Name") identifies (i) the antibody name and (ii) the antibody fragment (or complete antibody) encoded by the respective amino acid or RNA sequences, for example the chain (e.g., heavy chain, light chain, or any alternative/variant thereof) or the variable region. If the respective amino acid or RNA sequences encodes a fragment of a chain only (such as a certain region of an antibody chain), this can be retrieved from the column "Name". In other words, unless otherwise indicated under "name", the sequences provided relate to full length heavy or light chain sequences of the respective antibodies. However, it is also preferred that the coding sequence of the RNA according to the present invention encodes a fragment or a variant of the antibody sequences (e.g. heavy chain or light chain sequences) shown in Table 3 below.

TABLE 3

RNA and amino acid sequences of exemplified antibodies

| Name | Protein SEQ ID NO | RNA SEQ ID NO |
| --- | --- | --- |
| AAB-003_gamma1-Chain | 1 | 7643, 15285, 22927, 30569, 38211, 45853, 53495 |
| Abagovomab_HeavyChain | 2 | 7644, 15286, 22928, 30570, 38212, 45854, 53496 |
| Abagovomab_LightChain | 3 | 7645, 15287, 22929, 30571, 38213, 45855, 53497 |
| Abciximab_HeavyChain | 4 | 7646, 15288, 22930, 30572, 38214, 45856, 53498 |
| Abciximab_LightChain | 5 | 7647, 15289, 22931, 30573, 38215, 45857, 53499 |
| Abituzumab_HeavyChain1 | 6 | 7648, 15290, 22932, 30574, 38216, 45858, 53500 |
| Abituzumab_LightChain1 | 7 | 7649, 15291, 22933, 30575, 38217, 45859, 53501 |
| Abrilumab_HeavyChain1 | 8 | 7650, 15292, 22934, 30576, 38218, 45860, 53502 |
| Abrilumab_LightChain1 | 9 | 7651, 15293, 22935, 30577, 38219, 45861, 53503 |
| Abrilumab_LightChain1_variant2 | 10 | 7652, 15294, 22936, 30578, 38220, 45862, 53504 |
| Actoxumab_HeavyChain1 | 11 | 7653, 15295, 22937, 30579, 38221, 45863, 53505 |
| Actoxumab_LightChain1 | 12 | 7654, 15296, 22938, 30580, 38222, 45864, 53506 |
| Adalimumab_HeavyChain | 13 | 7655, 15297, 22939, 30581, 38223, 45865, 53507 |
| Adalimumab_LightChain | 14 | 7656, 15298, 22940, 30582, 38224, 45866, 53508 |
| Aducanumab_HeavyChain1 | 15 | 7657, 15299, 22941, 30583, 38225, 45867, 53509 |
| Aducanumab_LightChain1 | 16 | 7658, 15300, 22942, 30584, 38226, 45868, 53510 |
| Afasevikumab_HeavyChain1 | 17 | 7659, 15301, 22943, 30585, 38227, 45869, 53511 |
| Afasevikumab_LightChain1 | 18 | 7660, 15302, 22944, 30586, 38228, 45870, 53512 |
| Aflibercept_Fusion_protein1 | 19 | 7661, 15303, 22945, 30587, 38229, 45871, 53513 |
| Afutuzuab_HeavyChain1 | 20 | 7662, 15304, 22946, 30588, 38230, 45872, 53514 |
| Afutuzuab_LightChain1 | 21 | 7663, 15305, 22947, 30589, 38231, 45873, 53515 |
| Afutuzumab_HeavyChain1 | 22 | 7664, 15306, 22948, 30590, 38232, 45874, 53516 |
| Afutuzumab_LightChain1 | 23 | 7665, 15307, 22949, 30591, 38233, 45875, 53517 |
| Alacizumab_pegol_HeavyChain1 | 24 | 7666, 15308, 22950, 30592, 38234, 45876, 53518 |
| Alacizumab_pegol_LightChain1 | 25 | 7667, 15309, 22951, 30593, 38235, 45877, 53519 |
| Alemtuzumab_HeavyChain | 26 | 7668, 15310, 22952, 30594, 38236, 45878, 53520 |
| Alemtuzumab_HeavyChain_variant_Ibey_H | 27 | 7669, 15311, 22953, 30595, 38237, 45879, 53521 |
| Alemtuzumab_HeavyChain_variant_Icel_H | 28 | 7670, 15312, 22954, 30596, 38238, 45880, 53522 |
| Alemtuzumab_HeavyChain_variant_8005_H | 29 | 7671, 15313, 22955, 30597, 38239, 45881, 53523 |
| Alemtuzumab_LightChain | 30 | 7672, 15314, 22956, 30598, 38240, 45882, 53524 |
| Alemtuzumab_LightChain_variant_8005_L | 31 | 7673, 15315, 22957, 30599, 38241, 45883, 53525 |
| Alirocumab_HeavyChain1 | 32 | 7674, 15316, 22958, 30600, 38242, 45884, 53526 |
| Alirocumab_LightChain1 | 33 | 7675, 15317, 22959, 30601, 38243, 45885, 53527 |
| ALX-0061_HeavyChain1 | 34 | 7676, 15318, 22960, 30602, 38244, 45886, 53528 |
| Amatuximab_HeavyChain1 | 35 | 7677, 15319, 22961, 30603, 38245, 45887, 53529 |
| Amatuximab_LightChain1 | 36 | 7678, 15320, 22962, 30604, 38246, 45888, 53530 |
| Anetumab_ravtansine_HeavyChain1 | 37 | 7679, 15321, 22963, 30605, 38247, 45889, 53531 |
| Anetumab_ravtansine_LightChain1 | 38 | 7680, 15322, 22964, 30606, 38248, 45890, 53532 |
| Anifrolumab_HeavyChain1 | 39 | 7681, 15323, 22965, 30607, 38249, 45891, 53533 |
| Anifrolumab_LightChain1 | 40 | 7682, 15324, 22966, 30608, 38250, 45892, 53534 |
| Anrukinzumab_HeavyChain1 | 41 | 7683, 15325, 22967, 30609, 38251, 45893, 53535 |
| Anrukinzumab_LightChain1 | 42 | 7684, 15326, 22968, 30610, 38252, 45894, 53536 |
| Apolizumab_HeavyChain1 | 43 | 7685, 15327, 22969, 30611, 38253, 45895, 53537 |
| Apolizumab_LightChain1 | 44 | 7686, 15328, 22970, 30612, 38254, 45896, 53538 |
| Apomab_HeavyChain | 45 | 7687, 15329, 22971, 30613, 38255, 45897, 53539 |
| Apomab_LightChain | 46 | 7688, 15330, 22972, 30614, 38256, 45898, 53540 |
| Aquaporumab_LightChain | 47 | 7689, 15331, 22973, 30615, 38257, 45899, 53541 |
| Arcitumomab_99tc_HeavyChain | 48 | 7690, 15332, 22974, 30616, 38258, 45900, 53542 |
| Arcitumomab_99tc_LightChain | 49 | 7691, 15333, 22975, 30617, 38259, 45901, 53543 |
| Ascrinvacumab_HeavyChain1 | 50 | 7692, 15334, 22976, 30618, 38260, 45902, 53544 |
| Ascrinvacumab_LightChain1 | 51 | 7693, 15335, 22977, 30619, 38261, 45903, 53545 |
| Aselizuab_HeavyChain1 | 52 | 7694, 15336, 22978, 30620, 38262, 45904, 53546 |
| Aselizuab_HeavyChain2 | 53 | 7695, 15337, 22979, 30621, 38263, 45905, 53547 |
| Aselizuab_LightChain1 | 54 | 7696, 15338, 22980, 30622, 38264, 45906, 53548 |
| Atezolizumab_HeavyChain1 | 55 | 7697, 15339, 22981, 30623, 38265, 45907, 53549 |
| Atezolizumab_LightChain1 | 56 | 7698, 15340, 22982, 30624, 38266, 45908, 53550 |
| Atinumab_HeavyChain1 | 57 | 7699, 15341, 22983, 30625, 38267, 45909, 53551 |
| Atinumab_LightChain1 | 58 | 7700, 15342, 22984, 30626, 38268, 45910, 53552 |
| Atlizuab_HeavyChain1 | 59 | 7701, 15343, 22985, 30627, 38269, 45911, 53553 |
| Atlizuab_LightChain1 | 60 | 7702, 15344, 22986, 30628, 38270, 45912, 53554 |
| Aurograb_SingleChain | 61 | 7703, 15345, 22987, 30629, 38271, 45913, 53555 |
| Avelumab_HeavyChain1 | 62 | 7704, 15346, 22988, 30630, 38272, 45914, 53556 |
| Avelumab_LightChain1 | 63 | 7705, 15347, 22989, 30631, 38273, 45915, 53557 |
| Bapineuzumab_HeavyChain1 | 64 | 7706, 15349, 22990, 30632, 38274, 45916, 53558 |
| Bapineuzumab_LightChain1 | 65 | 7707, 15349, 22991, 30633, 38275, 45917, 53559 |
| Basiliximab_HeavyChain | 66 | 7708, 15350, 22992, 30634, 38276, 45918, 53560 |
| Basiliximab_LightChain | 67 | 7709, 15351, 22993, 30635, 38277, 45919, 53561 |
| Bavituximab_HeavyChain | 68 | 7710, 15352, 22994, 30636, 38278, 45920, 53562 |
| Bavituximab_LightChain | 69 | 7711, 15353, 22995, 30637, 38279, 45921, 53563 |
| Bavituximab_LightChain_variant_8734_L | 70 | 7712, 15354, 22996, 30638, 38280, 45922, 53564 |
| Begelomab_HeavyChain1 | 71 | 7713, 15355, 22997, 30639, 38281, 45923, 53565 |
| Begelomab_LightChain1 | 72 | 7714, 15356, 22998, 30640, 38282, 45924, 53566 |
| Benralizumab_HeavyChain1 | 73 | 7715, 15357, 22999, 30641, 38283, 45925, 53567 |
| Benralizumab_LightChain1 | 74 | 7716, 15358, 23000, 30642, 38284, 45926, 53568 |
| Betalutin_HeavyChain1 | 75 | 7717, 15359, 23001, 30643, 38285, 45927, 53569 |
| Betalutin_LightChain1 | 76 | 7718, 15360, 23002, 30644, 38286, 45928, 53570 |

TABLE 3-continued

RNA and amino acid sequences of exemplified antibodies

| Name | Protein SEQ ID NO | RNA SEQ ID NO |
| --- | --- | --- |
| Bevacituzuab_HeavyChain1 | 77 | 7719, 15361, 23003, 30645, 38287, 45929, 53571 |
| Bevacituzuab_LightChain1 | 78 | 7720, 15362, 23004, 30646, 38288, 45930, 53572 |
| Bevacizumab_154-aspartic_acid_LightChain | 79 | 7721, 15363, 23005, 30647, 38289, 45931, 53573 |
| Bevacizumab_154-substitution_deriv_LightChain | 80 | 7722, 15364, 23006, 30648, 38290, 45932, 53574 |
| Bevacizumab_180-serine_HeavyChain | 81 | 7723, 15365, 23007, 30649, 38291, 45933, 53575 |
| Bevacizumab_180-substitution_deriv_HeavyCahin | 82 | 7724, 15366, 23008, 30650, 38292, 45934, 53576 |
| Bevacizumab_beta_HeavyChain1 | 83 | 7725, 15367, 23009, 30651, 38293, 45935, 53577 |
| Bevacizumab_beta_LightChain1 | 84 | 7726, 15368, 23010, 30652, 38294, 45936, 53578 |
| Bevacizumab_FcDomain | 85 | 7727, 15369, 23011, 30653, 38295, 45937, 53579 |
| Bevacizumab_HeavyChain | 86 | 7728, 15370, 23012, 30654, 38296, 45938, 53580 |
| Bevacizumab_HeavyChain_variant1 | 87 | 7729, 15371, 23013, 30655, 38297, 45939, 53581 |
| Bevacizumab_HeavyChain_V-Region | 88 | 7730, 15372, 23014, 30656, 38298, 45940, 53582 |
| Bevacizumab_LightChain1 | 89 | 7731, 15373, 23015, 30657, 38299, 45941, 53583 |
| Bevacizumab_LightChain2 | 90 | 7732, 15374, 23016, 30658, 38300, 45942, 53584 |
| Bevacizumab_LightChain | 91 | 7733, 15375, 23017, 30659, 38301, 45943, 53585 |
| Bevacizumab_LightChain_VJ-Region | 92 | 7734, 15376, 23018, 30660, 38302, 45944, 53586 |
| Bevacizumab_LightChain_V-Region | 93 | 7735, 15377, 23019, 30661, 38303, 45945, 53587 |
| Bevacizumah-rhuMAb-VEGF_HeavyChain_gamma1-Chain_VDJ-Region | 94 | 7736, 15378, 23020, 30662, 38304, 45946, 53588 |
| Bevacizumah-rhuMAb-VEGF_LightChain_VJ-Region | 95 | 7737, 15379, 23021, 30663, 38305, 45947, 53589 |
| Bevacizumab_gamma1-Chain | 96 | 7738, 15380, 23022, 30664, 38306, 45948, 53590 |
| Bevacizumab_gamma1-Chain_CH3-Region_mutein | 97 | 7739, 15381, 23023, 30665, 38307, 45949, 53591 |
| Bezlotoxumab_HeavyChain1 | 98 | 7740, 15382, 23024, 30666, 38308, 45950, 53592 |
| Bezlotoxumab_LightChain1 | 99 | 7741, 15383, 23025, 30667, 38309, 45951, 53593 |
| Bimagrumab_HeavyChain1 | 100 | 7742, 15384, 23026, 30668, 38310, 45952, 53594 |
| Bimagrumab_HeavyChain | 101 | 7743, 15385, 23027, 30669, 38311, 45953, 53595 |
| Bimagrumab_LightChain1 | 102 | 7744, 15386, 23028, 30670, 38312, 45954, 53596 |
| Bimekizumab_HeavyChain1 | 103 | 7745, 15387, 23029, 30671, 38313, 45955, 53597 |
| Bimekizumab_LightChain1 | 104 | 7746, 15388, 23030, 30672, 38314, 45956, 53598 |
| Bleselumab_HeavyChain1 | 105 | 7747, 15389, 23031, 30673, 38315, 45957, 53599 |
| Bleselumab_LightChain1 | 106 | 7748, 15390, 23032, 30674, 38316, 45958, 53600 |
| Blinatumomab_HeavyChain1 | 107 | 7749, 15391, 23033, 30675, 38317, 45959, 53601 |
| Blinatumomab_SingleChain | 108 | 7750, 15392, 23034, 30676, 38318, 45960, 53602 |
| Blinatumumab_SingleChain_variable_fragment_fusion_protein_(bite) | 109 | 7751, 15393, 23035, 30677, 38319, 45961, 53603 |
| Blontuvetmab_HeavyChain | 110 | 7752, 15394, 23036, 30678, 38320, 45962, 53604 |
| Blontuvetmab_LightChain | 111 | 7753, 15395, 23037, 30679, 38321, 45963, 53605 |
| Blosozumab_HeavyChain1 | 112 | 7754, 15396, 23038, 30680, 38322, 45964, 53606 |
| Blosozumab_LightChain1 | 113 | 7755, 15397, 23039, 30681, 38323, 45965, 53607 |
| Bococizumab_HeavyChain1 | 114 | 7756, 15398, 23040, 30682, 38324, 45966, 53608 |
| Bococizumab_LightChain1 | 115 | 7757, 15399, 23041, 30683, 38325, 45967, 53609 |
| Brentuximab_vedotin_HeavyChain1 | 116 | 7758, 15400, 23042, 30684, 38326, 45968, 53610 |
| Brentuximab_vedotin_LightChain1 | 117 | 7759, 15401, 23043, 30685, 38327, 45969, 53611 |
| Briakinumab_HeavyChain1 | 118 | 7760, 15402, 23044, 30686, 38328, 45970, 53612 |
| Briakinumab_LightChain1 | 119 | 7761, 15403, 23045, 30687, 38329, 45971, 53613 |
| Brodalumab_HeavyChain1 | 120 | 7762, 15404, 23046, 30688, 38330, 45972, 53614 |
| Brodalumab_LightChain1 | 121 | 7763, 15405, 23047, 30689, 38331, 45973, 53615 |
| Brolucizumab_HeavyChain1 | 122 | 7764, 15406, 23048, 30690, 38332, 45974, 53616 |
| Brolucizuma_scFv_fragment | 123 | 7765, 15407, 23049, 30691, 38333, 45975, 53617 |
| Brontictuzumab_HeavyChain1 | 124 | 7766, 15408, 23050, 30692, 38334, 45976, 53618 |
| Brontictuzumab_LightChain1 | 125 | 7767, 15409, 23051, 30693, 38335, 45977, 53619 |
| BTT-1023_HeavyChain1 | 126 | 7768, 15410, 23052, 30694, 38336, 45978, 53620 |
| BTT-1023_LightChain1 | 127 | 7769, 15411, 23053, 30695, 38337, 45979, 53621 |
| Burosumab_HeavyChain1 | 128 | 7770, 15412, 23054, 30696, 38338, 45980, 53622 |
| Burosumab_LightChain1 | 129 | 7771, 15413, 23055, 30697, 38339, 45981, 53623 |
| Canakinumab_HeavyChain1 | 130 | 7772, 15414, 23056, 30698, 38340, 45982, 53624 |
| Canakinumab_HeavyChain | 131 | 7773, 15415, 23057, 30699, 38341, 45983, 53625 |
| Canakinumab_LightChain1 | 132 | 7774, 15416, 23058, 30700, 38342, 45984, 53626 |
| Canakinumab_LightChain | 133 | 7775, 15417, 23059, 30701, 38343, 45985, 53627 |
| Canakinumab_LightChain_variant_8836_L | 134 | 7776, 15418, 23060, 30702, 38344, 45986, 53628 |
| Cantuzumab_HeavyChain1 | 135 | 7777, 15419, 23061, 30703, 38345, 45987, 53629 |
| Cantuzumab_HeavyChain | 136 | 7778, 15420, 23062, 30704, 38346, 45988, 53630 |
| Cantuzumab_LightChain1 | 137 | 7779, 15421, 23063, 30705, 38347, 45989, 53631 |
| Cantuzumab_mertansine_HeavyChain1 | 138 | 7780, 15422, 23064, 30706, 38348, 45990, 53632 |
| Cantuzumab_mertansine_LightChain1 | 139 | 7781, 15423, 23065, 30707, 38349, 45991, 53633 |
| Cantuzumab_ravtansine_HeavyChain1 | 140 | 7782, 15424, 23066, 30708, 38350, 45992, 53634 |
| Cantuzumab_ravtansine_LightChain1 | 141 | 7783, 15425, 23067, 30709, 38351, 45993, 53635 |
| Caplacizumab | 142 | 7784, 15426, 23068, 30710, 38352, 45994, 53636 |
| Caplacizumab_HeavyChain1 | 143 | 7785, 15427, 23069, 30711, 38353, 45995, 53637 |
| Caplacizumab_HeavyChain1 | 144 | 7786, 15428, 23070, 30712, 38354, 45996, 53638 |
| Carlumab_HeavyChain1 | 145 | 7787, 15429, 23071, 30713, 38355, 45997, 53639 |
| Carlumab_LightChain1 | 146 | 7788, 15430, 23072, 30714, 38356, 45998, 53640 |
| Cergutuzumab_amunaleukin_HeavyChain1 | 147 | 7789, 15431, 23073, 30715, 38357, 45999, 53641 |
| Cergutuzumab_amunaleukin_HeavyChain2 | 148 | 7790, 15432, 23074, 30716, 38358, 46000, 53642 |
| Cergutuzumab_amunaleukin_LightChain1 | 149 | 7791, 15433, 23075, 30717, 38359, 46001, 53643 |
| Certolizumab_pegol_HeavyChain1 | 150 | 7792, 15434, 23076, 30718, 38360, 46002, 53644 |
| Certolizumab_pegol_HeavyChain | 151 | 7793, 15435, 23077, 30719, 38361, 46003, 53645 |

TABLE 3-continued

RNA and amino acid sequences of exemplified antibodies

| Name | Protein SEQ ID NO | RNA SEQ ID NO |
| --- | --- | --- |
| Certolizumab_pegol_LightChain1 | 152 | 7794, 15436, 23078, 30720, 38362, 46004, 53646 |
| Certolizumab_pegol_LightChain | 153 | 7795, 15437, 23079, 30721, 38363, 46005, 53647 |
| Cetuximab_HeavyChain | 154 | 7796, 15438, 23080, 30722, 38364, 46006, 53648 |
| Cetuximab_HeavyChain_variant | 155 | 7797, 15439, 23081, 30723, 38365, 46007, 53649 |
| Cetuximab_LightChain | 156 | 7798, 15440, 23082, 30724, 38366, 46008, 53650 |
| Cetuximab_LightChain_variant | 157 | 7799, 15441, 23083, 30725, 38367, 46009, 53651 |
| Citatuzumab_bogatox_HeavyChain1 | 158 | 7780, 15442, 23084, 30726, 38368, 46010, 53652 |
| Citatuzumab_bogatox_LightChain1 | 159 | 7801, 15443, 23085, 30727, 38369, 46011, 53653 |
| Cixutumumab_HeavyChain1 | 160 | 7802, 15444, 23086, 30728, 38370, 46012, 53654 |
| Cixutumumab_LightChain1 | 161 | 7803, 15445, 23087, 30729, 38371, 46013, 53655 |
| Clazakizumab_HeavyChain1 | 162 | 7804, 15446, 23088, 30730, 38372, 46014, 53656 |
| Clazakizumab_LightChain1 | 163 | 7805, 15447, 23089, 30731, 38373, 46015, 53657 |
| Clivatuzumab_tetraxetan_HeavyChain1 | 164 | 7806, 15448, 23090, 30732, 38374, 46016, 53658 |
| Clivatuzumab_tetraxetan_LightChain1 | 165 | 7807, 15449, 23091, 30733, 38375, 46017, 53659 |
| Codrituzumab_HeavyChain1 | 166 | 7808, 15450, 23092, 30734, 38376, 46018, 53660 |
| Codrituzumab_LightChain1 | 167 | 7809, 15451, 23093, 30735, 38377, 46019, 53661 |
| Coltuximab_ravtansine_HeavyChain1 | 168 | 7810, 15452, 23094, 30736, 38378, 46020, 53662 |
| Coltuximah_ravtansine_LightChain1 | 169 | 7811, 15453, 23095, 30737, 38379, 46021, 53663 |
| Conatumumab_CV_HeavyChain | 170 | 7812, 15454, 23096, 30738, 38380, 46022, 53664 |
| Conatumumab_CV_LightChain | 171 | 7813, 15455, 23097, 30739, 38381, 46023, 53665 |
| Conatumumab_HeavyChain1 | 172 | 7814, 15456, 23098, 30740, 38382, 46024, 53666 |
| Conatumumab_HeavyChain | 173 | 7815, 15457, 23099, 30741, 38383, 46025, 53667 |
| Conatumumab_LightChain1 | 174 | 7816, 15458, 23100, 30742, 38384, 46026, 53668 |
| Conatumumab_LightChain | 175 | 7817, 15459, 23101, 30743, 38385, 46027, 53669 |
| Concizumab_HeavyChain1 | 175 | 7818, 15460, 23102, 30744, 38386, 46028, 53670 |
| Concizumab_LightChain1 | 177 | 7819, 15461, 23103, 30745, 38387, 46029, 53671 |
| Crenezumab_HeavyChain1 | 178 | 7820, 15462, 23104, 30746, 38388, 46030, 53672 |
| Crenezumab_LightChain1 | 179 | 7821, 15463, 23105, 30747, 38389, 46031, 53673 |
| Crotedumab_HeavyChain1 | 180 | 7822, 15464, 23106, 30748, 38390, 46032, 53674 |
| Crotedumab_HeavyChain2 | 181 | 7823, 15465, 23107, 30749, 38391, 46033, 53675 |
| Crotedumab_LightChain1 | 182 | 7824, 15466, 23108, 30750, 38392, 46034, 53676 |
| Crotedumab_LightChain2 | 183 | 7825, 15467, 23109, 30751, 38393, 46035, 53677 |
| Dacetuzumab_HeavyChain1 | 184 | 7826, 15468, 23110, 30752, 38394, 46036, 53678 |
| Dacetuzumab_LightChain1 | 185 | 7827, 15469, 23111, 30753, 38395, 46037, 53679 |
| Dacliximab_LightChain_VJ-Region | 186 | 7828, 15470, 23112, 30754, 38396, 46038, 53680 |
| Dacliximab_gamma2-Chain_VDJ-Region | 187 | 7829, 15471, 23113, 30755, 38397, 46039, 53681 |
| Daclizumab_HeavyChain | 188 | 7830, 15472, 23114, 30756, 38398, 46040, 53682 |
| Daclizumab_LightChain | 189 | 7831, 15473, 23115, 30757, 38399, 46041, 53683 |
| Dalotuzumab_HeavyChain1 | 190 | 7832, 15474, 23116, 30758, 38400, 46042, 53684 |
| Dalotuzumab_LightChain1 | 191 | 7833, 15475, 23117, 30759, 38401, 46043, 53685 |
| Dapirolizumab_pegol_HeavyChain1 | 192 | 7834, 15476, 23118, 30760, 38402, 46044, 53686 |
| Dapirolizumab_pegol_LightChain1 | 193 | 7835, 15477, 23119, 30761, 38403, 46045, 53687 |
| Daratumumab_HeavyChain1 | 194 | 7836, 15478, 23120, 30762, 38404, 46046, 53688 |
| Daratumumab_LightChain1 | 195 | 7837, 15479, 23121, 30763, 38405, 46047, 53689 |
| Dectrekumab_HeavyChain1 | 196 | 7838, 15480, 23122, 30764, 38406, 46048, 53690 |
| Dectrekumab_LightChain1 | 197 | 7839, 15481, 23123, 30765, 38407, 46049, 53691 |
| Demcizumab_HeavyChain1 | 198 | 7840, 15482, 23124, 30766, 38408, 46050, 53692 |
| Demcizumab_LightChain1 | 199 | 7841, 15483, 23125, 30767, 38409, 46051, 53693 |
| Denintuzumab_mafodotin_HeavyChain1 | 200 | 7842, 15484, 23126, 30768, 38410, 46052, 53694 |
| Denintuzumab_mafodotin_LightChain1 | 201 | 7843, 15485, 23127, 30769, 38411, 46053, 53695 |
| Denosumab_HeavyChain | 202 | 7844, 15486, 23128, 30770, 38412, 46054, 53696 |
| Denosumab_LightChain | 203 | 7845, 15487, 23129, 30771, 38413, 46055, 53697 |
| Depatuxizumab_HeavyChain1 | 204 | 7846, 15488, 23130, 30772, 38414, 46056, 53698 |
| Depatuxizumab_LightChain1 | 205 | 7847, 15489, 23131, 30773, 38415, 46057, 53699 |
| Depatuxizumab_mafodotin_HeavyChain1 | 206 | 7848, 15490, 23132, 30774, 38416, 46058, 53700 |
| Depatuxizumab_mafodotin_LightChain1 | 207 | 7849, 15491, 23133, 30775, 38417, 46059, 53701 |
| Dinutuximab_beta_HeavyChain1 | 208 | 7850, 15492, 23134, 30776, 38418, 46060, 53702 |
| Dinutuximab_beta_LightChain1 | 209 | 7851, 15493, 23135, 30777, 38419, 46061, 53703 |
| Dinutuximab_HeavyChain1 | 210 | 7852, 15494, 23136, 30778, 38420, 46062, 53704 |
| Dinutuximab_LightChain1 | 211 | 7853, 15495, 23137, 30779, 38421, 46063, 53705 |
| Dinutuximab_LightChain | 212 | 7854, 15496, 23138, 30780, 38422, 46064, 53706 |
| Diridavumab_HeavyChain1 | 213 | 7855, 15497, 23139, 30781, 38423, 46065, 53707 |
| Diridavumab_LightChain1 | 214 | 7856, 15498, 23140, 30782, 38424, 46066, 53708 |
| Domagrozumab_HeavyChain1 | 215 | 7857, 15499, 23141, 30783, 38425, 46067, 53709 |
| Domagrozumab_HeavyChain | 216 | 7858, 15500, 23142, 30784, 38426, 46068, 53710 |
| Domagrozumab_LightChain1 | 217 | 7859, 15501, 23143, 30785, 38427, 46069, 53711 |
| Drozituab_HeavyChain1 | 218 | 7860, 15502, 23144, 30786, 38428, 46070, 53712 |
| Drozituab_LightChain1 | 219 | 7861, 15503, 23145, 30787, 38429, 46071, 53713 |
| Drozitumab_HeavyChain1 | 220 | 7862, 15504, 23146, 30788, 38430, 46072, 53714 |
| Drozitumab_LightChain1 | 221 | 7863, 15505, 23147, 30789, 38431, 46073, 53715 |
| Duligotuab_HeavyChain1 | 222 | 7864, 15506, 23148, 30790, 38432, 46074, 53716 |
| Duligotumab_LightChain1 | 223 | 7865, 15507, 23149, 30791, 38433, 46075, 53717 |
| Duligotuzumab_HeavyChain1 | 224 | 7866, 15508, 23150, 30792, 38434, 46076, 53718 |
| Duligotuzumab_LightChain1 | 225 | 7867, 15509, 23151, 30793, 38435, 46077, 53719 |
| Dupilumab_HeavyChain1 | 226 | 7868, 15510, 23152, 30794, 38436, 46078, 53720 |
| Dupilumab_LightChain1 | 227 | 7869, 15511, 23153, 30795, 38437, 46079, 53721 |

TABLE 3-continued

RNA and amino acid sequences of exemplified antibodies

| Name | Protein SEQ ID NO | RNA SEQ ID NO |
|---|---|---|
| Durvalumab_HeavyChain1 | 228 | 7870, 15512, 23154, 30796, 38438, 46080, 53722 |
| Durvalumab_LightChain1 | 229 | 7871, 15513, 23155, 30797, 38439, 46081, 53723 |
| Dusigitumab_HeavyChain1 | 230 | 7872, 15514, 23156, 30798, 38440, 46082, 53724 |
| Dusigitumab_LightChain1 | 231 | 7873, 15515, 23157, 30799, 38441, 46083, 53725 |
| Ecromeximab_HeavyChain1 | 232 | 7874, 15516, 23158, 30800, 38442, 46084, 53726 |
| Ecromeximab_LightChain1 | 233 | 7875, 15517, 23159, 30801, 38443, 46085, 53727 |
| Eculizumab_HeavyChain1 | 234 | 7876, 15518, 23160, 30802, 38444, 46086, 53728 |
| Eculizumab_LightChain1 | 235 | 7877, 15519, 23161, 30803, 38445, 46087, 53729 |
| Efalizumab_HeavyChain | 236 | 7878, 15520, 23162, 30804, 38446, 46088, 53730 |
| Efalizumab_LightChain | 237 | 7879, 15521, 23163, 30805, 38447, 46089, 53731 |
| Efungumab_SingleChain_variable_fragment | 238 | 7880, 15522, 23164, 30806, 38448, 46090, 53732 |
| Eldelumab_HeavyChain1 | 239 | 7881, 15523, 23165, 30807, 38449, 46091, 53733 |
| Eldelumab_LightChain1 | 240 | 7882, 15524, 23166, 30808, 38450, 46092, 53734 |
| Elgemtumab_HeavyChain1 | 241 | 7883, 15525, 23167, 30809, 38451, 46093, 53735 |
| Elgemtumab_LightChain1 | 242 | 7884, 15526, 23168, 30810, 38452, 46094, 53736 |
| Elotuzumab_HeavyChain1 | 243 | 7885, 15527, 23169, 30811, 38453, 46095, 53737 |
| Elotuzumab_LightChain1 | 244 | 7886, 15528, 23170, 30812, 38454, 46096, 53738 |
| Emactuzumab_HeavyChain1 | 245 | 7887, 15529, 23171, 30813, 38455, 46097, 53739 |
| Emactuzumab_LightChain1 | 246 | 7888, 15530, 23172, 30814, 38456, 46098, 53740 |
| Emibetuzumab_HeavyChain1 | 247 | 7889, 15531, 23173, 30815, 38457, 46099, 53741 |
| Emibetuzumab_LightChain1 | 248 | 7890, 15532, 23174, 30816, 38458, 46100, 53742 |
| Emicizumab_HeavyChain1 | 249 | 7891, 15533, 23175, 30817, 38459, 46101, 53743 |
| Emicizumab_HeavyChain2 | 250 | 7892, 15534, 23176, 30818, 38460, 46102, 53744 |
| Emicizumab_LightChain1 | 251 | 7893, 15535, 23177, 30819, 38461, 46103, 53745 |
| Enavatuzumab_HeavyChain1 | 252 | 7894, 15536, 23178, 30820, 38462, 46104, 53746 |
| Enavatuzumab_LightChain1 | 253 | 7895, 15537, 23179, 30821, 38463, 46105, 53747 |
| Enfortumab_HeavyChain | 254 | 7896, 15538, 23180, 30822, 38464, 46106, 53748 |
| Enfortumab_LightChain | 255 | 7897, 15539, 23181, 30823, 38465, 46107, 53749 |
| Enfortumab_vedotin_HeavyChain1 | 256 | 7898, 15540, 23182, 30824, 38466, 46108, 53750 |
| Enfortumab_vedotin_LightChain1 | 257 | 7899, 15541, 23183, 30825, 38467, 46109, 53751 |
| Enoblituzumab_HeavyChain | 258 | 7900, 15542, 23184, 30826, 38468, 46110, 53752 |
| Enoblituzumab_LightChain | 259 | 7901, 15543, 23185, 30827, 38469, 46111, 53753 |
| Enokizumab_HeavyChain1 | 260 | 7902, 15544, 23186, 30828, 38470, 46112, 53754 |
| Enokizumab_LightChain1 | 261 | 7903, 15545, 23187, 30829, 38471, 46113, 53755 |
| Enokizumab_LightChain | 262 | 7904, 15546, 23188, 30830, 38472, 46114, 53756 |
| Enoticumab_HeavyChain1 | 263 | 7905, 15547, 23189, 30831, 38473, 46115, 53757 |
| Enoticumab_LightChain1 | 264 | 7906, 15548, 23190, 30832, 38474, 46116, 53758 |
| Ensituximab_HeavyChain1 | 265 | 7907, 15549, 23191, 30833, 38475, 46117, 53759 |
| Ensituximab_LightChain1 | 266 | 7908, 15550, 23192, 30834, 38476, 46118, 53760 |
| Ensituximab_SingleChain_variable_fragment | 267 | 7909, 15551, 23193, 30835, 38477, 46119, 53761 |
| Entolimod_Chain1 | 268 | 7910, 15552, 23194, 30836, 38478, 46120, 53762 |
| Epratuzumab_HeavyChain | 269 | 7911, 15553, 23195, 30837, 38479, 46121, 53763 |
| Epratuzumab_LightChain | 270 | 7912, 15554, 23196, 30838, 38480, 46122, 53764 |
| Eptacog_beta_HeavyChain1 | 271 | 7913, 15555, 23197, 30839, 38481, 46123, 53765 |
| Eptacog_beta_LightChain1 | 272 | 7914, 15556, 23198, 30840, 38482, 46124, 53766 |
| Erlizuab_HeavyChain1 | 273 | 7915, 15557, 23199, 30841, 38483, 46125, 53767 |
| Erlizuab_LightChain1 | 274 | 7916, 15558, 23200, 30842, 38484, 46126, 53768 |
| Etaracizumab_HeavyChain1 | 275 | 7917, 15559, 23201, 30843, 38485, 46127, 53769 |
| Etaracizumab_LightChain1 | 276 | 7918, 15560, 23202, 30844, 38486, 46128, 53770 |
| Etrolizumab_HeavyChain1 | 277 | 7919, 15561, 23203, 30845, 38487, 46129, 53771 |
| Etrolizumab_HeavyChain2 | 278 | 7920, 15562, 23204, 30846, 38488, 46130, 53772 |
| Etrolizumab_LightChain1 | 279 | 7921, 15563, 23205, 30847, 38489, 46131, 53773 |
| Etrolizumab_HeavyChain1 | 280 | 7922, 15564, 23206, 30848, 38490, 46132, 53774 |
| Etrolizumab_LightChain1 | 281 | 7923, 15565, 23207, 30849, 38491, 46133, 53775 |
| Evinacumab_HeavyChain1 | 282 | 7924, 15566, 23208, 30850, 38492, 46134, 53776 |
| Evinacumab_LightChain1 | 283 | 7925, 15567, 23209, 30851, 38493, 46135, 53777 |
| Evolocumab_HeavyChain1 | 284 | 7926, 15568, 23210, 30852, 38494, 46136, 53778 |
| Evolocumab_LightChain1 | 285 | 7927, 15569, 23211, 30853, 38495, 46137, 53779 |
| Exbivirumab_HeavyChain1 | 286 | 7928, 15570, 23212, 30854, 38496, 46138, 53780 |
| Exbivirumab_LightChain1 | 287 | 7929, 15571, 23213, 30855, 38497, 46139, 53781 |
| Farletuzumab_HeavyChain1 | 288 | 7930, 15572, 23214, 30856, 38498, 46140, 53782 |
| Farletuzumab_LightChain1 | 289 | 7931, 15573, 23215, 30857, 38499, 46141, 53783 |
| Fasinumab_HeavyChain1 | 290 | 7932, 15574, 23216, 30858, 38500, 46142, 53784 |
| Fasinumab_LightChain1 | 291 | 7933, 15575, 23217, 30859, 38501, 46143, 53785 |
| Fezakinumab_HeavyChain1 | 292 | 7934, 15576, 23218, 30860, 38502, 46144, 53786 |
| Fezakinumab_LightChain1 | 293 | 7935, 15577, 23219, 30861, 38503, 46145, 53787 |
| FG-3019_HeavyChain1 | 294 | 7936, 15578, 23220, 30862, 38504, 46146, 53788 |
| FG-3019_LightChain1 | 295 | 7937, 15579, 23221, 30863, 38505, 46147, 53789 |
| Fibatuzumab_HeavyChain1 | 296 | 7938, 15580, 23222, 30864, 38506, 46148, 53790 |
| Fibatuzumab_LightChain1 | 297 | 7939, 15581, 23223, 30865, 38507, 46149, 53791 |
| Ficlatuzumab_HeavyChain1 | 298 | 7940, 15582, 23224, 30866, 38508, 46150, 53792 |
| Ficlatuzumab_HeavyChain | 299 | 7941, 15583, 23225, 30867, 38509, 46151, 53793 |
| Ficlatuzumab_LightChain1 | 300 | 7942, 15584, 23226, 30868, 38510, 46152, 53794 |
| Figitumumab_HeavyChain1 | 301 | 7943, 15585, 23227, 30869, 38511, 46153, 53795 |
| Figitumumab_LightChain1 | 302 | 7944, 15586, 23228, 30870, 38512, 46154, 53796 |
| Firivumab_HeavyChain1 | 303 | 7945, 15587, 23229, 30871, 38513, 46155, 53797 |

TABLE 3-continued

RNA and amino acid sequences of exemplified antibodies

| Name | Protein SEQ ID NO | RNA SEQ ID NO |
| --- | --- | --- |
| Firivumab__LightChain1 | 304 | 7946, 15588, 23230, 30872, 38514, 46156, 53798 |
| Flanvotumab__HeavyChain1 | 305 | 7947, 15589, 23231, 30873, 38515, 46157, 53799 |
| Flanvotumab__LightChain1 | 306 | 7948, 15590, 23232, 30874, 38516, 46158, 53800 |
| Fletikumab__HeavyChain1 | 307 | 7949, 15591, 23233, 30875, 38517, 46159, 53801 |
| Fletikumab__LightChain1 | 308 | 7950, 15592, 23234, 30876, 38518, 46160, 53802 |
| Fontolizumab__HeavyChain1 | 309 | 7951, 15593, 23235, 30877, 38519, 46161, 53803 |
| Fontolizumab__LightChain1 | 310 | 7952, 15594, 23236, 30878, 38520, 46162, 53804 |
| Foralumab__HeavyChain1 | 311 | 7953, 15595, 23237, 30879, 38521, 46163, 53805 |
| Foralumab__LightChain1 | 312 | 7954, 15596, 23238, 30880, 38522, 46164, 53806 |
| Foravirumab__HeavyChain1 | 313 | 7955, 15597, 23239, 30881, 38523, 46165, 53807 |
| Foravirumab__HeavyChain | 314 | 7956, 15598, 23240, 30882, 38524, 46166, 53808 |
| Foravirumab__LightChain1 | 315 | 7957, 15599, 23241, 30883, 38525, 46167, 53809 |
| Fresolimumab__HeavyChain1 | 316 | 7958, 15600, 23242, 30884, 38526, 46168, 53810 |
| Fresolimumab__LightChain1 | 317 | 7959, 15601, 23243, 30885, 38527, 46169, 53811 |
| Fulranumab__HeavyChain1 | 318 | 7960, 15602, 23244, 30886, 38528, 46170, 53812 |
| Fulranumab__LightChain1 | 319 | 7961, 15603, 23245, 30887, 38529, 46171, 53813 |
| Futuximab__HeavyChain1 | 320 | 7962, 15604, 23246, 30888, 38530, 46172, 53814 |
| Futuximab__LightChain1 | 321 | 7963, 15605, 23247, 30889, 38531, 46173, 53815 |
| Galcanezumab__HeavyChain1 | 322 | 7964, 15606, 23248, 30890, 38532, 46174, 53816 |
| Galcanezumab__LightChain1 | 323 | 7965, 15607, 23249, 30891, 38533, 46175, 53817 |
| Galiximab__HeavyChain1 | 324 | 7966, 15608, 23250, 30892, 38534, 46176, 53818 |
| Galiximab__LightChain1 | 325 | 7967, 15609, 23251, 30893, 38535, 46177, 53819 |
| Ganitumab__HeavyChain1 | 326 | 7968, 15610, 23252, 30894, 38536, 46178, 53820 |
| Ganitumab__LightChain1 | 327 | 7969, 15611, 23253, 30895, 38537, 46179, 53821 |
| Gantenerumab__HeavyChain1 | 328 | 7970, 15612, 23254, 30896, 38538, 46180, 53822 |
| Gantenerumab__LightChain1 | 329 | 7971, 15613, 23255, 30897, 38539, 46181, 53823 |
| Gemtuzumab__HeavyChain1 | 330 | 7972, 15614, 23256, 30898, 38540, 46182, 53824 |
| Gemtuzumab__HeavyChain2 | 331 | 7973, 15615, 23257, 30899, 38541, 46183, 53825 |
| Gemtuzumab__LightChain2 | 332 | 7974, 15616, 23258, 30900, 38542, 46184, 53826 |
| Gemtuzumab_ozogamicin__LightChain1 | 333 | 7975, 15617, 23259, 30901, 38543, 46185, 53827 |
| Gevokizumab__HeavyChain1 | 334 | 7976, 15618, 23260, 30902, 38544, 46186, 53828 |
| Gevokizumab__LightChain1 | 335 | 7977, 15619, 23261, 30903, 38545, 46187, 53829 |
| Girentuximab__HeavyChain1 | 336 | 7978, 15620, 23262, 30904, 38546, 46188, 53830 |
| Girentuximab__LightChain1 | 337 | 7979, 15621, 23263, 30905, 38547, 46189, 53831 |
| Glembatumumab__HeavyChain1 | 338 | 7980, 15622, 23264, 30906, 38548, 46190, 53832 |
| Glembatumumab__LightChain1 | 339 | 7981, 15623, 23265, 30907, 38549, 46191, 53833 |
| Goilixiab__HeavyChain1 | 340 | 7982, 15624, 23266, 30908, 38550, 46192, 53834 |
| Goilixiab__LightChain1 | 341 | 7983, 15625, 23267, 30909, 38551, 46193, 53835 |
| Guselkumab__HeavyChain1 | 342 | 7984, 15626, 23268, 30910, 38552, 46194, 53836 |
| Guselkumab__LightChain1 | 343 | 7985, 15627, 23269, 30911, 38553, 46195, 53837 |
| HuMab-001__HeavyChain__VDJ-Region | 344 | 7986, 15628, 23270, 30912, 38554, 46196, 53838 |
| HuMab-001__LightChain__VJ-Region | 345 | 7987, 15629, 23271, 30913, 38555, 46197, 53839 |
| HuMab-005__HeavyChain__gamma-Chain__VDJ-Region | 346 | 7988, 15630, 23272, 30914, 38556, 46198, 53840 |
| HuMab-005__LightChain__VJ-Region | 347 | 7989, 15631, 23273, 30915, 38557, 46199, 53841 |
| HuMab-006__HeavyChain__VDJ-Region | 348 | 7990, 15632, 23274, 30916, 38558, 46200, 53842 |
| HuMab-006__LightChain__VJ-Region | 349 | 7991, 15633, 23275, 30917, 38559, 46201, 53843 |
| HuMab-019__HeavyChain__VDJ-Region | 350 | 7992, 15634, 23276, 30918, 38560, 46202, 53844 |
| HuMab-021__HeavyChain__VDJ-Region | 351 | 7993, 15635, 23277, 30919, 38561, 46203, 53845 |
| HuMab-021__LightChain__VJ-Region | 352 | 7994, 15636, 23278, 30920, 38562, 46204, 53846 |
| HuMab-025__HeavyChain__VDJ-Region | 353 | 7995, 15637, 23279, 30921, 38563, 46205, 53847 |
| HuMab-025__LightChain__VJ-Region | 354 | 7996, 15638, 23280, 30922, 38564, 46206, 53848 |
| HuMab-027__HeavyChain__VDJ-Region | 355 | 7997, 15639, 23281, 30923, 38565, 46207, 53849 |
| HuMab-032__HeavyChain__VDJ-Region | 356 | 7998, 15640, 23282, 30924, 38566, 46208, 53850 |
| HuMab-032__LightChain__VJ-Region | 357 | 7999, 15641, 23283, 30925, 38567, 46209, 53851 |
| HuMab-033__HeavyChain__VDJ-Region | 358 | 8000, 15642, 23284, 30926, 38568, 46210, 53852 |
| HuMab-035__HeavyChain__VDJ-Region | 359 | 8001, 15643, 23285, 30927, 38569, 46211, 53853 |
| HuMab-036__HeavyChain__VDJ-Region | 360 | 8002, 15644, 23286, 30928, 38570, 46212, 53854 |
| HuMab-036__LightChain__VJ-Region | 361 | 8003, 15645, 23287, 30929, 38571, 46213, 53855 |
| HuMab-041__HeavyChain__VDJ-Region | 362 | 8004, 15646, 23288, 30930, 38572, 46214, 53856 |
| HuMab-044__HeavyChain__VDJ-Region | 363 | 8005, 15647, 23289, 30931, 38573, 46215, 53857 |
| HuMab-049__HeavyChain__VDJ-Region | 364 | 8006, 15648, 23290, 30932, 38574, 46216, 53858 |
| HuMab-049__LightChain__VJ-Region | 365 | 8007, 15649, 23291, 30933, 38575, 46217, 53859 |
| HuMab-050__HeavyChain__VDJ-Region | 366 | 8008, 15650, 23292, 30934, 38576, 46218, 53860 |
| HuMab-050__LightChain__VJ-Region | 367 | 8009, 15651, 23293, 30935, 38577, 46219, 53861 |
| HuMab-054__HeavyChain__VDJ-Region | 368 | 8010, 15652, 23294, 30936, 38578, 46220, 53862 |
| HuMab-054__LightChain__VJ-Region | 369 | 8011, 15653, 23295, 30937, 38579, 46221, 53863 |
| HuMab-055__HeavyChain__VDJ-Region | 370 | 8012, 15654, 23296, 30938, 38580, 46222, 53864 |
| HuMab-059__HeavyChain__VDJ-Region | 371 | 8013, 15655, 23297, 30939, 38581, 46223, 53865 |
| HuMab-059__LightChain__VJ-Region | 372 | 8014, 15656, 23298, 30940, 38582, 46224, 53866 |
| HuMab-060__HeavyChain__VDJ-Region | 373 | 8015, 15657, 23299, 30941, 38583, 46225, 53867 |
| HuMab-060__LightChain__VJ-Region | 374 | 8016, 15658, 23300, 30942, 38584, 46226, 53868 |
| HuMab-067__HeavyChain__VDJ-Region | 375 | 8017, 15659, 23301, 30943, 38585, 46227, 53869 |
| HuMab-072__HeavyChain__VDJ-Region | 376 | 8018, 15660, 23302, 30944, 38586, 46228, 53870 |
| HuMab-072__LightChain__VJ-Region | 377 | 8019, 15661, 23303, 30945, 38587, 46229, 53871 |
| HuMab-084__HeavyChain__VDJ-Region | 378 | 8020, 15662, 23304, 30946, 38588, 46230, 53872 |
| HuMab-084__LightChain__VJ-Region | 379 | 8021, 15663, 23305, 30947, 38589, 46231, 53873 |

TABLE 3-continued

RNA and amino acid sequences of exemplified antibodies

| Name | Protein SEQ ID NO | RNA SEQ ID NO |
| --- | --- | --- |
| HuMab-091_HeavyChain_VDJ-Region | 380 | 8022, 15664, 23306, 30948, 38590, 46232, 53874 |
| HuMab-091_LightChain_VJ-Region | 381 | 8023, 15665, 23307, 30949, 38591, 46233, 53875 |
| HuMab-093_HeavyChain_VDJ-Region | 382 | 8024, 15666, 23308, 30950, 38592, 46234, 53876 |
| HuMab-098_HeavyChain_VDJ-Region | 383 | 8025, 15667, 23309, 30951, 38593, 46235, 53877 |
| HuMab-098_LightChain_VJ-Region | 384 | 8026, 15668, 23310, 30952, 38594, 46236, 53878 |
| HuMab-100_HeavyChain_VDJ-Region | 385 | 8027, 15669, 23311, 30953, 38595, 46237, 53879 |
| HuMab-106_HeavyChain_VDJ-Region | 386 | 8028, 15670, 23312, 30954, 38596, 46238, 53880 |
| HuMab-106_LightChain_VJ-Region | 387 | 8029, 15671, 23313, 30955, 38597, 46239, 53881 |
| HuMab_10F8_HeavyChain_V-Region | 388 | 8030, 15672, 23314, 30956, 38598, 46240, 53882 |
| HuMab_10F8_HeavyChain_V-Region_Precursor | 389 | 8031, 15673, 23315, 30957, 38599, 46241, 53883 |
| HuMab_10F8_LightChain_V-Region | 390 | 8032, 15674, 23316, 30958, 38600, 46242, 53884 |
| HuMab_10F8_LightChain_V-Region_Precursor | 391 | 8033, 15675, 23317, 30959, 38601, 46243, 53885 |
| HuMab-111_HeavyChain_VDJ-Region | 392 | 8034, 15676, 23318, 30960, 38602, 46244, 53886 |
| HuMab-111_LightChain_VJ-Region | 393 | 8035, 15677, 23319, 30961, 38603, 46245, 53887 |
| HuMab-123_HeavyChain_VDJ-Region | 394 | 8036, 15678, 23320, 30962, 38604, 46246, 53888 |
| HuMab-123_LightChain_VJ-Region | 395 | 8037, 15679, 23321, 30963, 38605, 46247, 53889 |
| HuMab-124_HeavyChain_VDJ-Region | 396 | 8038, 15680, 23322, 30964, 38606, 46248, 53890 |
| HuMab-125_HeavyChain_VDJ-Region | 397 | 8039, 15681, 23323, 30965, 38607, 46249, 53891 |
| HuMab-125_LightChain_VJ-Region | 398 | 8040, 15682, 23324, 30966, 38608, 46250, 53892 |
| HuMab-127_HeavyChain_VDJ-Region | 399 | 8041, 15683, 23325, 30967, 38609, 46251, 53893 |
| HuMab-127_LightChain_VJ-Region | 400 | 8042, 15684, 23326, 30968, 38610, 46252, 53894 |
| HuMab-129_HeavyChain_VDJ-Region | 401 | 8043, 15685, 23327, 30969, 38611, 46253, 53895 |
| HuMab-129_LightChain_VJ-Region | 402 | 8044, 15686, 23328, 30970, 38612, 46254, 53896 |
| HuMab-132_HeavyChain_VDJ-Region | 403 | 8045, 15687, 23329, 30971, 38613, 46255, 53897 |
| HuMab-132_LightChain_VJ-Region | 404 | 8046, 15688, 23330, 30972, 38614, 46256, 53898 |
| HuMab-143_HeavyChain_VDJ-Region | 405 | 8047, 15689, 23331, 30973, 38615, 46257, 53899 |
| HuMab-143_LightChain_VJ-Region | 406 | 8048, 15690, 23332, 30974, 38616, 46258, 53900 |
| HuMab-150_HeavyChain_VDJ-Region | 407 | 8049, 15691, 23333, 30975, 38617, 46259, 53901 |
| HuMab-150_LightChain_VJ-Region | 408 | 8050, 15692, 23334, 30976, 38618, 46260, 53902 |
| HuMab-152_HeavyChain_VDJ-Region | 409 | 8051, 15693, 23335, 30977, 38619, 46261, 53903 |
| HuMab-152_LightChain_VJ-Region | 410 | 8052, 15694, 23336, 30978, 38620, 46262, 53904 |
| HuMab-153_HeavyChain_VDJ-Region | 411 | 8053, 15695, 23337, 30979, 38621, 46263, 53905 |
| HuMab-153_LightChain_VJ-Region | 412 | 8054, 15696, 23338, 30980, 38622, 46264, 53906 |
| HuMab-159_HeavyChain_VDJ-Region | 413 | 8055, 15697, 23339, 30981, 38623, 46265, 53907 |
| HuMab-159_LightChain_VJ-Region | 414 | 8056, 15698, 23340, 30982, 38624, 46266, 53908 |
| HuMab-160_HeavyChain_VDJ-Region | 415 | 8057, 15699, 23341, 30983, 38625, 46267, 53909 |
| HuMab-160_LightChain_VJ-Region | 416 | 8058, 15700, 23342, 30984, 38626, 46268, 53910 |
| HuMab-162_HeavyChain_VDJ-Region | 417 | 8059, 15701, 23343, 30985, 38627, 46269, 53911 |
| HuMab-162_LightChain_VJ-Region | 418 | 8060, 15702, 23344, 30986, 38628, 46270, 53912 |
| HuMab-163_HeavyChain_VDJ-Region | 419 | 8061, 15703, 23345, 30987, 38629, 46271, 53913 |
| HuMab-163_LightChain_VJ-Region | 420 | 8062, 15704, 23346, 30988, 38630, 46272, 53914 |
| HuMab-166_HeavyChain_VDJ-Region | 421 | 8063, 15705, 23347, 30989, 38631, 46273, 53915 |
| HuMab-166_LightChain_VJ-Region | 422 | 8064, 15706, 23348, 30990, 38632, 46274, 53916 |
| HuMab-167_HeavyChain_VDJ-Region | 423 | 8065, 15707, 23349, 30991, 38633, 46275, 53917 |
| HuMab-169_HeavyChain_VDJ-Region | 424 | 8066, 15708, 23350, 30992, 38634, 46276, 53918 |
| HuMab-169_LightChain_VJ-Region | 425 | 8067, 15709, 23351, 30993, 38635, 46277, 53919 |
| HuMab-708_HeavyChain_VH-Region | 426 | 8068, 15710, 23352, 30994, 38636, 46278, 53920 |
| HuMab-708_HeavyChain_V-Region | 427 | 8069, 15711, 23353, 30995, 38637, 46279, 53921 |
| HuMab-708_LightChain_VL-Region | 428 | 8070, 15712, 23354, 30996, 38638, 46280, 53922 |
| HuMab-708_LightChain_V-Region | 429 | 8071, 15713, 23355, 30997, 38639, 46281, 53923 |
| huMAb-anti-MSP10.1_LightChain_VJ-Region | 430 | 8072, 15714, 23356, 30998, 38640, 46282, 53924 |
| huMAb-anti-MSP10.2_LightChain_VJ-Region | 431 | 8073, 15715, 23357, 30999, 38641, 46283, 53925 |
| HUMAB-Clone_18_VJ-Region | 432 | 8074, 15716, 23358, 31000, 38642, 46284, 53926 |
| HUMAB-Clone_22_VJ-Region | 433 | 8075, 15717, 23359, 31001, 38643, 46285, 53927 |
| HuMab-L612_μChain_VDJ-Region_Precursor | 434 | 8076, 15718, 23360, 31002, 38644, 46286, 53928 |
| HuMab_LC5002-002_LightChain_V-Region | 435 | 8077, 15719, 23361, 31003, 38645, 46287, 53929 |
| HuMab_LC5002-002_gamma1-Chain_V-Region | 436 | 8078, 15720, 23362, 31004, 38646, 46288, 53930 |
| HuMab_LC5002-003_LightChain_V-Region | 437 | 8079, 15721, 23363, 31005, 38647, 46289, 53931 |
| HuMab_LC5002-003_gamma1-Chain_V-Region | 438 | 8080, 15722, 23364, 31006, 38648, 46290, 53932 |
| HuMab_LC5002-005_LightChain_V-Region | 439 | 8081, 15723, 23365, 31007, 38649, 46291, 53933 |
| HuMab_LC5002-005_gamma1-Chain_V-Region | 440 | 8082, 15724, 23366, 31008, 38650, 46292, 53934 |
| HuMab_LC5002-007_LightChain_V-Region | 441 | 8083, 15725, 23367, 31009, 38651, 46293, 53935 |
| HuMab_LC5002-007_gamma1-Chain_V-Region | 442 | 8084, 15726, 23368, 31010, 38652, 46294, 53936 |
| HuMab_LC5002-018_gamma1-Chain_V-Region | 443 | 8085, 15727, 23369, 31011, 38653, 46295, 53937 |
| Ibalizumab_HeavyChain1 | 444 | 8086, 15728, 23370, 31012, 38654, 46296, 53938 |
| Ibalizumab_LightChain1 | 445 | 8087, 15729, 23371, 31013, 38655, 46297, 53939 |
| Ibritumomab_tiuxetan_HeavyChain | 446 | 8088, 15730, 23372, 31014, 38656, 46298, 53940 |
| Ibritumomab_tiuxetan_LightChain | 447 | 8089, 15731, 23373, 31015, 38657, 46299, 53941 |
| Icrucumab_HeavyChain1 | 448 | 8090, 15732, 23374, 31016, 38658, 46300, 53942 |
| Icrucumab_LightChain1 | 449 | 8091, 15733, 23375, 31017, 38659, 46301, 53943 |
| Idarucizumab_HeavyChain1 | 450 | 8092, 15734, 23376, 31018, 38660, 46302, 53944 |
| Idarucizumab_LightChain1 | 451 | 8093, 15735, 23377, 31019, 38661, 46303, 53945 |
| Igatuzuab_HeavyChain1 | 452 | 8094, 15736, 23378, 31020, 38662, 46304, 53946 |
| Igatuzuab_LightChain1 | 453 | 8095, 15737, 23379, 31021, 38663, 46305, 53947 |
| IGF-IR_HUMAB-1A_HeavyChain | 454 | 8096, 15738, 23380, 31022, 38664, 46306, 53948 |
| IGF-IR_HUMAB-23_HeavyChain | 455 | 8097, 15739, 23381, 31023, 38665, 46307, 53949 |

TABLE 3-continued

RNA and amino acid sequences of exemplified antibodies

| Name | Protein SEQ ID NO | RNA SEQ ID NO |
| --- | --- | --- |
| IGF-IR_HUMAB-23_LightChain | 456 | 8098, 15740, 23382, 31024, 38666, 46308, 53950 |
| IGF-IR_HUMAB-8_HeavyChain | 457 | 8099, 15741, 23383, 31025, 38667, 46309, 53951 |
| IGF-IR_HUMAB-8_LightChain | 458 | 8100, 15742, 23384, 31026, 38668, 46310, 53952 |
| ImAb1_LightChain | 459 | 8101, 15743, 23385, 31027, 38669, 46311, 53953 |
| ImAb1_gamma1-Chain | 460 | 8102, 15744, 23386, 31028, 38670, 46312, 53954 |
| Imalumab_HeavyChain1 | 461 | 8103, 15745, 23387, 31029, 38671, 46313, 53955 |
| Imalumab_LightChain1 | 462 | 8104, 15746, 23388, 31030, 38672, 46314, 53956 |
| Imgatuzumab_HeavyChain1 | 463 | 8105, 15747, 23389, 31031, 38673, 46315, 53957 |
| Imgatuzumab_LightChain1 | 464 | 8106, 15748, 23390, 31032, 38674, 46316, 53958 |
| Inclacumab_HeavyChain1 | 465 | 8107, 15749, 23391, 31033, 38675, 46317, 53959 |
| Inclacumab_LightChain1 | 466 | 8108, 15750, 23392, 31034, 38676, 46318, 53960 |
| Indatuximab_ravtansine_HeavyChain1 | 467 | 8109, 15751, 23393, 31035, 38677, 46319, 53961 |
| Indatuximab_ravtansine_LightChain1 | 468 | 8110, 15752, 23394, 31036, 38678, 46320, 53962 |
| Indusatumab_vedotin_HeavyChain1 | 469 | 8111, 15753, 23395, 31037, 38679, 46321, 53963 |
| Indusatumab_vedotin_LightChain1 | 470 | 8112, 15754, 23396, 31038, 38680, 46322, 53964 |
| Inebilizumab_HeavyChain1 | 471 | 8113, 15755, 23397, 31039, 38681, 46323, 53965 |
| Inebilizumab_LightChain1 | 472 | 8114, 15756, 23398, 31040, 38682, 46324, 53966 |
| Insulin_peglispro_Fragment1 | 473 | 8115, 15757, 23399, 31041, 38683, 46325, 53967 |
| Insulin_peglispro_Fragment2 | 474 | 8116, 15758, 23400, 31042, 38684, 46326, 53968 |
| Interferon_beta-1b_chain1 | 475 | 8117, 15759, 23401, 31043, 38685, 46327, 53969 |
| Intetumumab_HeavyChain1 | 476 | 8118, 15760, 23402, 31044, 38686, 46328, 53970 |
| Intetumumab_LightChain1 | 477 | 8119, 15761, 23403, 31045, 38687, 46329, 53971 |
| Iodine_(1241)_Girentuximab_HeavyChain1 | 478 | 8120, 15762, 23404, 31046, 38688, 46330, 53972 |
| Iodine_(1241)_Girentuximab_LightChain1 | 479 | 8121, 15763, 23405, 31047, 38689, 46331, 53973 |
| Iodine_(1311)_Derlotuxiab_biotin_HeavyChain1 | 480 | 8122, 15764, 23406, 31048, 38690, 46332, 53974 |
| Iodine_(1311)_Derlotuxiab_biotin_LightChain1 | 481 | 8123, 15765, 23407, 31049, 38691, 46333, 53975 |
| Iodine_(1311)_Derlotuximab_biotin_HeavyChain1 | 482 | 8124, 15766, 23408, 31050, 38692, 46334, 53976 |
| Iodine_(1311)_Derlotuximab_biotin_LightChain1 | 483 | 8125, 15767, 23409, 31051, 38693, 46335, 53977 |
| Ipilimumab_HeavyChain | 484 | 8126, 15768, 23410, 31052, 38694, 46336, 53978 |
| Ipilimumab_LightChain | 485 | 8127, 15769, 23411, 31053, 38695, 46337, 53979 |
| Iratumumab_HeavyChain1 | 486 | 8128, 15770, 23412, 31054, 38696, 46338, 53980 |
| Iratumumab_LightChain1 | 487 | 8129, 15771, 23413, 31055, 38697, 46339, 53981 |
| Isatuximab_HeavyChain1 | 488 | 8130, 15772, 23414, 31056, 38698, 46340, 53982 |
| Isatuximab_LightChain1 | 489 | 8131, 15773, 23415, 31057, 38699, 46341, 53983 |
| Itolizumab_HeavyChain1 | 490 | 8132, 15774, 23416, 31058, 38700, 46342, 53984 |
| Itolizumab_LightChain1 | 491 | 8133, 15775, 23417, 31059, 38701, 46343, 53985 |
| Ixekizumab_HeavyChain1 | 492 | 8134, 15776, 23418, 31060, 38702, 46344, 53986 |
| Ixekizumab_LightChain1 | 493 | 8135, 15777, 23419, 31061, 38703, 46345, 53987 |
| Labetuzumab_govitecan_HeavyChain1 | 494 | 8136, 15778, 23420, 31062, 38704, 46346, 53988 |
| Labetuzumab_govitecan_LightChain1 | 495 | 8137, 15779, 23421, 31063, 38705, 46347, 53989 |
| Lambrolizumab_HeavyChain1 | 496 | 8138, 15780, 23422, 31064, 38706, 46348, 53990 |
| Lambrolizumab_LightChain1 | 497 | 8139, 15781, 23423, 31065, 38707, 46349, 53991 |
| Lampalizumab_HeavyChain1 | 498 | 8140, 15782, 23424, 31066, 38708, 46350, 53992 |
| Lampalizumab_LightChain1 | 499 | 8141, 15783, 23425, 31067, 38709, 46351, 53993 |
| Lanadelumab_HeavyChain1 | 500 | 8142, 15784, 23426, 31068, 38710, 46352, 53994 |
| Lanadelumab_LightChain1 | 501 | 8143, 15785, 23427, 31069, 38711, 46353, 53995 |
| Landogrozumab_HeavyChain1 | 502 | 8144, 15786, 23428, 31070, 38712, 46354, 53996 |
| Landogrozumab_LightChain1 | 503 | 8145, 15787, 23429, 31071, 38713, 46355, 53997 |
| Laprituximab_emtansine_HeavyChain1 | 504 | 8146, 15788, 23430, 31072, 38714, 46355, 53998 |
| Laprituximab_emtansine_LightChain1 | 505 | 8147, 15789, 23431, 31073, 38715, 46357, 53999 |
| Lealesoab_HeavyChain1 | 506 | 8148, 15790, 23432, 31074, 38716, 46358, 54000 |
| Lealesoab_LightChain1 | 507 | 8149, 15791, 23433, 31075, 38717, 46359, 54001 |
| Lebrikizumab_HeavyChain1 | 508 | 8150, 15792, 23434, 31076, 38718, 46360, 54002 |
| Lebrikizumab_LightChain1 | 509 | 8151, 15793, 23435, 31077, 38719, 46361, 54003 |
| Lenercept_chain1 | 510 | 8152, 15794, 23436, 31078, 38720, 46362, 54004 |
| Lenzilumab_HeavyChain1 | 511 | 8153, 15795, 23437, 31079, 38721, 46363, 54005 |
| Lenzilumab_LightChain1 | 512 | 8154, 15796, 23438, 31080, 38722, 46364, 54006 |
| Lerdelimumab_HeavyChain1 | 513 | 8155, 15797, 23439, 31081, 38723, 46365, 54007 |
| Lerdelimumab_LightChain1 | 514 | 8156, 15798, 23440, 31082, 38724, 46366, 54008 |
| Lexatumumab_HeavyChain1 | 515 | 8157, 15799, 23441, 31083, 38725, 46367, 54009 |
| Lexatumumab_HeavyChain | 516 | 8158, 15800, 23442, 31084, 38726, 46368, 54010 |
| Lexatumumab_LightChain1 | 517 | 8159, 15801, 23443, 31085, 38727, 46369, 54011 |
| Lexatumumab_LightChain | 518 | 8160, 15802, 23444, 31086, 38728, 46370, 54012 |
| Libivirumab_HeavyChain1 | 519 | 8161, 15803, 23445, 31087, 38729, 46371, 54013 |
| Libivirumab_LightChain1 | 520 | 8162, 15804, 23446, 31088, 38730, 46372, 54014 |
| Lifastuzumab_HeavyChain | 521 | 8163, 15805, 23447, 31089, 38731, 46373, 54015 |
| Lifastuzumab_LightChain | 522 | 8164, 15806, 23448, 31090, 38732, 46374, 54016 |
| Lifastuzumab_vedotin_HeavyChain1 | 523 | 8165, 15807, 23449, 31091, 38733, 46375, 54017 |
| Lifastuzumab_vedotin_LightChain1 | 524 | 8166, 15808, 23450, 31092, 38734, 46376, 54018 |
| Ligelizumab_HeavyChain1 | 525 | 8167, 15809, 23451, 31093, 38735, 46377, 54019 |
| Ligelizumab_LightChain1 | 526 | 8168, 15810, 23452, 31094, 38736, 46378, 54020 |
| Lilotomab_HeavyChain1 | 527 | 8169, 15811, 23453, 31095, 38737, 46379, 54021 |
| Lilotomab_LightChain1 | 528 | 8170, 15812, 23454, 31096, 38738, 46380, 54022 |
| Lintuzumab_HeavyChain1 | 529 | 8171, 15813, 23455, 31097, 38739, 46381, 54023 |
| Lintuzumab_LightChain1 | 530 | 8172, 15814, 23456, 31098, 38740, 46382, 54024 |
| Lirilumab_HeavyChain1 | 531 | 8173, 15815, 23457, 31099, 38741, 46383, 54025 |

TABLE 3-continued

RNA and amino acid sequences of exemplified antibodies

| Name | Protein SEQ ID NO | RNA SEQ ID NO |
|---|---|---|
| Lirilumab__LightChain1 | 532 | 8174, 15816, 23458, 31100, 38742, 46384, 54026 |
| Lodelcizumab__HeavyChain1 | 533 | 8175, 15817, 23459, 31101, 38743, 46385, 54027 |
| Lodelcizumab__LightChain1 | 534 | 8176, 15818, 23460, 31102, 38744, 46386, 54028 |
| Lokivetmab__HeavyChain1 | 535 | 8177, 15819, 23461, 31103, 38745, 46387, 54029 |
| Lokivetmab__LightChain1 | 536 | 8178, 15820, 23462, 31104, 38746, 46388, 54030 |
| Lorvotuzumab__mertansine__HeavyChain1 | 537 | 8179, 15821, 23463, 31105, 38747, 46389, 54031 |
| Lorvotuzumab__mertansine__LightChain1 | 538 | 8180, 15822, 23464, 31106, 38748, 46390, 54032 |
| Lpathomab__VL | 539 | 8181, 15823, 23465, 31107, 38749, 46391, 54033 |
| Lpathomab__gamma1-Chain__VDJ-Region | 540 | 8182, 15824, 23466, 31108, 38750, 46392, 54034 |
| Lucatumumab__HeavyChain1 | 541 | 8183, 15825, 23467, 31109, 38751, 46393, 54035 |
| Lucatumumab__LightChain1 | 542 | 8184, 15826, 23468, 31110, 38752, 46394, 54036 |
| Lulizumab_pegol__LightChain1 | 543 | 8185, 15827, 23469, 31111, 38753, 46395, 54037 |
| Lulizumab_pegol__LightChain | 544 | 8186, 15828, 23470, 31112, 38754, 46396, 54038 |
| Lumiliximab__HeavyChain1 | 545 | 8187, 15829, 23471, 31113, 38755, 46397, 54039 |
| Lumiliximab__LightChain1 | 546 | 8188, 15830, 23472, 31114, 38756, 46398, 54040 |
| Lumretuzumab__HeavyChain1 | 547 | 8189, 15831, 23473, 31115, 38757, 46399, 54041 |
| Lumretuzumab__LightChain1 | 548 | 8190, 15832, 23474, 31116, 38758, 46400, 54042 |
| Lutetium_(177Lu)_lilotomab_satetraxetan__HeavyChain1 | 549 | 8191, 15833, 23475, 31117, 38759, 46401, 54043 |
| Lutetium_(177Lu)_lilotomab_satetraxetan__LightChain1 | 550 | 8192, 15834, 23476, 31118, 38760, 46402, 54044 |
| Margetuximab__HeavyChain1 | 551 | 8193, 15835, 23477, 31119, 38761, 46403, 54045 |
| Margetuximab__LightChain1 | 552 | 8194, 15836, 23478, 31120, 38762, 46404, 54046 |
| Marzeptacog_alfa__HeavyChain1 | 553 | 8195, 15837, 23479, 31121, 38763, 46405, 54047 |
| Marzeptacog_alfa__LightChain1 | 554 | 8196, 15838, 23480, 31122, 38764, 46406, 54048 |
| Matuzumab__HeavyChain1_variant_3c08_H | 555 | 8197, 15839, 23481, 31123, 38765, 46407, 54049 |
| Matuzumab__HeavyChain1_variant_3c09_C | 556 | 8198, 15840, 23482, 31124, 38766, 46408, 54050 |
| Matuzumab__LightChain1_variant_3c08_L | 557 | 8199, 15841, 23483, 31125, 38767, 46409, 54051 |
| Matuzumab__LightChain1_variant_3c09_B | 558 | 8200, 15842, 23484, 31126, 38768, 46410, 54052 |
| Mavrilimumab__HeavyChain1 | 559 | 8201, 15843, 23485, 31127, 38769, 46411, 54053 |
| Mavrilimumab__LightChain1 | 560 | 8202, 15844, 23486, 31128, 38770, 49412, 54054 |
| MDX-1303__HeavyChain1 | 561 | 8203, 15845, 23487, 31129, 38771, 46413, 54055 |
| MDX-1303__LightChain1 | 562 | 8204, 15846, 23488, 31130, 38772, 46414, 54056 |
| Mepolizumab__HeavyChain1 | 563 | 8205, 15847, 23489, 31131, 38773, 46415, 54057 |
| Mepolizumab__LightChain1 | 564 | 8206, 15848, 23490, 31132, 38774, 46416, 54058 |
| Metelimumab__HeavyChain1 | 565 | 8207, 15849, 23491, 31133, 38775, 46417, 54059 |
| Metelimumab__LightChain1 | 566 | 8208, 15850, 23492, 31134, 38776, 46418, 54060 |
| Milatuzumab__HeavyChain1 | 567 | 8209, 15851, 23493, 31135, 38777, 46419, 54061 |
| Milatuzumab__LightChain1 | 568 | 8210, 15852, 23494, 31136, 38778, 46420, 54062 |
| Mirvetuximab__HeavyChain1 | 569 | 8211, 15853, 23495, 31137, 38779, 46421, 54063 |
| Mirvetuximab__LightChain1 | 570 | 8212, 15854, 23496, 31138, 38780, 46422, 54064 |
| Modotuximab__HeavyChain1 | 571 | 8213, 15855, 23497, 31139, 38781, 46423, 54065 |
| Modotuximab__LightChain1 | 572 | 8214, 15856, 23498, 31140, 38782, 46424, 54066 |
| Mogamulizumab__HeavyChain1 | 573 | 8215, 15857, 23499, 31141, 38783, 46425, 54067 |
| Mogamulizumab__LightChain1 | 574 | 8216, 15858, 23500, 31142, 38784, 46426, 54068 |
| Monalizumab__HeavyChain1 | 575 | 8217, 15859, 23501, 31143, 38785, 46427, 54069 |
| Monalizumab__LightChain1 | 576 | 8218, 15860, 23502, 31144, 38786, 46428, 54070 |
| Motavizumab__HeavyChain1 | 577 | 8219, 15861, 23503, 31145, 38787, 46429, 54071 |
| Motavizumab__HeavyChain_variant | 578 | 8220, 15862, 23504, 31146, 38788, 46430, 54072 |
| Motavizumab__LightChain | 579 | 8221, 15863, 23505, 31147, 38789, 46431, 54073 |
| Motavizumab__LightChain_variant | 580 | 8222, 15864, 23506, 31148, 38790, 46432, 54074 |
| Moxetumomab_pasudotox__HeavyChain1 | 581 | 8223, 15865, 23507, 31149, 38791, 46433, 54075 |
| Moxetumomab_pasudotox__LightChain1 | 582 | 8224, 15866, 23508, 31150, 38792, 46434, 54076 |
| Muromonab-CD3__HeavyChain | 583 | 8225, 15867, 23509, 31151, 38793, 46435, 54077 |
| Muromonab-CD3__LightChain | 584 | 8226, 15868, 23510, 31152, 38794, 46436, 54078 |
| Namilumab__HeavyChain1 | 585 | 8227, 15869, 23511, 31153, 38795, 46437, 54079 |
| Namilumab__LightChain1 | 586 | 8228, 15870, 23512, 31154, 38796, 46438, 54080 |
| Naptumomab_estafenatox__HeavyChain | 587 | 8229, 15871, 23513, 31155, 38797, 46439, 54081 |
| Naptumomab_estafenatox__LightChain | 588 | 8230, 15872, 23514, 31156, 38798, 46440, 54082 |
| Narnatumab__HeavyChain1 | 589 | 8231, 15873, 23515, 31157, 38799, 46441, 54083 |
| Narnatumab__LightChain1 | 590 | 8232, 15874, 23516, 31158, 38800, 46442, 54084 |
| Natalizumab__HeavyChain1 | 591 | 8233, 15875, 23517, 31159, 38801, 46443, 54085 |
| Natalizumab__LightChain1 | 592 | 8234, 15876, 23518, 31160, 38802, 46444, 54086 |
| Navicixizumab__HeavyChain1 | 593 | 8235, 15877, 23519, 31161, 38803, 46445, 54087 |
| Navicixizumab__HeavyChain2 | 594 | 8236, 15878, 23520, 31162, 38804, 46446, 54088 |
| Navicixizumab__LightChain1 | 595 | 8237, 15879, 23521, 31163, 38805, 46447, 54089 |
| Navivumab__HeavyChain1 | 596 | 8238, 15880, 23522, 31164, 38806, 46448, 54090 |
| Navivumab__LightChain1 | 597 | 8239, 15881, 23523, 31165, 38807, 46449, 54091 |
| Ndimab-varB__HeavyChain | 598 | 8240, 15882, 23524, 31166, 38808, 46450, 54092 |
| Ndimab-varB__LightChain | 599 | 8241, 15883, 23525, 31167, 38809, 46451, 54093 |
| Necitumumab__HeavyChain1 | 600 | 8242, 15884, 23526, 31168, 38810, 46452, 54094 |
| Necitumumab__LightChain1 | 601 | 8243, 15885, 23527, 31169, 38811, 46453, 54095 |
| Neliximab__HeavyChain_VH-Region | 602 | 8244, 15886, 23528, 31170, 38812, 46454, 54096 |
| Neliximab__HeavyChain_VH-Region_variant1 | 603 | 8245, 15887, 23529, 31171, 38813, 46455, 54097 |
| Neliximab__LightChain_VL-Region | 604 | 8246, 15888, 23530, 31172, 38814, 46456, 54098 |
| Neliximab__LightChain_VL-Region_variant1 | 605 | 8247, 15889, 23531, 31173, 38815, 46457, 54099 |
| Nemolizumab__HeavyChain1 | 606 | 8248, 15890, 23532, 31174, 38816, 46458, 54100 |
| Nemolizumab__LightChain1 | 607 | 8249, 15891, 23533, 31175, 38817, 46459, 54101 |

TABLE 3-continued

RNA and amino acid sequences of exemplified antibodies

| Name | Protein SEQ ID NO | RNA SEQ ID NO |
|---|---|---|
| Nesvacumab_HeavyChain1 | 608 | 8250, 15892, 23534, 31176, 38818, 46460, 54102 |
| Nesvacumab_LightChain1 | 609 | 8251, 15893, 23535, 31177, 38819, 46461, 54103 |
| Neuradiab_HeavyChain1 | 610 | 8252, 15894, 23536, 31178, 38820, 46462, 54104 |
| Neuradiab_LightChain1 | 611 | 8253, 15895, 23537, 31179, 38821, 46463, 54105 |
| Nimotuzumab_HeavyChain1 | 612 | 8254, 15896, 23538, 31180, 38822, 46464, 54106 |
| Nimotuzumab_LightChain1 | 613 | 8255, 15897, 23539, 31181, 38823, 46465, 54107 |
| Nivolumab_HeavyChain1 | 614 | 8256, 15898, 23540, 31182, 38824, 46466, 54108 |
| Nivolumab_LightChain1 | 615 | 8257, 15899, 23541, 31183, 38825, 46467, 54109 |
| Obiltoxaximab_HeavyChain1 | 616 | 8258, 15900, 23542, 31184, 38826, 46468, 54110 |
| Obiltoxaximab_LightChain1 | 617 | 8259, 15901, 23543, 31185, 38827, 46469, 54111 |
| Obinutuzumab_HeavyChain1 | 618 | 8260, 15902, 23544, 31186, 38828, 46470, 54112 |
| Obinutuzumab_LightChain1 | 619 | 8261, 15903, 23545, 31187, 38829, 46471, 54113 |
| Ocaratuzumab_HeavyChain1 | 620 | 8262, 15904, 23546, 31188, 38830, 46472, 54114 |
| Ocaratuzumab_LightChain1 | 621 | 8263, 15905, 23547, 31189, 38831, 46473, 54115 |
| Ocrelizumab_HeavyChain1 | 622 | 8264, 15906, 23548, 31190, 38832, 46474, 54116 |
| Ocrelizumab_LightChain1 | 623 | 8265, 15907, 23549, 31191, 38833, 46475, 54117 |
| Ofatumumab_HeavyChain1 | 624 | 8266, 15908, 23550, 31192, 38834, 46476, 54118 |
| Ofatumumab_LightChain1 | 625 | 8267, 15909, 23551, 31193, 38835, 46477, 54119 |
| Olaratumab_HeavyChain1 | 626 | 8268, 15910, 23552, 31194, 38836, 46478, 54120 |
| Olaratumab_LightChain1 | 627 | 8269, 15911, 23553, 31195, 38837, 46479, 54121 |
| Olizuab_HeavyChain1 | 628 | 8270, 15912, 23554, 31196, 38838, 46480, 54122 |
| Olizuab_LightChain1 | 629 | 8271, 15913, 23555, 31197, 38839, 46481, 54123 |
| Olokizumab_HeavyChain1 | 630 | 8272, 15914, 23556, 31198, 38840, 46482, 54124 |
| Olokizumab_LightChain1 | 631 | 8273, 15915, 23557, 31199, 38841, 46483, 54125 |
| Omalizumab_HeavyChain1 | 632 | 8274, 15916, 23558, 31200, 38842, 46484, 54126 |
| Omalizumab_LightChain | 633 | 8275, 15917, 23559, 31201, 38843, 46485, 54127 |
| Onartuzumab_HeavyChain1 | 634 | 8276, 15918, 23560, 31202, 38844, 46486, 54128 |
| Onartuzumab_HeavyChain2 | 635 | 8277, 15919, 23561, 31203, 38845, 46487, 54129 |
| Onartuzumab_LightChain1 | 636 | 8278, 15920, 23562, 31204, 38846, 46488, 54130 |
| Ontuxizumab_HeavyChain1 | 637 | 8279, 15921, 23563, 31205, 38847, 46489, 54131 |
| Ontuxizumab_LightChain1 | 638 | 8280, 15922, 23564, 31206, 38848, 46490, 54132 |
| Opicinumab_HeavyChain1 | 639 | 8281, 15923, 23565, 31207, 38849, 46491, 54133 |
| Opicinumab_LightChain1 | 640 | 8282, 15924, 23566, 31208, 38850, 46492, 54134 |
| Oportuzumab_monatox_HeavyChain1 | 641 | 8283, 15925, 23567, 31209, 38851, 46493, 54135 |
| Oportuzumab_monatox_SingleChain_variable_fragment | 642 | 8284, 15926, 23568, 31210, 38852, 46494, 54136 |
| Oreptacog_alfa_HeavyChain1 | 643 | 8285, 15927, 23569, 31211, 38853, 46495, 54137 |
| Oreptacog_alfa_LightChain1 | 644 | 8286, 15928, 23570, 31212, 38854, 46496, 54138 |
| Orticumab_HeavyChain1 | 645 | 8287, 15929, 23571, 31213, 38855, 46497, 54139 |
| Orticumab_LightChain1 | 646 | 8288, 15930, 23572, 31214, 38856, 46498, 54140 |
| Otelixizumab_HeavyChain1 | 647 | 8289, 15931, 23573, 31215, 38857, 46499, 54141 |
| Otelixizumab_LightChain1 | 648 | 8290, 15932, 23574, 31216, 38858, 46500, 54142 |
| Otlertuzumab_HeavyChain1 | 649 | 8291, 15933, 23575, 31217, 38859, 46501, 54143 |
| Oxelumab_HeavyChain1 | 650 | 8292, 15934, 23576, 31218, 38860, 46502, 54144 |
| Oxelumab_LightChain1 | 651 | 8293, 15935, 23577, 31219, 38861, 46503, 54145 |
| Ozanezumab_HeavyChain1 | 652 | 8294, 15936, 23578, 31220, 38862, 49504, 54146 |
| Ozanezumab_LightChain1 | 653 | 8295, 15937, 23579, 31221, 38863, 46505, 54147 |
| Ozoralizumab_HeavyChain1 | 654 | 8296, 15938, 23580, 31222, 38864, 46506, 54148 |
| Palivizumab_HeavyChain | 655 | 8297, 15939, 23581, 31223, 38865, 46507, 54149 |
| Palivizumab_LightChain | 656 | 8298, 15940, 23582, 31224, 38866, 46508, 54150 |
| Palivizumab_VH-Region | 657 | 8299, 15941, 23583, 31225, 38867, 46509, 54151 |
| Pamrevlumab_HeavyChain1 | 658 | 8300, 15942, 23584, 31226, 38868, 46510, 54152 |
| Pamrevlumab_LightChain1 | 659 | 8301, 15943, 23585, 31227, 38869, 46511, 54153 |
| Panitumumab_HeavyChain1 | 660 | 8302, 15944, 23586, 31228, 38870, 46512, 54154 |
| Panitumumab_LightChain1 | 661 | 8303, 15945, 23587, 31229, 38871, 46513, 54155 |
| Pankoab_HeavyChain1 | 662 | 8304, 15946, 23588, 31230, 38872, 46514, 54156 |
| Pankoab_LightChain1 | 663 | 8305, 15947, 23589, 31231, 38873, 46515, 54157 |
| Pankoab_LightChain2 | 664 | 8306, 15948, 23590, 31232, 38874, 46516, 54158 |
| PankoMab_HeavyChain_VDJ-Region | 665 | 8307, 15949, 23591, 31233, 38875, 46517, 54159 |
| PankoMab_LightChain_VJ-Region | 666 | 8308, 15950, 23592, 31234, 38876, 46518, 54160 |
| Panobacumab_HeavyChain1 | 667 | 8309, 15951, 23593, 31235, 38877, 46519, 54161 |
| Panobacumab_LightChain1 | 668 | 8310, 15952, 23594, 31236, 38878, 46520, 54162 |
| Panobacumab_LightChain2 | 669 | 8311, 15953, 23595, 31237, 38879, 46521, 54163 |
| Parsatuzumab_HeavyChain1 | 670 | 8312, 15954, 23596, 31238, 38880, 46522, 54164 |
| Parsatuzumab_LightChain1 | 671 | 8313, 15955, 23597, 31239, 38881, 46523, 54165 |
| Pascolizumab_HeavyChain1 | 672 | 8314, 15956, 23598, 31240, 38882, 46524, 54166 |
| Pascolizumab_LightChain1 | 673 | 8315, 15957, 23599, 31241, 38883, 46525, 54167 |
| Pasotuxizumab_HeavyChain1 | 674 | 8316, 15958, 23600, 31242, 38884, 46526, 54168 |
| Pasotuxizumab_SingleChain | 675 | 8317, 15959, 23601, 31243, 38885, 46527, 54169 |
| Pateclizumab_HeavyChain1 | 676 | 8318, 15960, 23602, 31244, 38886, 46528, 54170 |
| Pateclizumab_LightChain1 | 677 | 8319, 15961, 23603, 31245, 38887, 46529, 54171 |
| Patritumab_HeavyChain1 | 678 | 8320, 15962, 23604, 31246, 38888, 46530, 54172 |
| Patritumab_hinge-CH2—CH3 | 679 | 8321, 15963, 23605, 31247, 38889, 46531, 54173 |
| Patritumab_LightChain1 | 680 | 8322, 15964, 23606, 31248, 38890, 46532, 54174 |
| Pembrolizumab_HeavyChain1 | 681 | 8323, 15965, 23607, 31249, 38891, 46533, 54175 |
| Pembrolizumab_LightChain1 | 682 | 8324, 15966, 23608, 31250, 38892, 46534, 54176 |
| Perakizumab_HeavyChain1 | 683 | 8325, 15967, 23609, 31251, 38893, 46535, 54177 |

TABLE 3-continued

RNA and amino acid sequences of exemplified antibodies

| Name | Protein SEQ ID NO | RNA SEQ ID NO |
| --- | --- | --- |
| Perakizumab_LightChain1 | 684 | 8326, 15968, 23610, 31252, 38894, 46536, 54178 |
| Pertuzuab_HeavyChain1 | 685 | 8327, 15969, 23611, 31253, 38895, 46537, 54179 |
| Pertuzuab_LightChain1 | 686 | 8328, 15970, 23612, 31254, 38896, 46538, 54180 |
| Pertuzumab_HeavyChain | 687 | 8329, 15971, 23613, 31255, 38897, 46539, 54181 |
| Pertuzumab_LightChain | 688 | 8330, 15972, 23614, 31256, 38898, 46540, 54182 |
| Pexelizumab_h5g1.1-scFv | 689 | 8331, 15973, 23615, 31257, 38899, 46541, 54183 |
| Pexelizumab_h5g1.1VHC_+_F_Heavy_Chain_V-Region | 690 | 8332, 15974, 23616, 31258, 38900, 46542, 54184 |
| Pexelizumab_h5g1.1VHC_+_F_Light_Chain_V-Region | 691 | 8333, 15975, 23617, 31259, 38901, 46543, 54185 |
| PF-05082566_HeavyChain1 | 692 | 8334, 15976, 23618, 31260, 38902, 46544, 54186 |
| PF-05082568_LightChain1 | 693 | 8335, 15977, 23619, 31261, 38903, 46545, 54187 |
| Pidilizumab_HeavyChain1 | 694 | 8336, 15978, 23620, 31262, 38904, 46546, 54188 |
| Pidilizumab_LightChain1 | 695 | 8337, 15979, 23621, 31263, 38905, 46547, 54189 |
| Pinatuzumab_vedotin_HeavyChain1 | 696 | 8338, 15980, 23622, 31264, 38906, 46548, 54190 |
| Pinatuzumab_vedotin_LightChain1 | 697 | 8339, 15981, 23623, 31265, 38907, 46549, 54191 |
| Placulumab_chain1 | 698 | 8340, 15982, 23624, 31266, 38908, 46550, 54192 |
| Placulumab_HeavyChain1 | 699 | 8341, 15983, 23625, 31267, 38909, 46551, 54193 |
| Plozalizumab_HeavyChain1 | 700 | 8342, 15984, 23626, 31268, 38910, 46552, 54194 |
| Plozalizumab_LightChain1 | 701 | 8343, 15985, 23627, 31269, 38911, 46553, 54195 |
| Pogalizumab_HeavyChain1 | 702 | 8344, 15986, 23628, 31270, 38912, 46554, 54196 |
| Pogalizumab_LightChain1 | 703 | 8345, 15987, 23629, 31271, 38913, 46555, 54197 |
| Polatuzumab_vedotin_HeavyChain1 | 704 | 8346, 15988, 23630, 31272, 38914, 46556, 54198 |
| Polatuzumab_vedotin_LightChain1 | 705 | 8347, 15989, 23631, 31273, 38915, 46557, 54199 |
| Ponezumab_HeavyChain1 | 706 | 8348, 15990, 23632, 31274, 38916, 46558, 54200 |
| Ponezumab_LightChain1 | 707 | 8349, 15991, 23633, 31275, 38917, 46559, 54201 |
| Pritoxaximab_HeavyChain1 | 708 | 8350, 15992, 23634, 31276, 38918, 46560, 54202 |
| Pritoxaximab_LightChain1 | 709 | 8351, 15993, 23635, 31277, 38919, 46561, 54203 |
| Pritumumab_HeavyChain1 | 710 | 8352, 15994, 23636, 31278, 38920, 46562, 54204 |
| Pritumumab_LightChain1 | 711 | 8353, 15995, 23637, 31279, 38921, 46563, 54205 |
| Quilizumab_HeavyChain1 | 712 | 8354, 15996, 23638, 31280, 38922, 46564, 54206 |
| Quilizumab_LightChain1 | 713 | 8355, 15997, 23639, 31281, 38923, 46565, 54207 |
| Racotumomab_HeavyChain1 | 714 | 8356, 15998, 23640, 31282, 38924, 46566, 54208 |
| Racotumomab_LightChain1 | 715 | 8357, 15999, 23641, 31283, 38925, 46567, 54209 |
| Racotumomab_scVH-VH'-VH_chain | 716 | 8358, 16000, 23642, 31284, 38926, 46568, 54210 |
| Radretumab_HeavyChain1 | 717 | 8359, 16001, 23643, 31285, 38927, 46569, 54211 |
| Radretumab_j_chain | 718 | 8360, 16002, 23644, 31286, 38928, 46570, 54212 |
| Rafivirumab_HeavyChain1 | 719 | 8361, 16003, 23645, 31287, 38929, 46571, 54213 |
| Rafivirumab_HeavyChain | 720 | 8362, 16004, 23646, 31288, 38930, 46572, 54214 |
| Rafivirumab_LightChain1 | 721 | 8363, 16005, 23647, 31289, 38931, 46573, 54215 |
| Rafivirumab_LightChain | 722 | 8364, 16006, 23648, 31290, 38932, 46574, 54216 |
| Ralpancizumab_HeavyChain1 | 723 | 8365, 16007, 23649, 31291, 38933, 46575, 54217 |
| Ralpancizumab_LightChain1 | 724 | 8366, 16008, 23650, 31292, 38934, 46576, 54218 |
| Ramucirumab_HeavyChain1 | 725 | 8367, 16009, 23651, 31293, 38935, 46577, 54219 |
| Ramucirumab_LightChain1 | 726 | 8368, 16010, 23652, 31294, 38936, 46578, 54220 |
| Ranibiziuab_HeavyChain1 | 727 | 8369, 16011, 23653, 31295, 38937, 46579, 54221 |
| Ranibiziuab_LightChain1 | 728 | 8370, 16012, 23654, 31296, 38938, 46580, 54222 |
| Ranibizumab_fab_fragment | 729 | 8371, 16013, 23655, 31297, 38939, 46581, 54223 |
| Ranibizumab_HeavyChain | 730 | 8372, 16014, 23656, 31298, 38940, 46582, 54224 |
| Ranibizumab_LightChain | 731 | 8373, 16015, 23657, 31299, 38941, 46583, 54225 |
| Ranibizumab_LightChain_variant | 732 | 8374, 16016, 23658, 31300, 38942, 46584, 54226 |
| Refanezumab_HeavyChain1 | 733 | 8375, 16017, 23659, 31301, 38943, 46585, 54227 |
| Refanezumab_LightChain1 | 734 | 8376, 16018, 23660, 31302, 38944, 46586, 54228 |
| REGN2810_HeavyChain1 | 735 | 8377, 16019, 23661, 31303, 38945, 46587, 54229 |
| REGN2810_LightChain1 | 736 | 8378, 16020, 23662, 31304, 38946, 46588, 54230 |
| rhuMab_HER2(9CI)_LightChain | 737 | 8379, 16021, 23663, 31305, 38947, 46589, 54231 |
| rhuMab_HER2_HeavyChain | 738 | 8380, 16022, 23664, 31306, 38948, 46590, 54232 |
| rhuMab_HER2_LightChain | 739 | 8381, 16023, 23665, 31307, 38949, 46591, 54233 |
| rhuMab_HER2_LightChain_variant1 | 740 | 8382, 16024, 23666, 31308, 38950, 46592, 54234 |
| rhuMab_HER2_LightChain_variant2 | 741 | 8383, 16025, 23667, 31309, 38951, 46593, 54235 |
| rhuMab_HER2_LightChain_variant3 | 742 | 8384, 16026, 23668, 31310, 38952, 46594, 54236 |
| rhuMab_HER2_LightChain_variant4 | 743 | 8385, 16027, 23669, 31311, 38953, 46595, 54237 |
| rhuMab_HER2_LightChain_V-Region | 744 | 8386, 16028, 23670, 31312, 38954, 46596, 54238 |
| rhuMab_HER2_gamma1-Chain | 745 | 8387, 16029, 23671, 31313, 38955, 46597, 54239 |
| rhuMab_HER2_gamma1-Chain | 746 | 8388, 16030, 23672, 31314, 38956, 46598, 54240 |
| rhuMab_HER2_gamma1-Chain_rhuMab_HER2_LightChain_sc405 | 747 | 8389, 16031, 23673, 31315, 38957, 46599, 54241 |
| rhuMab_HER2_gamma1-Chain_variant1 | 748 | 8390, 16032, 23674, 31316, 38958, 46600, 54242 |
| rhuMab_HER2_gamma1-Chain_variant2 | 749 | 8391, 16033, 23675, 31317, 38959, 46601, 54243 |
| rhuMab_HER2_gamma1-Chain_variant3 | 750 | 8392, 16034, 23676, 31318, 38960, 46602, 54244 |
| rhuMab_HER2_gamma1-Chain_V-Region | 751 | 8393, 16035, 23677, 31319, 38961, 46603, 54245 |
| rhuMab-VEGF_HeavyChain1 | 752 | 8394, 16036, 23678, 31320, 38962, 46604, 54246 |
| rhuMab-VEGF_LightChain1 | 753 | 8395, 16037, 23679, 31321, 38963, 46605, 54247 |
| rhuMAb-VEGF_LightChain | 754 | 8396, 16038, 23680, 31322, 38964, 46606, 54248 |
| rhuMAb-VEGF_LightChain_VG-Region | 755 | 8397, 16039, 23681, 31323, 38965, 46607, 54249 |
| rhuMAb-VEGF_gamma1-Chain | 756 | 8398, 16040, 23682, 31324, 38966, 46608, 54250 |
| rhuMAb-VEGF_gamma1-Chain_VDG-Region | 757 | 8399, 16041, 23683, 31325, 38967, 46609, 54251 |
| Rilotumumab_HeavyChain1 | 758 | 8400, 16042, 23684, 31326, 38968, 46610, 54252 |

TABLE 3-continued

RNA and amino acid sequences of exemplified antibodies

| Name | Protein SEQ ID NO | RNA SEQ ID NO |
| --- | --- | --- |
| Rilotumumab_LightChain1 | 759 | 8401, 16043, 23685, 31327, 38969, 46611, 54253 |
| Rilotumumab_scFv-CH_chain | 760 | 8402, 16044, 23686, 31328, 38970, 46612, 54254 |
| Rinucumab_HeavyChain1 | 761 | 8403, 16045, 23687, 31329, 38971, 46613, 54255 |
| Rinucumab_HeavyChain | 762 | 8404, 16046, 23688, 31330, 38972, 46614, 54256 |
| Rinucumab_LightChain1 | 763 | 8405, 16047, 23689, 31331, 38973, 46615, 54257 |
| Risankizumab_HeavyChain1 | 764 | 8406, 16048, 23690, 31332, 38974, 46616, 54258 |
| Risankizumab_LightChain1 | 765 | 8407, 16049, 23691, 31333, 38975, 46617, 54259 |
| Rituximab_HeavyChain | 766 | 8408, 16050, 23692, 31334, 38976, 46618, 54260 |
| Rituximab_HeavyChain_variant | 767 | 8409, 16051, 23693, 31335, 38977, 46619, 54261 |
| Rituximab_LightChain | 768 | 8410, 16052, 23694, 31336, 38978, 46620, 54262 |
| Rivabazumab_pegol_HeavyChain1 | 769 | 8411, 16053, 23695, 31337, 38979, 46621, 54263 |
| Rivabazumab_pegol_LightChain1 | 770 | 8412, 16054, 23696, 31338, 38980, 46622, 54264 |
| Robatumumab_HeavyChain1 | 771 | 8413, 16055, 23697, 31339, 38981, 46623, 54265 |
| Robatumumab_LightChain1 | 772 | 8414, 16056, 23698, 31340, 38982, 46624, 54266 |
| Roledumab_HeavyChain1 | 773 | 8415, 16057, 23699, 31341, 38983, 46625, 54267 |
| Roledumab_LightChain1 | 774 | 8416, 16058, 23700, 31342, 38984, 46626, 54268 |
| Romosozumab_fab_fragment | 775 | 8417, 16059, 23701, 31343, 38985, 46627, 54269 |
| Romosozumab_HeavyChain1 | 776 | 8418, 16060, 23702, 31344, 38986, 46628, 54270 |
| Romosozumab_LightChain1 | 777 | 8419, 16061, 23703, 31345, 38987, 46629, 54271 |
| Rontalizuab_HeavyChain1 | 778 | 8420, 16062, 23704, 31346, 38988, 46630, 54272 |
| Rontalizuab_LightChain1 | 779 | 8421, 16063, 23705, 31347, 38989, 46631, 54273 |
| Rontalizumab_HeavyChain1 | 780 | 8422, 16064, 23706, 31348, 38990, 46632, 54274 |
| Rontalizumab_LightChain1 | 781 | 8423, 16065, 23707, 31349, 38991, 46633, 54275 |
| Rovalpituzumab_tesirine_HeavyChain1 | 782 | 8424, 16066, 23708, 31350, 38992, 46634, 54276 |
| Rovalpituzumab_tesirine_LightChain1 | 783 | 8425, 16067, 23709, 31351, 38993, 46635, 54277 |
| Rovelizumab_HeavyChain1 | 784 | 8426, 16068, 23710, 31352, 38994, 46636, 54278 |
| Rovelizumab_LightChain1 | 785 | 8427, 16069, 23711, 31353, 38995, 46637, 54279 |
| Ruplizumab_HeavyChain1 | 786 | 8428, 16070, 23712, 31354, 38996, 46638, 54280 |
| Ruplizumab_LightChain1 | 787 | 8429, 16071, 23713, 31355, 38997, 46639, 54281 |
| Sacituzumab_govitecan_HeavyChain1 | 788 | 8430, 16072, 23714, 31356, 38998, 46640, 54282 |
| Sacituzumab_govitecan_LightChain1 | 789 | 8431, 16073, 23715, 31357, 38999, 46641, 54283 |
| Samalizumab_HeavyChain1 | 790 | 8432, 16074, 23716, 31358, 39000, 46642, 54284 |
| Samalizumab_LightChain1 | 791 | 8433, 16075, 23717, 31359, 39001, 46643, 54285 |
| Sarilumab_HeavyChain1 | 792 | 8434, 16076, 23718, 31360, 39002, 46644, 54286 |
| Sarilumab_LightChain1 | 793 | 8435, 16077, 23719, 31361, 39003, 46645, 54287 |
| Satumomab_pendetide_HeavyChain | 794 | 8436, 16078, 23720, 31362, 39004, 46646, 54288 |
| Satumomab_pendetide_LightChain | 795 | 8437, 16079, 23721, 31363, 39005, 46647, 54289 |
| Secukinumab_HeavyChain1 | 796 | 8438, 16080, 23722, 31364, 39006, 46648, 54290 |
| Secukinumab_LightChain1 | 797 | 8439, 16081, 23723, 31365, 39007, 46649, 54291 |
| Seribantumab_HeavyChain1 | 798 | 8440, 16082, 23724, 31366, 39008, 46650, 54292 |
| Seribantumab_LightChain1 | 799 | 8441, 16083, 23725, 31367, 39009, 46651, 54293 |
| Setoxaximab_HeavyChain1 | 800 | 8442, 16084, 23726, 31368, 39010, 46652, 54294 |
| Setoxaximab_LightChain1 | 801 | 8443, 16085, 23727, 31369, 39011, 46653, 54295 |
| Sifalimumab_HeavyChain1 | 802 | 8444, 16086, 23728, 31370, 39012, 46654, 54296 |
| Sifalimumab_LightChain1 | 803 | 8445, 16087, 23729, 31371, 39013, 46655, 54297 |
| Siltuximab_HeavyChain1 | 804 | 8446, 16088, 23730, 31372, 39014, 46656, 54298 |
| Siltuximab_LightChain1 | 805 | 8447, 16089, 23731, 31373, 39015, 46657, 54299 |
| Simtuzumab_HeavyChain1 | 806 | 8448, 16090, 23732, 31374, 39016, 46658, 54300 |
| Simtuzumab_LightChain1 | 807 | 8449, 16091, 23733, 31375, 39017, 46659, 54301 |
| Sirukumab_HeavyChain1 | 808 | 8450, 16092, 23734, 31376, 39018, 46660, 54302 |
| Sirukumab_LightChain1 | 809 | 8451, 16093, 23735, 31377, 39019, 46661, 54303 |
| Sofituzumab_vedotin_HeavyChain1 | 810 | 8452, 16094, 23736, 31378, 39020, 46662, 54304 |
| Sofituzumab_vedotin_LightChain1 | 811 | 8453, 16095, 23737, 31379, 39021, 46663, 54305 |
| Solanezumab_HeavyChain1 | 812 | 8454, 16096, 23738, 31380, 39022, 46664, 54306 |
| Solanezumab_HeavyChain | 813 | 8455, 16097, 23739, 31381, 39023, 46665, 54307 |
| Solanezumab_LightChain1 | 814 | 8456, 16098, 23740, 31382, 39024, 46666, 54308 |
| Solitomab_HeavyChain1 | 815 | 8457, 16099, 23741, 31383, 39025, 46667, 54309 |
| Solitomab_SingleChain | 816 | 8458, 16100, 23742, 31384, 39026, 46668, 54310 |
| Sonepcizumab_LightChain_Precursor | 817 | 8459, 16101, 23743, 31385, 39027, 46669, 54311 |
| Sonepcizumab_gamma1-Chain_Precursor | 818 | 8460, 16102, 23744, 31386, 39028, 46670, 54312 |
| Stamulumab_HeavyChain1 | 819 | 8461, 16103, 23745, 31387, 39029, 46671, 54313 |
| Stamulumab_LightChain1 | 820 | 8462, 16104, 23746, 31388, 39030, 46672, 54314 |
| Suptavumab_HeavyChain1 | 821 | 8463, 16105, 23747, 31389, 39031, 46673, 54315 |
| Suptavumab_LightChain1 | 822 | 8464, 16106, 23748, 31390, 39032, 46674, 54316 |
| Suvizumab_HeavyChain1 | 823 | 8465, 16107, 23749, 31391, 39033, 46675, 54317 |
| Suvizumab_LightChain1 | 824 | 8466, 16108, 23750, 31392, 39034, 46676, 54318 |
| Tabalumab_HeavyChain1 | 825 | 8467, 16109, 23751, 31393, 39035, 46677, 54319 |
| Tabalumab_LightChain1 | 826 | 8468, 16110, 23752, 31394, 39036, 46678, 54320 |
| Tacatuzuab_HeavyChain1 | 827 | 8469, 16111, 23753, 31395, 39037, 46679, 54321 |
| Tacatuzuab_LightChain1 | 828 | 8470, 16112, 23754, 31396, 39038, 46680, 54322 |
| Tadocizumab_fab_fragment_HeavyChain | 829 | 8471, 16113, 23755, 31397, 39039, 46681, 54323 |
| Tadocizumab_fab_fragment_LightChain | 830 | 8472, 16114, 23756, 31398, 39040, 46682, 54324 |
| Talizumab_HeavyChain1 | 831 | 8473, 16115, 23757, 31399, 39041, 46683, 54325 |
| Talizumab_LightChain1 | 832 | 8474, 16116, 23758, 31400, 39042, 46684, 54326 |
| Tamtuvetmab_HeavyChain1 | 833 | 8475, 16117, 23759, 31401, 39043, 46685, 54327 |
| Tamtuvetmab_LightChain1 | 834 | 8476, 16118, 23760, 31402, 39044, 46686, 54328 |

TABLE 3-continued

RNA and amino acid sequences of exemplified antibodies

| Name | Protein SEQ ID NO | RNA SEQ ID NO |
|---|---|---|
| Tanezumab_HeavyChain | 835 | 8477, 16119, 23761, 31403, 39045, 46687, 54329 |
| Tanezumab_LightChain | 836 | 8478, 16120, 23762, 31404, 39046, 46688, 54330 |
| Tarextumab_HeavyChain1 | 837 | 8479, 16121, 23763, 31405, 39047, 46689, 54331 |
| Tarextumab_LightChain1 | 838 | 8480, 16122, 23764, 31406, 39048, 46690, 54332 |
| Tefibazumab_HeavyChain1 | 839 | 8481, 16123, 23765, 31407, 39049, 46691, 54333 |
| Tefibazumab_LightChain1 | 840 | 8482, 16124, 23766, 31408, 39050, 46692, 54334 |
| Tenatumomab_HeavyChain1 | 841 | 8483, 16125, 23767, 31409, 39051, 46693, 54335 |
| Tenatumomab_LightChain1 | 842 | 8484, 16126, 23768, 31410, 39052, 46694, 54336 |
| Teneliximab_HeavyChain1 | 843 | 8485, 16127, 23769, 31411, 39053, 46695, 54337 |
| Teneliximab_LightChain1 | 844 | 8486, 16128, 23770, 31412, 39054, 46696, 54338 |
| Teplizumab_HeavyChain1 | 845 | 8487, 16129, 23771, 31413, 39055, 46697, 54339 |
| Teplizumab_LightChain1 | 846 | 8488, 16130, 23772, 31414, 39056, 46698, 54340 |
| Teprotumumab_HeavyChain1 | 847 | 8489, 16131, 23773, 31415, 39057, 46699, 54341 |
| Teprotumumab_LightChain1 | 848 | 8490, 16132, 23774, 31416, 39058, 46700, 54342 |
| Tesidolumab_HeavyChain1 | 849 | 8491, 16133, 23775, 31417, 39059, 46701, 54343 |
| Tesidolumab_LightChain1 | 850 | 8492, 16134, 23776, 31418, 39060, 46702, 54344 |
| Tezepelumab_HeavyChain1 | 851 | 8493, 16135, 23777, 31419, 39061, 46703, 54345 |
| Tezepelumab_LightChain1 | 852 | 8494, 16136, 23778, 31420, 39162, 46704, 54346 |
| ThioMAb-chMA79b-HC(A118C)_HeavyChain | 853 | 8495, 16137, 23779, 31421, 39063, 46705, 54347 |
| ThioMab-hu10A8.v1-HC(A118C)_HeavyChain | 854 | 8496, 16138, 23780, 31422, 39064, 46706, 54348 |
| ThioMab-hu10A8.v1-HC(V205C)_HeavyChain | 855 | 8497, 16139, 23781, 31423, 39065, 46707, 54349 |
| ThioMab-hu10A8.v1-LC(A118C)_LightChain | 856 | 8498, 16140, 23782, 31424, 39066, 46708, 54350 |
| ThioMab-hu10AB.v1-LC(V205C)_LightChain | 857 | 8499, 16141, 23783, 31425, 39067, 46709, 54351 |
| ThioMAb-huMA79b.v17-HC(A118C)_HeavyChain | 858 | 8500, 16142, 23784, 31426, 39068, 46710, 54352 |
| ThioMAb-huMA79b.v17-HC(A118C)_LightChain | 859 | 8501, 16143, 23785, 31427, 39069, 46711, 54353 |
| ThioMAb-huMA79b.v18-HC(A118C)_HeavyChain | 860 | 8502, 16144, 23786, 31428, 39070, 46712, 54354 |
| ThioMAb-huMA79b.v28-HC(A118C)_LightChain | 861 | 8503, 16145, 23787, 31429, 39071, 46713, 54355 |
| ThioMAb-huMA79b.v28-LC(V205C)_LightChain | 862 | 8504, 16146, 23788, 31430, 39072, 46714, 54356 |
| Ticiliuab_HeavyChain1 | 863 | 8505, 16147, 23789, 31431, 39073, 46715, 54357 |
| Ticilivab_LightChain1 | 864 | 8506, 16148, 23790, 31432, 39074, 46716, 54358 |
| Tigatuzumab_HeavyChain1 | 865 | 8507, 16149, 23791, 31433, 39075, 46717, 54359 |
| Tigatuzumab_HeavyChain | 866 | 8508, 16150, 23792, 31434, 39076, 46718, 54360 |
| Tigatuzumab_LightChain1 | 867 | 8509, 16151, 23793, 31435, 39077, 46719, 54361 |
| Tigatuzumab_LightChain | 868 | 8510, 16152, 23794, 31436, 39078, 46720, 54362 |
| Tildrakizumab_HeavyChain1 | 869 | 8511, 16153, 23795, 31437, 39079, 46721, 54363 |
| Tildrakizumab_LightChain1 | 870 | 8512, 16154, 23796, 31438, 39080, 46722, 54364 |
| Tisotumab_vedotin_HeavyChain1 | 871 | 8513, 16155, 23797, 31439, 39081, 46723, 54365 |
| Tisotumab_vedotin_LightChain1 | 872 | 8514, 16156, 23798, 31440, 39082, 46724, 54366 |
| Tocilizumab_HeavyChain1 | 873 | 8515, 16157, 23799, 31441, 39083, 46725, 54367 |
| Tocilizumab_LightChain1 | 874 | 8516, 16158, 23800, 31442, 39084, 46726, 54368 |
| Tosatoxumab_HeavyChain1 | 875 | 8517, 16159, 23801, 31443, 39085, 46727, 54369 |
| Tosatoxumab_LightChain1 | 876 | 8518, 16160, 23802, 31444, 39086, 46728, 54370 |
| Tositumomab_HeavyChain | 877 | 8519, 16161, 23803, 31445, 39087, 46729, 54371 |
| Tositumomab_LightChain | 878 | 8520, 16162, 23804, 31446, 39088, 46730, 54372 |
| Tovetumab_HeavyChain1 | 879 | 8521, 16163, 23805, 31447, 39089, 46731, 54373 |
| Tovetumab_LightChain1 | 880 | 8522, 16164, 23806, 31448, 39090, 46732, 54374 |
| Tralokinumab_HeavyChain1 | 881 | 8523, 16165, 23807, 31449, 39091, 46733, 54375 |
| Tralokinumab_LightChain1 | 882 | 8524, 16166, 23808, 31450, 39092, 46734, 54376 |
| Trastuzuab_HeavyChain1 | 883 | 8525, 16167, 23809, 31451, 39093, 46735, 54377 |
| Trastuzuab_LightChain1 | 884 | 8526, 16168, 23810, 31452, 39094, 46736, 54378 |
| Trastuzumab_emtansine_HeavyChain1 | 885 | 8527, 16169, 23811, 31453, 39095, 46737, 54379 |
| Trastuzumab_emtansine_LightChain1 | 886 | 8528, 16170, 23812, 31454, 39096, 46738, 54380 |
| Trastuzumab_HeavyChain1 | 887 | 8529, 16171, 23813, 31455, 39097, 46739, 54381 |
| Trastuzumab_HeavyChain | 888 | 8530, 16172, 23814, 31456, 39098, 46740, 54382 |
| Trastuzumab_HeavyChain_variant_1n8z_B | 889 | 8531, 16173, 23815, 31457, 39099, 46741, 54383 |
| Trastuzumab_HeavyChain_variant_7637_H | 890 | 8532, 16174, 23816, 31458, 39100, 46742, 54384 |
| Trastuzumab_LightChain1 | 891 | 8533, 16175, 23817, 31459, 39101, 46743, 54385 |
| Trastuzumab_LightChain_variant_1n8z_A | 892 | 8534, 16176, 23818, 31460, 39102, 46744, 54386 |
| Trastuzumab_LightChain_variant_7637_L | 893 | 8535, 16177, 23819, 31461, 39103, 46745, 54387 |
| TRC-105_HeavyChain1 | 894 | 8536, 16178, 23820, 31462, 39104, 46746, 54388 |
| TRC-105_LightChain1 | 895 | 8537, 16179, 23821, 31463, 39105, 46747, 54389 |
| Tregalizumab_HeavyChain1 | 896 | 8538, 16180, 23822, 31464, 39106, 46748, 54390 |
| Tregalizumab_LightChain1 | 897 | 8539, 16181, 23823, 31465, 39107, 46749, 54391 |
| Tremelimumab_HeavyChain1 | 898 | 8540, 16182, 23824, 31466, 39108, 46750, 54392 |
| Tremelimumab_LightChain1 | 899 | 8541, 16183, 23825, 31467, 39109, 46751, 54393 |
| Trevogrumab_HeavyChain1 | 900 | 8542, 16184, 23826, 31468, 39110, 46752, 54394 |
| Trevogrumab_LightChain1 | 901 | 8543, 16185, 23827, 31469, 39111, 46753, 54395 |
| Tucotuzumab_celmoleukin_HeavyChain1 | 902 | 8544, 16186, 23828, 31470, 39112, 46754, 54396 |
| Tucotuzumab_celmoleukin_LightChain1 | 903 | 8545, 16187, 23829, 31471, 39113, 46755, 54397 |
| Ublituximab_HeavyChain1 | 904 | 8546, 16188, 23830, 31472, 39114, 46756, 54398 |
| Ublituximab_LightChain1 | 905 | 8547, 16189, 23831, 31473, 39115, 46757, 54399 |
| Ulocuplumab_HeavyChain1 | 906 | 8548, 16190, 23832, 31474, 39116, 46758, 54400 |
| Ulocuplumab_LightChain1 | 907 | 8549, 16191, 23833, 31475, 39117, 46759, 54401 |
| Urelumab_HeavyChain1 | 908 | 8550, 16192, 23834, 31476, 39118, 46760, 54402 |
| Urelumab_LightChain1 | 909 | 8551, 16193, 23835, 31477, 39119, 46761, 54403 |
| Urtoxazumab_HeavyChain1 | 910 | 8552, 16194, 23836, 31478, 39120, 46762, 54404 |

TABLE 3-continued

RNA and amino acid sequences of exemplified antibodies

| Name | Protein SEQ ID NO | RNA SEQ ID NO |
|---|---|---|
| Urtoxazumab_LightChain1 | 911 | 8553, 16195, 23837, 31479, 39121, 46763, 54405 |
| Ustekinumab_HeavyChain1 | 912 | 8554, 16196, 23838, 31480, 39122, 46764, 54406 |
| Ustekinumab_LightChain1 | 913 | 8555, 16197, 23839, 31481, 39123, 46765, 54407 |
| Vadastuximab_talirine_HeavyChain1 | 914 | 8556, 16198, 23840, 31482, 39124, 46766, 54408 |
| Vadastuximab_talirine_LightChain1 | 915 | 8557, 16199, 23841, 31483, 39125, 46767, 54409 |
| Vandortuzumab_vedotin_HeavyChain1 | 916 | 8558, 16200, 23842, 31484, 39126, 46768, 54410 |
| Vandortuzumab_vedotin_LightChain1 | 917 | 8559, 16201, 23843, 31485, 39127, 46769, 54411 |
| Vantictumab_HeavyChain1 | 918 | 8560, 16202, 23844, 31486, 39128, 46770, 54412 |
| Vantictumab_LightChain1 | 919 | 8561, 16203, 23845, 31487, 39129, 46771, 54413 |
| Vanucizumab_HeavyChain1 | 920 | 8562, 16204, 23846, 31488, 39130, 46772, 54414 |
| Vanucizumab_HeavyChain2 | 921 | 8563, 16205, 23847, 31489, 39131, 46773, 54415 |
| Vanucizumab_LightChain1 | 922 | 8564, 16206, 23848, 31490, 39132, 46774, 54416 |
| Vanucizumab_LightChain2 | 923 | 8565, 16207, 23849, 31491, 39133, 46775, 54417 |
| Varlilumab_HeavyChain1 | 924 | 8566, 16208, 23850, 31492, 39134, 46776, 54418 |
| Varlilumab_LightChain1 | 925 | 8567, 16209, 23851, 31493, 39135, 46777, 54419 |
| Vatelizumab_HeavyChain1 | 926 | 8568, 16210, 23852, 31494, 39136, 46778, 54420 |
| Vatelizumab_LightChain1 | 927 | 8569, 16211, 23853, 31495, 39137, 46779, 54421 |
| Vedolizumab_HeavyChain1 | 928 | 8570, 16212, 23854, 31496, 39138, 46780, 54422 |
| Vedolizumab_LightChain1 | 929 | 8571, 16213, 23855, 31497, 39139, 46781, 54423 |
| Veltuzumab_HeavyChain1 | 930 | 8572, 16214, 23856, 31498, 39140, 46782, 54424 |
| Veltuzumab_LightChain1 | 931 | 8573, 16215, 23857, 31499, 39141, 46783, 54425 |
| Vesencumab_HeavyChain1 | 932 | 8574, 16216, 23858, 31500, 39142, 46784, 54426 |
| Vesencumab_LightChain1 | 933 | 8575, 16217, 23859, 31501, 39143, 46785, 54427 |
| Visilizumab_HeavyChain1 | 934 | 8576, 16218, 23860, 31502, 39144, 46786, 54428 |
| Visilizumab_LightChain1 | 935 | 8577, 16219, 23861, 31503, 39145, 46787, 54429 |
| Volociximab_HeavyChain | 936 | 8578, 16220, 23862, 31504, 39146, 46788, 54430 |
| Volociximab_LightChain | 937 | 8579, 16221, 23863, 31505, 39147, 46789, 54431 |
| Vorsetuzumab_HeavyChain1 | 938 | 8580, 16222, 23864, 31506, 39148, 46790, 54432 |
| Vorsetuzumab_LightChain1 | 939 | 8581, 16223, 23865, 31507, 39149, 46791, 54433 |
| Vorsetuzumab_mafodotin_HeavyChain1 | 940 | 8582, 16224, 23866, 31508, 39150, 46792, 54434 |
| Vorsetuzumab_mafodotin_LightChain1 | 941 | 8583, 16225, 23867, 31509, 39151, 46793, 54435 |
| Yttrium_(90Y)_clivatuzumab_tetraxetan_HeavyChain1 | 942 | 8584, 16226, 23868, 31510, 39152, 46794, 54436 |
| Yttrium_(90Y)_clivatuzumab_tetraxetan_LightChain1 | 943 | 8585, 16227, 23869, 31511, 39153, 46795, 54437 |
| Yttrium_Y_90_epratuzumab_tetraxetan_HeavyChain1 | 944 | 8586, 16228, 23870, 31512, 39154, 46796, 54438 |
| Yttrium_Y_90_epratuzumab_tetraxetan_LightChain1 | 945 | 8587, 16229, 23871, 31513, 39155, 46797, 54439 |
| Yttrium_Y_90_epratuzumab_HeavyChain1 | 946 | 8588, 16230, 23872, 31514, 39156, 46798, 54440 |
| Yttrium_Y_90_epratuzumab_LightChain1 | 947 | 8589, 16231, 23873, 31515, 39157, 46799, 54441 |
| Zalutumumab_HeavyChain1 | 948 | 8590, 16232, 23874, 31516, 39158, 46800, 54442 |
| Zalutumumab_LightChain1 | 949 | 8591, 16233, 23875, 31517, 39159, 46801, 54443 |
| Zanolimumab_H0_HeavyChain | 950 | 8592, 16234, 23876, 31518, 39160, 46802, 54444 |
| Zanolimumab_L0_LightChain | 951 | 8593, 16235, 23877, 31519, 39161, 46803, 54445 |
| Zatuximab_HeavyChain1 | 952 | 8594, 16236, 23878, 31520, 39162, 46804, 54446 |
| Zatuximab_LightChain1 | 953 | 8595, 16237, 23879, 31521, 39163, 46805, 54447 |
| Actoxumab_HeavyChain | 954 | 8596, 16238, 23880, 31522, 39164, 49806, 54448 |
| Actoxumab_LightChain | 955 | 8597, 16239, 23881, 31523, 39165, 49807, 54449 |
| Andecaliximab_HeavyChain | 956 | 8598, 16240, 23882, 31524, 39166, 49808, 54450 |
| Andecaliximab_LightChain | 957 | 8599, 16241, 23883, 31525, 39167, 49809, 54451 |
| Aprutumab_HeavyChain | 958 | 8600, 16242, 23884, 31526, 39168, 49810, 54452 |
| Aprutumab_LightChain | 959 | 8601, 16243, 23885, 31527, 39169, 49811, 54453 |
| Azintuxizumab_HeavyChain | 960 | 8602, 16244, 23886, 31528, 39170, 49812, 54454 |
| Azintuxizumab_LightChain | 961 | 8603, 16245, 23887, 31529, 39171, 49813, 54455 |
| Blinatumomab_HeavyChain1 | 962 | 8604, 16246, 23888, 31530, 39172, 49814, 54456 |
| Blinatumomab_HeavyChain2 | 963 | 8605, 16247, 23889, 31531, 39173, 49815, 54457 |
| Blinatumomab_LightChain_HeavyChain_HeavyChain_LightChain | 964 | 8606, 16248, 23890, 31532, 39174, 49816, 54458 |
| Blinatumomab_LightChain1 | 965 | 8607, 16249, 23891, 31533, 39175, 49817, 54459 |
| Blinatumomab_LightChain2 | 966 | 8608, 16250, 23892, 31534, 39176, 49818, 54460 |
| Brazikumab_HeavyChain | 967 | 8609, 16251, 23893, 31535, 39177, 49819, 54461 |
| Brazikumab_LightChain | 968 | 8610, 16252, 23894, 31536, 39178, 49820, 54462 |
| Brolucizumab_HeavyChain | 969 | 8611, 16253, 23895, 31537, 39179, 49821, 54463 |
| Brolucizumab_LightChain | 970 | 8612, 16254, 23896, 31538, 39180, 49822, 54464 |
| Cabiralizumab_HeavyChain | 971 | 8613, 16255, 23897, 31539, 39181, 49823, 54465 |
| Cabiralizumab_LightChain | 972 | 8614, 16256, 23898, 31540, 39182, 49824, 54466 |
| Camrelizumab_HeavyChain | 973 | 8615, 16257, 23899, 31541, 39183, 49825, 54467 |
| Camrelizumab_LightChain | 974 | 8616, 16258, 23900, 31542, 39184, 49826, 54468 |
| Caplanizumab_HeavyChain | 975 | 8617, 16259, 23901, 31543, 39185, 49827, 54469 |
| Citatuzumab_bogatox_HeavyChain | 976 | 8618, 16260, 23902, 31544, 39186, 49828, 54470 |
| Cosfroviximab_HeavyChain | 977 | 8619, 16261, 23903, 31545, 39187, 49829, 54471 |
| Cosfroviximab_LightChain | 978 | 8620, 16262, 23904, 31546, 39188, 49830, 54472 |
| Crizanlizumab_HeavyChain | 979 | 8621, 16263, 23905, 31547, 39189, 49831, 54473 |
| Crizanlizumab_LightChain | 980 | 8622, 16264, 23906, 31548, 39190, 49832, 54474 |
| Crotedumab_HeavyChain | 981 | 8623, 16265, 23907, 31549, 39191, 49833, 54475 |
| Crotedumab_LightChain | 982 | 8624, 16266, 23908, 31550, 39192, 49834, 54476 |
| Dezamizumab_HeavyChain | 983 | 8625, 16267, 23909, 31551, 39193, 49835, 54477 |
| Dezamizumab_LightChain | 984 | 8626, 16268, 23910, 31552, 39194, 49836, 54478 |
| Duvortuxizumab_Chain1_scFv | 985 | 8627, 16269, 23911, 31553, 39195, 49837, 54479 |

TABLE 3-continued

RNA and amino acid sequences of exemplified antibodies

| Name | Protein SEQ ID NO | RNA SEQ ID NO |
|---|---|---|
| Duvortuxizumab_Chain2_scfv | 986 | 8628, 16270, 23912, 31554, 39196, 46838, 54480 |
| Duvortuxizumab_Chain3_h-CH2—CH3 | 987 | 8629, 16271, 23913, 31555, 39197, 46839, 54481 |
| Efungumab_HeavyChain | 988 | 8630, 16272, 23914, 31556, 39198, 46840, 54482 |
| Efungumab_HeavyChain_LightChain | 989 | 8631, 16273, 23915, 31557, 39199, 46841, 54483 |
| Efungumab_LightChain | 990 | 8632, 16274, 23916, 31558, 39200, 46842, 54484 |
| Elezanumab_HeavyChain | 991 | 8633, 16275, 23917, 31559, 39201, 46843, 54485 |
| Elezanumab_LightChain | 992 | 8634, 16276, 23918, 31560, 39202, 46844, 54486 |
| Emapalumab_HeavyChain | 993 | 8635, 16277, 23919, 31561, 39203, 46845, 54487 |
| Emapalumab_LightChain | 994 | 8636, 16278, 23920, 31562, 39204, 46846, 54488 |
| Enoblituzumab_HeavyChain | 995 | 8637, 16279, 23921, 31563, 39205, 46847, 54489 |
| Enoblituzumab_LightChain | 996 | 8638, 16280, 23922, 31564, 39206, 46848, 54490 |
| Eptinezumab_HeavyChain | 997 | 8639, 16281, 23923, 31565, 39207, 46849, 54491 |
| Eptinezumab_LightChain | 998 | 8640, 16282, 23924, 31566, 39208, 46850, 54492 |
| Erenumab_HeavyChain | 999 | 8641, 16283, 23925, 31567, 39209, 46851, 54493 |
| Erenumab_LightChain | 1000 | 8642, 16284, 23926, 31568, 39210, 46852, 54494 |
| Fremanezumab_HeavyChain | 1001 | 8643, 16285, 23927, 31569, 39211, 46853, 54495 |
| Fremanezumab_LightChain | 1002 | 8644, 16286, 23928, 31570, 39212, 46854, 54496 |
| Frunevetmab_HeavyChain | 1003 | 8645, 16287, 23929, 31571, 39213, 46855, 54497 |
| Frunevetmab_LightChain | 1004 | 8646, 16288, 23930, 31572, 39214, 46856, 54498 |
| Gatipotuzumab_HeavyChain | 1005 | 8647, 16289, 23931, 31573, 39215, 46857, 54499 |
| Gatipotuzumab_LightChain | 1006 | 8648, 16290, 23932, 31574, 39216, 46858, 54500 |
| Gedivumab_HeavyChain | 1007 | 8649, 16291, 23933, 31575, 39217, 46859, 54501 |
| Gedivumab_LightChain | 1008 | 8650, 16292, 23934, 31576, 39218, 46860, 54502 |
| Gemetuzumab_HeavyChain | 1009 | 8651, 16293, 23935, 31577, 39219, 46861, 54503 |
| Gemetuzumab_LightChain | 1010 | 8652, 16294, 23936, 31578, 39220, 46862, 54504 |
| Gilvetmab_HeavyChain | 1011 | 8653, 16295, 23937, 31579, 39221, 46863, 54505 |
| Gilvetmab_LightChain | 1012 | 8654, 16296, 23938, 31580, 39222, 46864, 54506 |
| Ifabotuzumab_HeavyChain | 1013 | 8655, 16297, 23939, 31581, 39223, 46865, 54507 |
| Ifabotuzumab_LightChain | 1014 | 8656, 16298, 23940, 31582, 39224, 46866, 54508 |
| Iratumumab_HeavyChain | 1015 | 8657, 16299, 23941, 31583, 39225, 46867, 54509 |
| Iratumumab_LightChain | 1016 | 8658, 16300, 23942, 31584, 39226, 46868, 54510 |
| Lacnotuzumab_HeavyChain | 1017 | 8659, 16301, 23943, 31585, 39227, 46869, 54511 |
| Lacnotuzumab_LightChain | 1018 | 8660, 16302, 23944, 31586, 39228, 46870, 54512 |
| Larcaviximab_HeavyChain | 1019 | 8661, 16303, 23945, 31587, 39229, 46871, 54513 |
| Larcaviximab_LightChain | 1020 | 8662, 16304, 23946, 31588, 39230, 46872, 54514 |
| Landalizumab_HeavyChain | 1021 | 8663, 16305, 23947, 31589, 39231, 46873, 54515 |
| Landalizumab_LightChain | 1022 | 8664, 16306, 23948, 31590, 39232, 46874, 54516 |
| Lesofavumab_HeavyChain | 1023 | 8665, 16307, 23949, 31591, 39233, 46875, 54517 |
| Lesofavumab_LightChain | 1024 | 8666, 16308, 23950, 31592, 39234, 46876, 54518 |
| Letolizumab_HeavyChain | 1025 | 8667, 16309, 23951, 31593, 39235, 46877, 54519 |
| Losatuxizumab_HeavyChain | 1026 | 8668, 16310, 23952, 31594, 39236, 46878, 54520 |
| Losatuxizumab_LightChain | 1027 | 8669, 16311, 23953, 31595, 39237, 46879, 54521 |
| Lupartumab_HeavyChain | 1028 | 8670, 16312, 23954, 31596, 39238, 46880, 54522 |
| Lupartumab_LightChain | 1029 | 8671, 16313, 23955, 31597, 39239, 46881, 54523 |
| Lutikizumab_HeavyChain | 1030 | 8672, 16314, 23956, 31598, 39240, 46882, 54524 |
| Lutikizumab_LightChain | 1031 | 8673, 16315, 23957, 31599, 39241, 46883, 54525 |
| Oleclumab_HeavyChain | 1032 | 8674, 16316, 23958, 31600, 39242, 46884, 54526 |
| Oleclumab_LightChain | 1033 | 8675, 16317, 23959, 31601, 39243, 46885, 54527 |
| Otlertuzumab_HeavyChain | 1034 | 8676, 16318, 23960, 31602, 39244, 46886, 54528 |
| Ozoralizumab_HeavyChain | 1035 | 8677, 16319, 23961, 31603, 39245, 46887, 54529 |
| Ozoralizumab_HeavyChain_HeavyChain_HeavyChain | 1036 | 8678, 16320, 23962, 31604, 39246, 46888, 54530 |
| Pasotuxizumab_HeavyChain_LightChain_HeavyChain_LightChain | 1037 | 8679, 16321, 23963, 31605, 39247, 46889, 54531 |
| Pasotuxizumab_HeavyChain1 | 1038 | 8680, 16322, 23964, 31606, 39248, 46890, 54532 |
| Pasotuxizumab_HeavyChain2 | 1039 | 8681, 16323, 23965, 31607, 39249, 46891, 54533 |
| Pasotuxizumab_LightChain1 | 1040 | 8682, 16324, 23966, 31608, 39250, 46892, 54534 |
| Pasotuxizumab_LightChain2 | 1041 | 8683, 16325, 23967, 31609, 39251, 46893, 54535 |
| Placulumab_HeavyChain | 1042 | 8684, 16326, 23968, 31610, 39252, 46894, 54536 |
| Porgaviximab_HeavyChain | 1043 | 8685, 16327, 23969, 31611, 39253, 46895, 54537 |
| Porgaviximab_LightChain | 1044 | 8686, 16328, 23970, 31612, 39254, 46896, 54538 |
| Prezalumab_HeavyChain | 1045 | 8687, 16329, 23971, 31613, 39255, 46897, 54539 |
| Prezalumab_LightChain | 1046 | 8688, 16330, 23972, 31614, 39256, 46898, 54540 |
| Radretumab_HeavyChain | 1047 | 8689, 16331, 23973, 31615, 39257, 46899, 54541 |
| Radretumab_HeavyChain_LightChain | 1048 | 8690, 16332, 23974, 31616, 39258, 46900, 54542 |
| Radretumab_LightChain | 1049 | 8691, 16333, 23975, 31617, 39259, 46901, 54543 |
| Ranevetmab_HeavyChain1 | 1050 | 8692, 16334, 23976, 31618, 39260, 46902, 54544 |
| Ranevetmab_HeavyChain2 | 1051 | 8693, 16335, 23977, 31619, 39261, 46903, 54545 |
| Ranevetmab_LightChain | 1052 | 8694, 16336, 23978, 31620, 39262, 46904, 54546 |
| Remtolumab_HeavyChain | 1053 | 8695, 16337, 23979, 31621, 39263, 46905, 54547 |
| Remtolumab_LightChain | 1054 | 8696, 16338, 23980, 31622, 39264, 46906, 54548 |
| Rosmantuzumab_HeavyChain | 1055 | 8697, 16339, 23981, 31623, 39265, 46907, 54549 |
| Rosmantuzumab_LightChain | 1056 | 8698, 16340, 23982, 31624, 39266, 46908, 54550 |
| Rozanolixizumab_HeavyChain | 1057 | 8699, 16341, 23983, 31625, 39267, 46909, 54551 |
| Rozanolixizumab_LightChain | 1058 | 8700, 16342, 23984, 31626, 39268, 46910, 54552 |
| Sapalizumab_HeavyChain | 1059 | 8701, 16343, 23985, 31627, 39269, 46911, 54553 |
| Sapalizumab_LightChain | 1060 | 8702, 16344, 23986, 31628, 39270, 46912, 54554 |

TABLE 3-continued

RNA and amino acid sequences of exemplified antibodies

| Name | Protein SEQ ID NO | RNA SEQ ID NO |
|---|---|---|
| Salicrelumab_HeavyChain | 1061 | 8703, 16345, 23987, 31629, 39271, 46913, 54555 |
| Salicrelumab_LightChain | 1062 | 8704, 16346, 23988, 31630, 39272, 46914, 54556 |
| Solitomab_HeavyChain1 | 1063 | 8705, 16347, 23989, 31631, 39273, 46915, 54557 |
| Solitomab_HeavyChain2 | 1064 | 8706, 16348, 23990, 31632, 39274, 46916, 54558 |
| Solitomab_LightChain_HeavyChain_HeavyChain_LightChain | 1065 | 8707, 16349, 23991, 31633, 39275, 46917, 54559 |
| Solitomab_LightChain1 | 1066 | 8708, 16350, 23992, 31634, 39276, 46918, 54560 |
| Solitomab_LightChain2 | 1067 | 8709, 16351, 23993, 31635, 39277, 46919, 54561 |
| Suptavumab_HeavyChain2 | 1068 | 8710, 16352, 23994, 31636, 39278, 46920, 54562 |
| Suvratoxumab_HeavyChain | 1069 | 8711, 16353, 23995, 31637, 39279, 46921, 54563 |
| Suvratoxumab_LightChain | 1070 | 8712, 16354, 23996, 31638, 39280, 46922, 54564 |
| Tadocizumab_LightChain | 1071 | 8713, 16355, 23997, 31639, 39281, 46923, 54565 |
| Tanezumab_HeavyChain | 1072 | 8714, 16356, 23998, 31640, 39282, 46924, 54566 |
| Tanezumab_LightChain | 1073 | 8715, 16357, 23999, 31641, 39283, 46925, 54567 |
| Tavolixizumab_HeavyChain | 1074 | 8716, 16358, 24000, 31642, 39284, 46926, 54568 |
| Tavolixizumab_LightChain | 1075 | 8717, 16359, 24001, 31643, 39285, 46927, 54569 |
| Telisotuzumab_HeavyChain | 1076 | 8718, 16360, 24002, 31644, 39286, 46928, 54570 |
| Telisotuzumab_LightChain | 1077 | 8719, 16361, 24003, 31645, 39287, 46929, 54571 |
| Telisotuzumab_vadotin_HeavyChain | 1078 | 8720, 16362, 24004, 31646, 39288, 46930, 54572 |
| Telisotuzumab_vadotin_LightChain | 1079 | 8721, 16363, 24005, 31647, 39289, 46931, 54573 |
| Timigutuzumab_HeavyChain | 1080 | 8722, 16364, 24006, 31648, 39290, 46932, 54574 |
| Timigutuzumab_LightChain | 1081 | 8723, 16365, 24007, 31649, 39291, 46933, 54575 |
| Timolumab_HeavyChain | 1082 | 8724, 16366, 24008, 31650, 39292, 46934, 54576 |
| Timolumab_LightChain | 1083 | 8725, 16367, 24009, 31651, 39293, 46935, 54577 |
| Tomuzotuximab_HeavyChain | 1084 | 8726, 16368, 24010, 31652, 39294, 46936, 54578 |
| Tomuzotuximab_LightChain | 1085 | 8727, 16369, 24011, 31653, 39295, 46937, 54579 |
| Trastuzumab_duocarmazine_HeavyChain | 1086 | 8728, 16370, 24012, 31654, 39296, 46938, 54580 |
| Trastuzumab_duocarmazine_LightChain | 1087 | 8729, 16371, 24013, 31655, 39297, 46939, 54581 |
| Varisacumab_HeavyChain | 1088 | 8730, 16372, 24014, 31656, 39298, 46940, 54582 |
| Varisacumab_LightChain | 1089 | 8731, 16373, 24015, 31657, 39299, 46941, 54583 |
| Vunakizumab_HeavyChain | 1090 | 8732, 16374, 24016, 31658, 39300, 46942, 54584 |
| Vunakizumab_LightChain | 1091 | 8733, 16375, 24017, 31659, 39301, 46943, 54585 |
| Xentuzumab_HeavyChain | 1092 | 8734, 16376, 24018, 31660, 39302, 46944, 54586 |
| Xentuzumab_LightChain | 1093 | 8735, 16377, 24019, 31661, 39303, 46945, 54587 |
| anti-rabies_S057_LightChain | 1094 | 8736, 16378, 24020, 31662, 39304, 46946, 54588 |
| anti-rabies_S057_HeavyChain | 1095 | 8737, 16379, 24021, 31663, 39305, 46947, 54589 |
| anti-rabies_S0JB_LightChain | 1096 | 8738, 16380, 24022, 31664, 39306, 46948, 54590 |
| anti-rabies_S0JB_HeavyChain | 1097 | 8739, 16381, 24023, 31665, 39307, 46949, 54591 |
| anti-rabies_S0JA_LightChain | 1098 | 8740, 16382, 24024, 31666, 39308, 46950, 54592 |
| anti-rabies_S0JA_HeavyChain | 1099 | 8741, 16383, 24025, 31667, 39309, 46951, 54593 |
| anti-rabies_LightChain | 1100 | 8742, 16384, 24026, 31668, 39310, 46952, 54594 |
| anti-rabies_HeavyChain | 1101 | 8743, 16385, 24027, 31669, 39311, 46953, 54595 |
| anti-rabies_LightChain | 1102 | 8744, 16386, 24028, 31670, 39312, 46954, 54596 |
| anti-rabies_HeavyChain | 1103 | 8745, 16387, 24029, 31671, 39313, 46955, 54597 |
| anti-RSV_5ITB_LightChain | 1104 | 8746, 16388, 24030, 31672, 39314, 46956, 54598 |
| anti-RSV_5ITB_HeavyChain | 1105 | 8747, 16389, 24031, 31673, 39315, 46957, 54599 |
| anti-alpha-toxin_4U6V_LightChain | 1106 | 8748, 16390, 24032, 31674, 39316, 46958, 54600 |
| anti-alpha-toxin_4U6V_HeavyChain | 1107 | 8749, 16391, 24033, 31675, 39317, 46959, 54601 |
| anti-alpha-toxin_4U6V_Chain-A | 1108 | 8750, 16392, 24034, 31676, 39318, 46960, 54602 |
| anti-alpha-toxin_4U6V_Chain-B | 1109 | 8751, 16393, 24035, 31677, 39319, 46961, 54603 |
| anti-lsdB_5D1Q_Chain-A | 1110 | 8752, 16394, 24036, 31678, 39320, 46962, 54604 |
| anti-lsdB_5D1Q_Chain-B | 1111 | 8753, 16395, 24037, 31679, 39321, 46963, 54605 |
| anti-lsdB_5D1Q_Chain-C | 1112 | 8754, 16396, 24038, 31680, 39322, 46964, 54606 |
| anti-lsdB_5D1Q_Chain-D | 1113 | 8755, 16397, 24039, 31681, 39323, 46965, 54607 |
| anti-lsdB_5D1Q_Chain-E | 1114 | 8756, 16398, 24040, 31682, 39324, 46966, 54608 |
| anti-lsdB_5D1X_Chain-A | 1115 | 8757, 16399, 24041, 31683, 39325, 46967, 54609 |
| anti-lsdB_5D1X_Chain-B | 1116 | 8758, 16400, 24042, 31684, 39326, 46968, 54610 |
| anti-lsdB_5D1X_Chain-C | 1117 | 8759, 16401, 24043, 31685, 39327, 46969, 54611 |
| anti-lsdB_5D1X_Chain-D | 1118 | 8760, 16402, 24044, 31686, 39328, 46970, 54612 |
| anti-lsdB_5D1X_Chain-E | 1119 | 8761, 16403, 24045, 31687, 39329, 46971, 54613 |
| anti-lsdB_5D1Z_Chain-B | 1120 | 8762, 16404, 24046, 31688, 39330, 46972, 54614 |
| anti-lsdB_5D1Z_Chain-C | 1121 | 8763, 16405, 24047, 31689, 39331, 46973, 54615 |
| anti-lsdB_5D1Z_Chain-D | 1122 | 8764, 16406, 24048, 31690, 39332, 46974, 54616 |
| anti-lsdB_5D1Z_Chain-F | 1123 | 8765, 16407, 24049, 31691, 39333, 46975, 54617 |
| anti-lsdB_5D1Z_Chain-G | 1124 | 8766, 16408, 24050, 31692, 39334, 46976, 54618 |
| anti-lsdB_5D1Z_HeavyChain | 1125 | 8767, 16409, 24051, 31693, 39335, 46977, 54619 |
| anti-lsdB_5D1Z_Chain-1 | 1126 | 8768, 16410, 24052, 31694, 39336, 46978, 54620 |
| anti-HIV_b12_LightChain | 1127 | 8769, 16411, 24053, 31695, 39337, 46979, 54621 |
| anti-HIV_b12_HeavyChain | 1128 | 8770, 16412, 24054, 31696, 39338, 46980, 54622 |
| anti-HIV_2GI2_LightChain | 1129 | 8771, 16413, 24055, 31697, 39339, 46981, 54623 |
| anti-HIV_2GI2_HeavyChain | 1130 | 8772, 16414, 24056, 31698, 39340, 46982, 54624 |
| anti-HIV_4E10_LightChain | 1131 | 8773, 16415, 24057, 31699, 39341, 46983, 54625 |
| anti-HIV_4E10_HeavyChain | 1132 | 8774, 16416, 24058, 31700, 39342, 46984, 54626 |
| anti-HIV_VRC01_LightChain | 1133 | 8775, 16417, 24059, 31701, 39343, 46985, 54627 |
| anti-HIV_VRC01_HeavyChain | 1134 | 8776, 16418, 24060, 31702, 39344, 46986, 54628 |
| anti-HIV_PG9_LightChain | 1135 | 8777, 16419, 24061, 31703, 39345, 46987, 54629 |
| anti-HIV_PG9_HeavyChain | 1136 | 8778, 16420, 24062, 31704, 39346, 46988, 54630 |

TABLE 3-continued

RNA and amino acid sequences of exemplified antibodies

| Name | Protein SEQ ID NO | RNA SEQ ID NO |
| --- | --- | --- |
| anti-HIV__VRC07__LightChain | 1137 | 8779, 16421, 24063, 31705, 39347, 46989, 54631 |
| anti-HIV__VRC07__HeavyChain | 1138 | 8780, 16422, 24064, 31706, 39348, 46990, 54632 |
| anti-HIV__3BNC117__LightChain | 1139 | 8781, 16423, 24065, 31707, 39349, 46991, 54633 |
| anti-HIV__3BNC117__HeavyChain | 1140 | 8782, 16424, 24066, 31708, 39350, 46992, 54634 |
| anti-HIV__10-1074__LightChain | 1141 | 8783, 16425, 24067, 31709, 39351, 46993, 54635 |
| anti-HIV__10-1074__HeavyChain | 1142 | 8784, 16426, 24068, 31710, 39352, 46994, 54636 |
| anti-HIV__PGT121__LightChain | 1143 | 8785, 16427, 24069, 31711, 39353, 46995, 54637 |
| anti-HIV__PGT121__HeavyChain | 1144 | 8786, 16428, 24070, 31712, 39354, 46996, 54638 |
| anti-HIV__PGDM1400__LightChain | 1145 | 8787, 16429, 24071, 31713, 39355, 46997, 54639 |
| anti-HIV__PGDM1400__HeavyChain | 1146 | 8788, 16430, 24072, 31714, 39356, 46998, 54640 |
| anti-HIV__N6__LightChain | 1147 | 8789, 16431, 24073, 31715, 39357, 46999, 54641 |
| anti-HIV__N6__HeavyChain | 1148 | 8790, 16432, 24074, 31716, 39358, 47000, 54642 |
| anti-HIV__N6__GChain | 1149 | 8791, 16433, 24075, 31717, 39359, 47001, 54643 |
| anti-HIV__10E8__LightChain | 1150 | 8792, 16434, 24076, 31718, 39360, 47002, 54644 |
| anti-HIV__10E8__HeavyChain | 1151 | 8793, 16435, 24077, 31719, 39361, 47003, 54645 |
| anti-HIV__12A12__LightChain | 1152 | 8794, 16436, 24078, 31720, 39362, 47004, 54646 |
| anti-HIV__12A12__HeavyChain | 1153 | 8795, 16437, 24079, 31721, 39363, 47005, 54647 |
| anti-HIV__12A21__LightChain | 1154 | 8796, 16438, 24080, 31722, 39364, 47006, 54648 |
| anti-HIV__12A21__HeavyChain | 1155 | 8797, 16439, 24081, 31723, 39365, 47007, 54649 |
| anti-HIV__35022__LightChain | 1156 | 8798, 16440, 24082, 31724, 39366, 47008, 54650 |
| anti-HIV__35022__HeavyChain | 1157 | 8799, 16441, 24083, 31725, 39367, 47009, 54651 |
| anti-HIV__38C176__LightChain | 1158 | 8800, 16442, 24084, 31726, 39368, 47010, 54652 |
| anti-HIV__38C176__HeavyChain | 1159 | 8801, 16443, 24085, 31727, 39369, 47011, 54653 |
| anti-HIV__3BNC55__LightChain | 1160 | 8802, 16444, 24086, 31728, 39370, 47012, 54654 |
| anti-HIV__3BNC55__HeavyChain | 1161 | 8803, 16445, 24087, 31729, 39371, 47013, 54655 |
| anti-HIV__3BNC60__LightChain | 1162 | 8804, 16446, 24088, 31730, 39372, 47014, 54656 |
| anti-HIV__3BNC60__HeavyChain | 1163 | 8805, 16447, 24089, 31731, 39373, 47015, 54657 |
| anti-HIV__3BNC60__HeavyChain | 1164 | 8806, 16448, 24090, 31732, 39374, 47016, 54658 |
| anti-HIV__447-520__LightChain | 1165 | 8807, 16449, 24091, 31733, 39375, 47017, 54659 |
| anti-HIV__447-520__HeavyChain | 1166 | 8808, 16450, 24092, 31734, 39376, 47018, 54660 |
| anti-HIV__447-520__LightChain | 1167 | 8809, 16451, 24093, 31735, 39377, 47019, 54661 |
| anti-HIV__447-520__HeavyChain | 1168 | 8810, 16452, 24094, 31736, 39378, 47020, 54662 |
| anti-HIV__5H/I1-BMV-D5__LightChain | 1169 | 8811, 16453, 24095, 31737, 39379, 47021, 54663 |
| anti-HIV__5H/I1-BMV-D5__HeavyChain | 1170 | 8812, 16454, 24096, 31738, 39380, 47022, 54664 |
| anti-HIV__5H/I1-BMV-D5__A-Chain | 1171 | 8813, 16455, 24097, 31739, 39381, 47023, 54665 |
| anti-HIV__8ANC195__LightChain | 1172 | 8814, 16456, 24098, 31740, 39382, 47024, 54666 |
| anti-HIV__8ANC195__HeavyChain | 1173 | 8815, 16457, 24099, 31741, 39383, 47025, 54667 |
| anti-HIV__CAP256-VRC26.01__LightChain | 1174 | 8816, 16458, 24100, 31742, 39384, 47026, 54668 |
| anti-HIV__CAP256-VRC26.01__HeavyChain | 1175 | 8817, 16459, 24101, 31743, 39385, 47027, 54669 |
| anti-HIV__CAP256-VRC26.02__LightChain | 1176 | 8818, 16460, 24102, 31744, 39386, 47028, 54670 |
| anti-HIV__CAP256-VRC26.02__HeavyChain | 1177 | 8819, 16461, 24103, 31745, 39387, 47029, 54671 |
| anti-HIV__CAP256-VRC26.03__LightChain | 1178 | 8820, 16462, 24104, 31746, 39388, 47030, 54672 |
| anti-HIV__CAP256-VRC26.03__HeavyChain | 1179 | 8821, 16463, 24105, 31747, 39389, 47031, 54673 |
| anti-HIV__CAP256-VRC26.04__LightChain | 1180 | 8822, 16464, 24106, 31748, 39390, 47032, 54674 |
| anti-HIV__CAP256-VRC26.04__HeavyChain | 1181 | 8823, 16465, 24107, 31749, 39391, 47033, 54675 |
| anti-HIV__CAP256-VRC26.05__LightChain | 1182 | 8824, 16466, 24108, 31750, 39392, 47034, 54676 |
| anti-HIV__CAP256-VRC26.05__HeavyChain | 1183 | 8825, 16467, 24109, 31751, 39393, 47035, 54677 |
| anti-HIV__CAP256-VRC26.06__LightChain | 1184 | 8826, 16468, 24110, 31752, 39394, 47036, 54678 |
| anti-HIV__CAP256-VRC26.06__HeavyChain | 1185 | 8827, 16469, 24111, 31753, 39395, 47037, 54679 |
| anti-HIV__CAP256-VRC26.07__LightChain | 1186 | 8828, 16470, 24112, 31754, 39396, 47038, 54680 |
| anti-HIV__CAP256-VRC26.07__HeavyChain | 1187 | 8829, 16471, 24113, 31755, 39397, 47039, 54681 |
| anti-HIV__CAP256-VRC26.08__LightChain | 1188 | 8830, 16472, 24114, 31756, 39398, 47040, 54682 |
| anti-HIV__CAP256-VRC26.08__HeavyChain | 1189 | 8831, 16473, 24115, 31757, 39399, 47041, 54683 |
| anti-HIV__CAP256-VRC26.09__LightChain | 1190 | 8832, 16474, 24116, 31758, 39400, 47042, 54684 |
| anti-HIV__CAP256-VRC26.09__HeavyChain | 1191 | 8833, 16475, 24117, 31759, 39401, 47043, 54685 |
| anti-HIV__CAP256-VRC26.10__LightChain | 1192 | 8834, 16476, 24118, 31760, 39402, 47044, 54686 |
| anti-HIV__CAP256-VRC26.10__HeavyChain | 1193 | 8835, 16477, 24119, 31761, 39403, 47045, 54687 |
| anti-HIV__CAP256-VRC26.11__LightChain | 1194 | 8836, 16478, 24120, 31762, 39404, 47046, 54688 |
| anti-HIV__CAP256-VRC26.11__HeavyChain | 1195 | 8837, 16479, 24121, 31763, 39405, 47047, 54689 |
| anti-HIV__CAP256-VRC26.12__LightChain | 1196 | 8838, 16480, 24122, 31764, 39406, 47048, 54690 |
| anti-HIV__CAP256-VRC26.12__HeavyChain | 1197 | 8839, 16481, 24123, 31765, 39407, 47049, 54691 |
| anti-HIV__CAP256-VRC26.11__LightChain | 1198 | 8840, 16482, 24124, 31766, 39408, 47050, 54692 |
| anti-HIV__CAP256-VRC26.11__HeavyChain | 1199 | 8841, 16483, 24125, 31767, 39409, 47051, 54693 |
| anti-HIV__CAP256-VRC26.12__LightChain | 1200 | 8842, 16484, 24126, 31768, 39410, 47052, 54694 |
| anti-HIV__CAP256-VRC26.12__HeavyChain | 1201 | 8843, 16485, 24127, 31769, 39411, 47053, 54695 |
| anti-HIV__CAP256-VRC26.UCA__LightChain | 1202 | 8844, 16486, 24128, 31770, 39412, 47054, 54696 |
| anti-HIV__CAP256-VRC26.UCA__HeavyChain | 1203 | 8845, 16487, 24129, 31771, 39413, 47055, 54697 |
| anti-HIV__CH01__LightChain | 1204 | 8846, 16488, 24130, 31772, 39414, 47056, 54698 |
| anti-HIV__CH01__HeavyChain | 1205 | 8847, 16489, 24131, 31773, 39415, 47057, 54699 |
| anti-HIV__CH02__LightChain | 1206 | 8848, 16490, 24132, 31774, 39416, 47058, 54700 |
| anti-HIV__CH02__HeavyChain | 1207 | 8849, 16491, 24133, 31775, 39417, 47059, 54701 |
| anti-HIV__CH03__LightChain | 1208 | 8850, 16492, 24134, 31776, 39418, 47060, 54702 |
| anti-HIV__CH03__HeavyChain | 1209 | 8851, 16493, 24135, 31777, 39419, 47061, 54703 |
| anti-HIV__CH04__LightChain | 1210 | 8852, 16494, 24136, 31778, 39420, 47062, 54704 |
| anti-HIV__CH04__HeavyChain | 1211 | 8853, 16495, 24137, 31779, 39421, 47063, 54705 |
| anti-HIV__CH103__LightChain | 1212 | 8854, 16496, 24138, 31780, 39422, 47064, 54706 |

TABLE 3-continued

RNA and amino acid sequences of exemplified antibodies

| Name | Protein SEQ ID NO | RNA SEQ ID NO |
| --- | --- | --- |
| anti-HIV__CH103__HeavyChain | 1213 | 8855, 16497, 24139, 31781, 39423, 47065, 54707 |
| anti-HIV__M66.6__LightChain | 1214 | 8856, 16498, 24140, 31782, 39424, 47066, 54708 |
| anti-HIV__M66.6__HeavyChain | 1215 | 8857, 16499, 24141, 31783, 39425, 47067, 54709 |
| anti-HIV__NIH45-46__LightChain | 1216 | 8858, 16500, 24142, 31784, 39426, 47068, 54710 |
| anti-HIV__NIH45-46__HeavyChain | 1217 | 8859, 16501, 24143, 31785, 39427, 47069, 54711 |
| anti-HIV__PG16__LightChain | 1218 | 8860, 16502, 24144, 31786, 39428, 47070, 54712 |
| anti-HIV__PG16__HeavyChain | 1219 | 8861, 16503, 24145, 31787, 39429, 47071, 54713 |
| anti-HIV__PGT122__LightChain | 1220 | 8862, 16504, 24146, 31788, 39430, 47072, 54714 |
| anti-HIV__PGT122__HeavyChain | 1221 | 8863, 16505, 24147, 31789, 39431, 47073, 54715 |
| anti-HIV__PGT123__LightChain | 1222 | 8864, 16506, 24148, 31790, 39432, 47074, 54716 |
| anti-HIV__PGT123__HeavyChain | 1223 | 8865, 16507, 24149, 31791, 39433, 47075, 54717 |
| anti-HIV__PGT125__LightChain | 1224 | 8866, 16508, 24150, 31792, 39434, 47076, 54718 |
| anti-HIV__PGT125__HeavyChain | 1225 | 8867, 16509, 24151, 31793, 39435, 47077, 54719 |
| anti-HIV__PGT126__LightChain | 1226 | 8868, 16510, 24152, 31794, 39436, 47078, 54720 |
| anti-HIV__PGT126__HeavyChain | 1227 | 8869, 16511, 24153, 31795, 39437, 47079, 54721 |
| anti-HIV__PGT127__LightChain | 1228 | 8870, 16512, 24154, 31796, 39438, 47080, 54722 |
| anti-HIV__PGT127__HeavyChain | 1229 | 8871, 16513, 24155, 31797, 39439, 47081, 54723 |
| anti-HIV__PGT128__LightChain | 1230 | 8872, 16514, 24156, 31798, 39440, 47082, 54724 |
| anti-HIV__PGT128__HeavyChain | 1231 | 8873, 16515, 24157, 31799, 39441, 47083, 54725 |
| anti-HIV__PGT130__LightChain | 1232 | 8874, 16516, 24158, 31800, 39442, 47084, 54726 |
| anti-HIV__PGT130__HeavyChain | 1233 | 8875, 16517, 24159, 31801, 39443, 47085, 54727 |
| anti-HIV__PGT131__LightChain | 1234 | 8876, 16518, 24160, 31802, 39444, 47086, 54728 |
| anti-HIV__PGT131__HeavyChain | 1235 | 8877, 16519, 24161, 31803, 39445, 47087, 54729 |
| anti-HIV__PGT135__LightChain | 1236 | 8878, 16520, 24162, 31804, 39446, 47088, 54730 |
| anti-HIV__PGT135__HeavyChain | 1237 | 8879, 16521, 24163, 31805, 39447, 47089, 54731 |
| anti-HIV__PGT136__LightChain | 1238 | 8880, 16522, 24164, 31806, 39448, 47090, 54732 |
| anti-HIV__PGT136__HeavyChain | 1239 | 8881, 16523, 24165, 31807, 39449, 47091, 54733 |
| anti-HIV__PGT137__LightChain | 1240 | 8882, 16524, 24166, 31808, 39450, 47092, 54734 |
| anti-HIV__PGT137__HeavyChain | 1241 | 8883, 16525, 24167, 31809, 39451, 47093, 54735 |
| anti-HIV__PGT141__LightChain | 1242 | 8884, 16526, 24168, 31810, 39452, 47094, 54736 |
| anti-HIV__PGT141__HeavyChain | 1243 | 8885, 16527, 24169, 31811, 39453, 47095, 54737 |
| anti-HIV__PGT142__LightChain | 1244 | 8886, 16528, 24170, 31812, 39454, 47096, 54738 |
| anti-HIV__PGT142__HeavyChain | 1245 | 8887, 16529, 24171, 31813, 39455, 47097, 54739 |
| anti-HIV__PGT143__LightChain | 1246 | 8888, 16530, 24172, 31814, 39456, 47098, 54740 |
| anti-HIV__PGT143__HeavyChain | 1247 | 8889, 16531, 24173, 31815, 39457, 47099, 54741 |
| anti-HIV__PGT144__LightChain | 1248 | 8890, 16532, 24174, 31816, 39458, 47100, 54742 |
| anti-HIV__PGT144__HeavyChain | 1249 | 8891, 16533, 24175, 31817, 39459, 47101, 54743 |
| anti-HIV__PGT145__LightChain | 1250 | 8892, 16534, 24176, 31818, 39460, 47102, 54744 |
| anti-HIV__PGT145__HeavyChain | 1251 | 8893, 16535, 24177, 31819, 39461, 47103, 54745 |
| anti-HIV__PGT151__LightChain | 1252 | 8894, 16536, 24178, 31820, 39462, 47104, 54746 |
| anti-HIV__PGT151__HeavyChain | 1253 | 8895, 16537, 24179, 31821, 39463, 47105, 54747 |
| anti-HIV__PGT152__LightChain | 1254 | 8896, 16538, 24180, 31822, 39464, 47106, 54748 |
| anti-HIV__PGT152__HeavyChain | 1255 | 8897, 16539, 24181, 31823, 39465, 47107, 54749 |
| anti-HIV_VRC-CH30__LightChain | 1256 | 8898, 16540, 24182, 31824, 39466, 47108, 54750 |
| anti-HIV_VRC-CH30__HeavyChain | 1257 | 8899, 16541, 24183, 31825, 39467, 47109, 54751 |
| anti-HIV_VRC-CH31__LightChain | 1258 | 8900, 16542, 24184, 31826, 39468, 47110, 54752 |
| anti-HIV_VRC-CH31__HeavyChain | 1259 | 8901, 16543, 24185, 31827, 39469, 47111, 54753 |
| anti-HIV_VRC-CH32__LightChain | 1250 | 8902, 16544, 24186, 31828, 39470, 47112, 54754 |
| anti-HIV_VRC-CH32__HeavyChain | 1251 | 8903, 16545, 24187, 31829, 39471, 47113, 54755 |
| anti-HIV_VRC-CH33__LightChain | 1252 | 8904, 16546, 24188, 31830, 39472, 47114, 54756 |
| anti-HIV_VRC-CH33__HeavyChain | 1253 | 8905, 16547, 24189, 31831, 39473, 47115, 54757 |
| anti-HIV_VRC-CH34__LightChain | 1254 | 8906, 16548, 24190, 31832, 39474, 47116, 54758 |
| anti-HIV_VRC-CH34__HeavyChain | 1255 | 8907, 16549, 24191, 31833, 39475, 47117, 54759 |
| anti-HIV_VRC-PG04__LightChain | 1256 | 8908, 16550, 24192, 31834, 39476, 47118, 54760 |
| anti-HIV_VRC-PG04__HeavyChain | 1257 | 8909, 16551, 24193, 31835, 39477, 47119, 54761 |
| anti-HIV_VRC-PG04b__LightChain | 1258 | 8910, 16552, 24194, 31836, 39478, 47120, 54762 |
| anti-HIV_VRC-PG04b__HeavyChain | 1259 | 8911, 16553, 24195, 31837, 39479, 47121, 54763 |
| anti-HIV_VRC-PG20__LightChain | 1270 | 8912, 16554, 24196, 31838, 39480, 47122, 54764 |
| anti-HIV_VRC-PG20__HeavyChain | 1271 | 8913, 16555, 24197, 31839, 39481, 47123, 54765 |
| anti-HIV_VRC-PG20__G-Chain | 1272 | 8914, 16556, 24198, 31840, 39482, 47124, 54766 |
| anti-HIV__VRC02__LightChain | 1273 | 8915, 16557, 24199, 31841, 39483, 47125, 54767 |
| anti-HIV__VRC02__HeavyChain | 1274 | 8916, 16558, 24200, 31842, 39484, 47126, 54768 |
| anti-HIV__VRC03__LightChain | 1275 | 8917, 16559, 24201, 31843, 39485, 47127, 54769 |
| anti-HIV__VRC03__HeavyChain | 1276 | 8918, 16560, 24202, 31844, 39486, 47128, 54770 |
| anti-HIV__VRC23__LightChain | 1277 | 8919, 16561, 24203, 31845, 39487, 47129, 54771 |
| anti-HIV__VRC23__HeavyChain | 1278 | 8920, 16562, 24204, 31846, 39488, 47130, 54772 |
| anti-HIV__VRC23__G-Chain | 1279 | 8921, 16563, 24205, 31847, 39489, 47131, 54773 |
| anti-HIV__5CCK__LightChain | 1280 | 8922, 16564, 24206, 31848, 39490, 47132, 54774 |
| anti-HIV__5CCK__HeavyChain | 1281 | 8923, 16565, 24207, 31849, 39491, 47133, 54775 |
| anti-HIV__5AWN__LightChain | 1282 | 8924, 16566, 24208, 31850, 39492, 47134, 54776 |
| anti-HIV__5AWN__HeavyChain | 1283 | 8925, 16567, 24209, 31851, 39493, 47135, 54777 |
| anti-HIV__3QEG__LightChain | 1284 | 8926, 16568, 24210, 31852, 39494, 47136, 54778 |
| anti-HIV__3QEG__HeavyChain | 1285 | 8927, 16569, 24211, 31853, 39495, 47137, 54779 |
| anti-HIV__INOX__K-Chain | 1286 | 8928, 16570, 24212, 31854, 39496, 47138, 54780 |
| anti-HIV__INOX__M-Chain | 1287 | 8929, 16571, 24213, 31855, 39497, 47139, 54781 |
| anti-HIV__3QEH__HeavyChain | 1288 | 8930, 16572, 24214, 31856, 39498, 47140, 54782 |

TABLE 3-continued

RNA and amino acid sequences of exemplified antibodies

| Name | Protein SEQ ID NO | RNA SEQ ID NO |
|---|---|---|
| anti-HIV__3QEH__G-Chain | 1289 | 8931, 16573, 24215, 31857, 39499, 47141, 54783 |
| anti-HIV__2BIH__HeavyChain | 1290 | 8932, 16574, 24216, 31858, 39500, 47142, 54784 |
| anti-HIV__2BIH__LightChain | 1291 | 8933, 16575, 24217, 31859, 39501, 47143, 54785 |
| anti-HIV__3TNM__B-Chain | 1292 | 8934, 16576, 24218, 31860, 39502, 47144, 54786 |
| anti-HIV__3TNM__A-Chain | 1293 | 8935, 16577, 24219, 31861, 39503, 47145, 54787 |
| anti-HIV__3UJJ__HeavyChain | 1294 | 8936, 16578, 24220, 31862, 39504, 47146, 54788 |
| anti-HIV__3UJJ__LightChain | 1295 | 8937, 16579, 24221, 31863, 39505, 47147, 54789 |
| anti-HIV__3UJI__HeavyChain | 1296 | 8938, 16580, 24222, 31864, 39506, 47148, 54790 |
| anti-HIV__3UJI__LightChain | 1297 | 8939, 16581, 24223, 31865, 39507, 47149, 54791 |
| anti-HIV__2QSC__HeavyChain | 1298 | 8940, 16582, 24224, 31866, 39508, 47150, 54792 |
| anti-HIV__2QSC__LightChain | 1299 | 8941, 16583, 24225, 31867, 39509, 47151, 54793 |
| anti-HIV__3MLZ__HeavyChain | 1300 | 8942, 16584, 24226, 31868, 39510, 47152, 54794 |
| anti-HIV__3MLZ__LightChain | 1301 | 8943, 16585, 24227, 31869, 39511, 47153, 54795 |
| anti-HIV__3MLX__I-Chain | 1302 | 8944, 16586, 24228, 31870, 39512, 47154, 54796 |
| anti-HIV__3MLX__M-Chain | 1303 | 8945, 16587, 24229, 31871, 39513, 47155, 54797 |
| anti-HIV__3MLW__I-Chain | 1304 | 8946, 16588, 24230, 31872, 39514, 47156, 54798 |
| anti-HIV__3MLW__M-Chain | 1305 | 8947, 16589, 24231, 31873, 39515, 47157, 54799 |
| anti-HIV__3MLV__N-Chain | 1306 | 8948, 16590, 24232, 31874, 39516, 47158, 54800 |
| anti-HIV__3MLV__M-Chain | 1307 | 8949, 16591, 24233, 31875, 39517, 47159, 54801 |
| anti-HIV__3MLU__LightChain | 1308 | 8950, 16592, 24234, 31876, 39518, 47160, 54802 |
| anti-HIV__3MLT__G-Chain | 1309 | 8951, 16593, 24235, 31877, 39519, 47161, 54803 |
| anti-HIV__3G01__HeavyChain | 1310 | 8952, 16594, 24236, 31878, 39520, 47162, 54804 |
| anti-HIV__3G01__LightChain | 1311 | 8953, 16595, 24237, 31879, 39521, 47163, 54805 |
| anti-HIV__4XCY__J-Chain | 1312 | 8954, 16596, 24238, 31880, 39522, 47164, 54806 |
| anti-HIV__4XCY__K-Chain | 1313 | 8955, 16597, 24239, 31881, 39523, 47165, 54807 |
| anti-HIV__4YBL__C-Chain | 1314 | 8956, 16598, 24240, 31882, 39524, 47166, 54808 |
| anti-HIV__4YBL__B-Chain | 1315 | 8957, 16599, 24241, 31883, 39525, 47167, 54809 |
| anti-HIV__4R4N__X-Chain | 1316 | 8958, 16600, 24242, 31884, 39526, 47168, 54810 |
| anti-HIV__4R4B__F-Chain | 1317 | 8959, 16601, 24243, 31885, 39527, 47169, 54811 |
| anti-HIV__3JUY__D-Chain | 1318 | 8960, 16602, 24244, 31886, 39528, 47170, 54812 |
| anti-HIV__4KG5__HeavyChain | 1319 | 8961, 16603, 24245, 31887, 39529, 47171, 54813 |
| anti-HIV__4KG5__LightChain | 1320 | 8962, 16604, 24246, 31888, 39530, 47172, 54814 |
| anti-HIV-1__LightChain | 1321 | 8963, 16605, 24247, 31889, 39531, 47173, 54815 |
| anti-HIV-1__LightChain | 1322 | 8964, 16606, 24248, 31890, 39532, 47174, 54816 |
| anti-HIV-1__LightChain | 1323 | 8965, 16607, 24249, 31891, 39533, 47175, 54817 |
| anti-HIV-1__LightChain | 1324 | 8966, 16608, 24250, 31892, 39534, 47176, 54818 |
| anti-HIV-1__LightChain | 1325 | 8967, 16609, 24251, 31893, 39535, 47177, 54819 |
| anti-HIV-1__LightChain | 1326 | 8968, 16610, 24252, 31894, 39536, 47178, 54820 |
| anti-HIV-1__HeavyChain | 1327 | 8969, 16611, 24253, 31895, 39537, 47179, 54821 |
| anti-HIV-1__HeavyChain | 1328 | 8970, 16612, 24254, 31896, 39538, 47180, 54822 |
| anti-HIV-1__HeavyChain | 1329 | 8971, 16613, 24255, 31897, 39539, 47181, 54823 |
| anti-HIV-1__HeavyChain | 1330 | 8972, 16614, 24256, 31898, 39540, 47182, 54824 |
| anti-HIV-1__HeavyChain | 1331 | 8973, 16615, 24257, 31899, 39541, 47183, 54825 |
| anti-HIV-1__HeavyChain | 1332 | 8974, 16616, 24258, 31900, 39542, 47184, 54826 |
| anti-HIV-1__HeavyChain | 1333 | 8975, 16617, 24259, 31901, 39543, 47185, 54827 |
| anti-HIV-1__HeavyChain | 1334 | 8976, 16618, 24260, 31902, 39544, 47186, 54828 |
| anti-HIV-1__HeavyChain | 1335 | 8977, 16619, 24261, 31903, 39545, 47187, 54829 |
| anti-HIV-1__HeavyChain | 1336 | 8978, 16620, 24262, 31904, 39546, 47188, 54830 |
| anti-HIV-1__LightChain | 1337 | 8979, 16621, 24263, 31905, 39547, 47189, 54831 |
| anti-HIV-1__LightChain | 1338 | 8980, 16622, 24264, 31906, 39548, 47190, 54832 |
| anti-HIV-1__LightChain | 1339 | 8981, 16623, 24265, 31907, 39549, 47191, 54833 |
| anti-HIV-1__LightChain | 1340 | 8982, 16624, 24266, 31908, 39550, 47192, 54834 |
| anti-HIV-1__LightChain | 1341 | 8983, 16625, 24267, 31909, 39551, 47193, 54835 |
| anti-HIV-1__LightChain | 1342 | 8984, 16626, 24268, 31910, 39552, 47194, 54836 |
| anti-HIV-1__LightChain | 1343 | 8985, 16627, 24269, 31911, 39553, 47195, 54837 |
| anti-HIV-1__LightChain | 1344 | 8986, 16628, 24270, 31912, 39554, 47196, 54838 |
| anti-HIV-1__HeavyChain | 1345 | 8987, 16629, 24271, 31913, 39555, 47197, 54839 |
| anti-HIV-1__HeavyChain | 1346 | 8988, 16630, 24272, 31914, 39556, 47198, 54840 |
| anti-HIV-1__HeavyChain | 1347 | 8989, 16631, 24273, 31915, 39557, 47199, 54841 |
| anti-HIV-1__HeavyChain | 1348 | 8990, 16632, 24274, 31916, 39558, 47200, 54842 |
| anti-HIV-1__HeavyChain | 1349 | 8991, 16633, 24275, 31917, 39559, 47201, 54843 |
| anti-HIV-1__HeavyChain | 1350 | 8992, 16634, 24276, 31918, 39560, 47202, 54844 |
| anti-HIV-1__HeavyChain | 1351 | 8993, 16635, 24277, 31919, 39561, 47203, 54845 |
| anti-HIV-1__HeavyChain | 1352 | 8994, 16636, 24278, 31920, 39562, 47204, 54846 |
| anti-HIV__V3__HeavyChain | 1353 | 8995, 16637, 24279, 31921, 39563, 47205, 54847 |
| anti-HIV__V3__HeavyChain | 1354 | 8996, 16638, 24280, 31922, 39564, 47206, 54848 |
| anti-HIV__V3__HeavyChain | 1355 | 8997, 16639, 24281, 31923, 39565, 47207, 54849 |
| anti-HIV__V3__HeavyChain | 1356 | 8998, 16640, 24282, 31924, 39566, 47208, 54850 |
| anti-HIV__V3__HeavyChain | 1357 | 8999, 16641, 24283, 31925, 39567, 47209, 54851 |
| anti-HIV__V3__HeavyChain | 1358 | 9000, 16642, 24284, 31926, 39568, 47210, 54852 |
| anti-HIV__V3__HeavyChain | 1359 | 9001, 16643, 24285, 31927, 39569, 47211, 54853 |
| anti-HIV__V3__HeavyChain | 1360 | 9002, 16644, 24286, 31928, 39570, 47212, 54854 |
| anti-HIV__V3__HeavyChain | 1361 | 9003, 16645, 24287, 31929, 39571, 47213, 54855 |
| anti-HIV__V3__HeavyChain | 1362 | 9004, 16646, 24288, 31930, 39572, 47214, 54856 |
| anti-HIV__V3__HeavyChain | 1363 | 9005, 16647, 24289, 31931, 39573, 47215, 54857 |
| anti-HIV__V3__HeavyChain | 1364 | 9006, 16648, 24290, 31932, 39574, 47216, 54858 |

TABLE 3-continued

RNA and amino acid sequences of exemplified antibodies

| Name | Protein SEQ ID NO | RNA SEQ ID NO |
|---|---|---|
| anti-HIV__CD4bs__HeavyChain | 1365 | 9007, 16649, 24291, 31933, 39575, 47217, 54859 |
| anti-HIV__CD4bs__HeavyChain | 1366 | 9008, 16650, 24292, 31934, 39576, 47218, 54860 |
| anti-HIV__CD4bs__HeavyChain | 1367 | 9009, 16651, 24293, 31935, 39577, 47219, 54861 |
| anti-HIV__CD4bs__HeavyChain | 1368 | 9010, 16652, 24294, 31936, 39578, 47220, 54862 |
| anti-HIV__CD4bs__HeavyChain | 1369 | 9011, 16653, 24295, 31937, 39579, 47221, 54863 |
| anti-HIV__CD4bs__HeavyChain | 1370 | 9012, 16654, 24296, 31938, 39580, 47222, 54864 |
| anti-HIV__CD4bs__HeavyChain | 1371 | 9013, 16655, 24297, 31939, 39581, 47223, 54865 |
| anti-HIV__CD4bs__HeavyChain | 1372 | 9014, 16656, 24298, 31940, 39582, 47224, 54866 |
| anti-HIV__CD4bs__HeavyChain | 1373 | 9015, 16657, 24299, 31941, 39583, 47225, 54867 |
| anti-HIV__CD4bs__HeavyChain | 1374 | 9016, 16658, 24300, 31942, 39584, 47226, 54868 |
| anti-HIV__V2__HeavyChain | 1375 | 9017, 16659, 24301, 31943, 39585, 47227, 54869 |
| anti-HIV__V2__HeavyChain | 1376 | 9018, 16660, 24302, 31944, 39586, 47228, 54870 |
| anti-HIV__V2__HeavyChain | 1377 | 9019, 16661, 24303, 31945, 39587, 47229, 54871 |
| anti-HIV__V2__HeavyChain | 1378 | 9020, 16662, 24304, 31946, 39588, 47230, 54872 |
| anti-HIV__V2__HeavyChain | 1379 | 9021, 16663, 24305, 31947, 39589, 47231, 54873 |
| anti-HIV__V2__HeavyChain | 1380 | 9022, 16664, 24306, 31948, 39590, 47232, 54874 |
| anti-HIV__V3__LightChain | 1381 | 9023, 16665, 24307, 31949, 39591, 47233, 54875 |
| anti-HIV__V3__LightChain | 1382 | 9024, 16666, 24308, 31950, 39592, 47234, 54876 |
| anti-HIV__V3__LightChain | 1383 | 9025, 16667, 24309, 31951, 39593, 47235, 54877 |
| anti-HIV__V3__LightChain | 1384 | 9026, 16668, 24310, 31952, 39594, 47236, 54878 |
| anti-HIV__V3__LightChain | 1385 | 9027, 16669, 24311, 31953, 39595, 47237, 54879 |
| anti-HIV__V3__LightChain | 1386 | 9028, 16670, 24312, 31954, 39596, 47238, 54880 |
| anti-HIV__V3__LightChain | 1387 | 9029, 16671, 24313, 31955, 39597, 47239, 54881 |
| anti-HIV__V3__LightChain | 1388 | 9030, 16672, 24314, 31956, 39598, 47240, 54882 |
| anti-HIV__V3__LightChain | 1389 | 9031, 16673, 24315, 31957, 39599, 47241, 54883 |
| anti-HIV__V3__LightChain | 1390 | 9032, 16674, 24316, 31958, 39600, 47242, 54884 |
| anti-HIV__V3__LightChain | 1391 | 9033, 16675, 24317, 31959, 39601, 47243, 54885 |
| anti-HIV__V3__LightChain | 1392 | 9034, 16676, 24318, 31960, 39602, 47244, 54886 |
| anti-HIV__V3__LightChain | 1393 | 9035, 16677, 24319, 31961, 39603, 47245, 54887 |
| anti-HIV__V3__LightChain | 1394 | 9036, 16678, 24320, 31962, 39604, 47246, 54888 |
| anti-HIV__V3__LightChain | 1395 | 9037, 16679, 24321, 31963, 39605, 47247, 54889 |
| anti-HIV__V3__LightChain | 1396 | 9038, 16680, 24322, 31964, 39606, 47248, 54890 |
| anti-HIV__V3__LightChain | 1397 | 9039, 16681, 24323, 31965, 39607, 47249, 54891 |
| anti-HIV__V3__LightChain | 1398 | 9040, 16682, 24324, 31966, 39608, 47250, 54892 |
| anti-HIV__V3__LightChain | 1399 | 9041, 16683, 24325, 31967, 39609, 47251, 54893 |
| anti-HIV__V3__LightChain | 1400 | 9042, 16684, 24326, 31968, 39610, 47252, 54894 |
| anti-HIV__V3__LightChain | 1401 | 9043, 16685, 24327, 31969, 39611, 47253, 54895 |
| anti-HIV__V3__LightChain | 1402 | 9044, 16686, 24328, 31970, 39612, 47254, 54896 |
| anti-HIV__V3__LightChain | 1403 | 9045, 16687, 24329, 31971, 39613, 47255, 54897 |
| anti-HIV__V3__LightChain | 1404 | 9046, 16688, 24330, 31972, 39614, 47256, 54898 |
| anti-HIV__V3__LightChain | 1405 | 9047, 16689, 24331, 31973, 39615, 47257, 54899 |
| anti-HIV__V3__LightChain | 1406 | 9048, 16690, 24332, 31974, 39616, 47258, 54900 |
| anti-HIV__V3__LightChain | 1407 | 9049, 16691, 24333, 31975, 39617, 47259, 54901 |
| anti-HIV__V3__LightChain | 1408 | 9050, 16692, 24334, 31976, 39618, 47260, 54902 |
| anti-HIV__V3__LightChain | 1409 | 9051, 16693, 24335, 31977, 39619, 47261, 54903 |
| anti-HIV__V3__LightChain | 1410 | 9052, 16694, 24336, 31978, 39620, 47262, 54904 |
| anti-HIV__CD4bs__LightChain | 1411 | 9053, 16695, 24337, 31979, 39621, 47263, 54905 |
| anti-HIV__CD4bs__LightChain | 1412 | 9054, 16696, 24338, 31980, 39622, 47264, 54906 |
| anti-HIV__CD4bs__LightChain | 1413 | 9055, 16697, 24339, 31981, 39623, 47265, 54907 |
| anti-HIV__CD4bs__LightChain | 1414 | 9056, 16698, 24340, 31982, 39624, 47266, 54908 |
| anti-HIV__CD4bs__LightChain | 1415 | 9057, 16699, 24341, 31983, 39625, 47267, 54909 |
| anti-HIV__CD4bs__LightChain | 1416 | 9058, 16700, 24342, 31984, 39626, 47268, 54910 |
| anti-HIV__CD4bs__LightChain | 1417 | 9059, 16701, 24343, 31985, 39627, 47269, 54911 |
| anti-HIV__CD4bs__LightChain | 1418 | 9060, 16702, 24344, 31986, 39628, 47270, 54912 |
| anti-HIV__CD4bs__LightChain | 1419 | 9061, 16703, 24345, 31987, 39629, 47271, 54913 |
| anti-HIV__CD4bs__LightChain | 1420 | 9062, 16704, 24346, 31988, 39630, 47272, 54914 |
| anti-HIV__V2__LightChain | 1421 | 9063, 16705, 24347, 31989, 39631, 47273, 54915 |
| anti-HIV__V2__LightChain | 1422 | 9064, 16706, 24348, 31990, 39632, 47274, 54916 |
| anti-HIV__V2__LightChain | 1423 | 9065, 16707, 24349, 31991, 39633, 47275, 54917 |
| anti-HIV__V2__LightChain | 1424 | 9066, 16708, 24350, 31992, 39634, 47276, 54918 |
| anti-HIV__V2__LightChain | 1425 | 9067, 16709, 24351, 31993, 39635, 47277, 54919 |
| anti-HIV__V2__LightChain | 1426 | 9068, 16710, 24352, 31994, 39636, 47278, 54920 |
| anti-HIV__10E8 | 1427 | 9069, 16711, 24353, 31995, 39637, 47279, 54921 |
| anti-HIV__10E8 | 1428 | 9070, 16712, 24354, 31996, 39638, 47280, 54922 |
| anti-HIV__10E8 | 1429 | 9071, 16713, 24355, 31997, 39639, 47281, 54923 |
| anti-HIV__10E8 | 1430 | 9072, 16714, 24356, 31998, 39640, 47282, 54924 |
| anti-HIV__10E8 | 1431 | 9073, 16715, 24357, 31999, 39641, 47283, 54925 |
| anti-HIV__10E8 | 1432 | 9074, 16716, 24358, 32000, 39642, 47284, 54926 |
| anti-HIV__10E8 | 1433 | 9075, 16717, 24359, 32001, 39643, 47285, 54927 |
| anti-HIV__10E8 | 1434 | 9076, 16718, 24360, 32002, 39644, 47286, 54928 |
| anti-HIV__10E8 | 1435 | 9077, 16719, 24361, 32003, 39645, 47287, 54929 |
| anti-HIV__10E8 | 1436 | 9078, 16720, 24362, 32004, 39646, 47288, 54930 |
| anti-HIV__10E8 | 1437 | 9079, 16721, 24363, 32005, 39647, 47289, 54931 |
| anti-HIV__10E8 | 1438 | 9080, 16722, 24364, 32006, 39648, 47290, 54932 |
| anti-HIV__10E8 | 1439 | 9081, 16723, 24365, 32007, 39649, 47291, 54933 |
| anti-HIV__10E8 | 1440 | 9082, 16724, 24366, 32008, 39650, 47292, 54934 |

TABLE 3-continued

RNA and amino acid sequences of exemplified antibodies

| Name | Protein SEQ ID NO | RNA SEQ ID NO |
|---|---|---|
| anti-HIV_10E8 | 1441 | 9083, 16725, 24367, 32009, 39651, 47293, 54935 |
| anti-HIV_10E8 | 1442 | 9084, 16726, 24368, 32010, 39652, 47294, 54936 |
| anti-HIV_10E8 | 1443 | 9085, 16727, 24369, 32011, 39653, 47295, 54937 |
| anti-HIV_10E8 | 1444 | 9086, 16728, 24370, 32012, 39654, 47296, 54938 |
| anti-HIV_10E8 | 1445 | 9087, 16729, 24371, 32013, 39655, 47297, 54939 |
| anti-HIV_10E8 | 1446 | 9088, 16730, 24372, 32014, 39656, 47298, 54940 |
| anti-HIV_10E8 | 1447 | 9089, 16731, 24373, 32015, 39657, 47299, 54941 |
| anti-HIV_10E8 | 1448 | 9090, 16732, 24374, 32016, 39658, 47300, 54942 |
| anti-HIV_10E8 | 1449 | 9091, 16733, 24375, 32017, 39659, 47301, 54943 |
| anti-HIV_10E8 | 1450 | 9092, 16734, 24376, 32018, 39660, 47302, 54944 |
| anti-HIV_10E8 | 1451 | 9093, 16735, 24377, 32019, 39661, 47303, 54945 |
| anti-HIV_10E8 | 1452 | 9094, 16736, 24378, 32020, 39662, 47304, 54946 |
| anti-HIV_10E8 | 1453 | 9095, 16737, 24379, 32021, 39663, 47305, 54947 |
| anti-HIV_10E8 | 1454 | 9096, 16738, 24380, 32022, 39664, 47306, 54948 |
| anti-HIV_10E8 | 1455 | 9097, 16739, 24381, 32023, 39665, 47307, 54949 |
| anti-HIV_10E8 | 1456 | 9098, 16740, 24382, 32024, 39666, 47308, 54950 |
| anti-HIV_10E8 | 1457 | 9099, 16741, 24383, 32025, 39667, 47309, 54951 |
| anti-HIV_10E8 | 1458 | 9100, 16742, 24384, 32026, 39668, 47310, 54952 |
| anti-HIV-1_LightChain | 1459 | 9101, 16743, 24385, 32027, 39669, 47311, 54953 |
| anti-HIV-1_LightChain | 1460 | 9102, 16744, 24386, 32028, 39670, 47312, 54954 |
| anti-HIV-1_LightChain | 1461 | 9103, 16745, 24387, 32029, 39671, 47313, 54955 |
| anti-HIV-1_LightChain | 1462 | 9104, 16746, 24388, 32030, 39672, 47314, 54956 |
| anti-HIV-1_LightChain | 1463 | 9105, 16747, 24389, 32031, 39673, 47315, 54957 |
| anti-HIV-1_LightChain | 1464 | 9106, 16748, 24390, 32032, 39674, 47316, 54958 |
| anti-HIV-1_LightChain | 1465 | 9107, 16749, 24391, 32033, 39675, 47317, 54959 |
| anti-HIV-1_LightChain | 1466 | 9108, 16750, 24392, 32034, 39676, 47318, 54960 |
| anti-HIV-1_LightChain | 1467 | 9109, 16751, 24393, 32035, 39677, 47319, 54961 |
| anti-HIV-1_LightChain | 1468 | 9110, 16752, 24394, 32036, 39678, 47320, 54962 |
| anti-HIV-1_LightChain | 1469 | 9111, 16753, 24395, 32037, 39679, 47321, 54963 |
| anti-HIV-1_LightChain | 1470 | 9112, 16754, 24396, 32038, 39680, 47322, 54964 |
| anti-HIV-1_LightChain | 1471 | 9113, 16755, 24397, 32039, 39681, 47323, 54965 |
| anti-HIV-1_LightChain | 1472 | 9114, 16756, 24398, 32040, 39682, 47324, 54966 |
| anti-HIV-1_LightChain | 1473 | 9115, 16757, 24399, 32041, 39683, 47325, 54967 |
| anti-HIV-1_LightChain | 1474 | 9116, 16758, 24400, 32042, 39684, 47326, 54968 |
| anti-HIV-1_LightChain | 1475 | 9117, 16759, 24401, 32043, 39685, 47327, 54969 |
| anti-HIV-1_LightChain | 1476 | 9118, 16760, 24402, 32044, 39686, 47328, 54970 |
| anti-HIV-1_LightChain | 1477 | 9119, 16761, 24403, 32045, 39687, 47329, 54971 |
| anti-HIV-1_LightChain | 1478 | 9120, 16762, 24404, 32046, 39688, 47330, 54972 |
| anti-HIV-1_LightChain | 1479 | 9121, 16763, 24405, 32047, 39689, 47331, 54973 |
| anti-HIV-1_LightChain | 1480 | 9122, 16764, 24406, 32048, 39690, 47332, 54974 |
| anti-HIV-1_LightChain | 1481 | 9123, 16765, 24407, 32049, 39691, 47333, 54975 |
| anti-HIV-1_LightChain | 1482 | 9124, 16766, 24408, 32050, 39692, 47334, 54976 |
| anti-HIV-1_LightChain | 1483 | 9125, 16767, 24409, 32051, 39693, 47335, 54977 |
| anti-HIV-1_LightChain | 1484 | 9126, 16768, 24410, 32052, 39694, 47336, 54978 |
| anti-HIV-1_LightChain | 1485 | 9127, 16769, 24411, 32053, 39695, 47337, 54979 |
| anti-HIV-1_LightChain | 1486 | 9128, 16770, 24412, 32054, 39696, 47338, 54980 |
| anti-HIV-1_LightChain | 1487 | 9129, 16771, 24413, 32055, 39697, 47339, 54981 |
| anti-HIV-1_LightChain | 1488 | 9130, 16772, 24414, 32056, 39698, 47340, 54982 |
| anti-HIV-1_LightChain | 1489 | 9131, 16773, 24415, 32057, 39699, 47341, 54983 |
| anti-HIV-1_LightChain | 1490 | 9132, 16774, 24416, 32058, 39700, 47342, 54984 |
| anti-HIV-1_LightChain | 1491 | 9133, 16775, 24417, 32059, 39701, 47343, 54985 |
| anti-HIV-1_LightChain | 1492 | 9134, 16776, 24418, 32060, 39702, 47344, 54986 |
| anti-HIV-1_LightChain | 1493 | 9135, 16777, 24419, 32061, 39703, 47345, 54987 |
| anti-HIV-1_LightChain | 1494 | 9136, 16778, 24420, 32062, 39704, 47346, 54988 |
| anti-HIV-1_LightChain | 1495 | 9137, 16779, 24421, 32063, 39705, 47347, 54989 |
| anti-HIV-1_LightChain | 1496 | 9138, 16780, 24422, 32064, 39706, 47348, 54990 |
| anti-HIV-1_LightChain | 1497 | 9139, 16781, 24423, 32065, 39707, 47349, 54991 |
| anti-HIV-1_LightChain | 1498 | 9140, 16782, 24424, 32066, 39708, 47350, 54992 |
| anti-HIV-1_LightChain | 1499 | 9141, 16783, 24425, 32067, 39709, 47351, 54993 |
| anti-HIV-1_LightChain | 1500 | 9142, 16784, 24426, 32068, 39710, 47352, 54994 |
| anti-HIV-1_LightChain | 1501 | 9143, 16785, 24427, 32069, 39711, 47353, 54995 |
| anti-HIV-1_LightChain | 1502 | 9144, 16786, 24428, 32070, 39712, 47354, 54996 |
| anti-HIV-1_LightChain | 1503 | 9145, 16787, 24429, 32071, 39713, 47355, 54997 |
| anti-HIV-1_LightChain | 1504 | 9146, 16788, 24430, 32072, 39714, 47356, 54998 |
| anti-HIV-1_LightChain | 1505 | 9147, 16789, 24431, 32073, 39715, 47357, 54999 |
| anti-HIV-1_LightChain | 1506 | 9148, 16790, 24432, 32074, 39716, 47358, 55000 |
| anti-HIV-1_LightChain | 1507 | 9149, 16791, 24433, 32075, 39717, 47359, 55001 |
| anti-HIV-1_LightChain | 1508 | 9150, 16792, 24434, 32076, 39718, 47360, 55002 |
| anti-HIV-1_LightChain | 1509 | 9151, 16793, 24435, 32077, 39719, 47361, 55003 |
| anti-HIV-1_LightChain | 1510 | 9152, 16794, 24436, 32078, 39720, 47362, 55004 |
| anti-HIV-1_LightChain | 1511 | 9153, 16795, 24437, 32079, 39721, 47363, 55005 |
| anti-HIV-1_LightChain | 1512 | 9154, 16796, 24438, 32080, 39722, 47364, 55006 |
| anti-HIV-1_LightChain | 1513 | 9155, 16797, 24439, 32081, 39723, 47365, 55007 |
| anti-HIV-1_LightChain | 1514 | 9156, 16798, 24440, 32082, 39724, 47366, 55008 |
| anti-HIV-1_LightChain | 1515 | 9157, 16799, 24441, 32083, 39725, 47367, 55009 |
| anti-HIV-1_LightChain | 1516 | 9158, 16800, 24442, 32084, 39726, 47368, 55010 |

TABLE 3-continued

RNA and amino acid sequences of exemplified antibodies

| Name | Protein SEQ ID NO | RNA SEQ ID NO |
| --- | --- | --- |
| anti-HIV-1_LightChain | 1517 | 9159, 16801, 24443, 32085, 39727, 47369, 55011 |
| anti-HIV-1_LightChain | 1518 | 9160, 16802, 24444, 32086, 39728, 47370, 55012 |
| anti-HIV-1_LightChain | 1519 | 9161, 16803, 24445, 32087, 39729, 47371, 55013 |
| anti-HIV-1_LightChain | 1520 | 9162, 16804, 24446, 32088, 39730, 47372, 55014 |
| anti-HIV-1_LightChain | 1521 | 9163, 16805, 24447, 32089, 39731, 47373, 55015 |
| anti-HIV-1_LightChain | 1522 | 9164, 16806, 24448, 32090, 39732, 47374, 55016 |
| anti-HIV-1_LightChain | 1523 | 9165, 16807, 24449, 32091, 39733, 47375, 55017 |
| anti-HIV-1_LightChain | 1524 | 9166, 16808, 24450, 32092, 39734, 47376, 55018 |
| anti-HIV-1_LightChain | 1525 | 9167, 16809, 24451, 32093, 39735, 47377, 55019 |
| anti-HIV-1_LightChain | 1526 | 9168, 16810, 24452, 32094, 39736, 47378, 55020 |
| anti-HIV-1_LightChain | 1527 | 9169, 16811, 24453, 32095, 39737, 47379, 55021 |
| anti-HIV-1_LightChain | 1528 | 9170, 16812, 24454, 32096, 39738, 47380, 55022 |
| anti-HIV-1_LightChain | 1529 | 9171, 16813, 24455, 32097, 39739, 47381, 55023 |
| anti-HIV-1_LightChain | 1530 | 9172, 16814, 24456, 32098, 39740, 47382, 55024 |
| anti-HIV-1_LightChain | 1531 | 9173, 16815, 24457, 32099, 39741, 47383, 55025 |
| anti-HIV-1_LightChain | 1532 | 9174, 16816, 24458, 32100, 39742, 47384, 55026 |
| anti-HIV-1_LightChain | 1533 | 9175, 16817, 24459, 32101, 39743, 47385, 55027 |
| anti-HIV-1_LightChain | 1534 | 9176, 16818, 24460, 32102, 39744, 47386, 55028 |
| anti-HIV-1_LightChain | 1535 | 9177, 16819, 24461, 32103, 39745, 47387, 55029 |
| anti-HIV-1_LightChain | 1536 | 9178, 16820, 24462, 32104, 39746, 47388, 55030 |
| anti-HIV-1_LightChain | 1537 | 9179, 16821, 24463, 32105, 39747, 47389, 55031 |
| anti-HIV-1_LightChain | 1538 | 9180, 16822, 24464, 32106, 39748, 47390, 55032 |
| anti-HIV-1_LightChain | 1539 | 9181, 16823, 24465, 32107, 39749, 47391, 55033 |
| anti-HIV-1_LightChain | 1540 | 9182, 16824, 24466, 32108, 39750, 47392, 55034 |
| anti-HIV-1_LightChain | 1541 | 9183, 16825, 24467, 32109, 39751, 47393, 55035 |
| anti-HIV-1_LightChain | 1542 | 9184, 16826, 24468, 32110, 39752, 47394, 55036 |
| anti-HIV-1_LightChain | 1543 | 9185, 16827, 24469, 32111, 39753, 47395, 55037 |
| anti-HIV-1_LightChain | 1544 | 9186, 16828, 24470, 32112, 39754, 47396, 55038 |
| anti-HIV-1_LightChain | 1545 | 9187, 16829, 24471, 32113, 39755, 47397, 55039 |
| anti-HIV-1_LightChain | 1546 | 9188, 16830, 24472, 32114, 39756, 47398, 55040 |
| anti-HIV-1_LightChain | 1547 | 9189, 16831, 24473, 32115, 39757, 47399, 55041 |
| anti-HIV-1_LightChain | 1548 | 9190, 16832, 24474, 32116, 39758, 47400, 55042 |
| anti-HIV-1_LightChain | 1549 | 9191, 16833, 24475, 32117, 39759, 47401, 55043 |
| anti-HIV-1_LightChain | 1550 | 9192, 16834, 24476, 32118, 39760, 47402, 55044 |
| anti-HIV-1_LightChain | 1551 | 9193, 16835, 24477, 32119, 39761, 47403, 55045 |
| anti-HIV-1_LightChain | 1552 | 9194, 16836, 24478, 32120, 39762, 47404, 55046 |
| anti-HIV-1_LightChain | 1553 | 9195, 16837, 24479, 32121, 39763, 47405, 55047 |
| anti-HIV-1_LightChain | 1554 | 9196, 16838, 24480, 32122, 39764, 47406, 55048 |
| anti-HIV-1_LightChain | 1555 | 9197, 16839, 24481, 32123, 39765, 47407, 55049 |
| anti-HIV-1_LightChain | 1556 | 9198, 16840, 24482, 32124, 39766, 47408, 55050 |
| anti-HIV-1_LightChain | 1557 | 9199, 16841, 24483, 32125, 39767, 47409, 55051 |
| anti-HIV-1_LightChain | 1558 | 9200, 16842, 24484, 32126, 39768, 47410, 55052 |
| anti-HIV-1_LightChain | 1559 | 9201, 16843, 24485, 32127, 39769, 47411, 55053 |
| anti-HIV-1_LightChain | 1560 | 9202, 16844, 24486, 32128, 39770, 47412, 55054 |
| anti-HIV-1_LightChain | 1561 | 9203, 16845, 24487, 32129, 39771, 47413, 55055 |
| anti-HIV-1_LightChain | 1562 | 9204, 16846, 24488, 32130, 39772, 47414, 55056 |
| anti-HIV-1_LightChain | 1563 | 9205, 16847, 24489, 32131, 39773, 47415, 55057 |
| anti-HIV-1_LightChain | 1564 | 9206, 16848, 24490, 32132, 39774, 47416, 55058 |
| anti-HIV-1_LightChain | 1565 | 9207, 16849, 24491, 32133, 39775, 47417, 55059 |
| anti-HIV-1_LightChain | 1566 | 9208, 16850, 24492, 32134, 39776, 47418, 55060 |
| anti-HIV-1_LightChain | 1567 | 9209, 16851, 24493, 32135, 39777, 47419, 55061 |
| anti-HIV-1_LightChain | 1568 | 9210, 16852, 24494, 32136, 39778, 47420, 55062 |
| anti-HIV-1_LightChain | 1569 | 9211, 16853, 24495, 32137, 39779, 47421, 55063 |
| anti-HIV-1_LightChain | 1570 | 9212, 16854, 24496, 32138, 39780, 47422, 55064 |
| anti-HIV-1_LightChain | 1571 | 9213, 16855, 24497, 32139, 39781, 47423, 55065 |
| anti-HIV-1_LightChain | 1572 | 9214, 16856, 24498, 32140, 39782, 47424, 55066 |
| anti-HIV-1_LightChain | 1573 | 9215, 16857, 24499, 32141, 39783, 47425, 55067 |
| anti-HIV-1_LightChain | 1574 | 9216, 16858, 24500, 32142, 39784, 47426, 55068 |
| anti-HIV-1_LightChain | 1575 | 9217, 16859, 24501, 32143, 39785, 47427, 55069 |
| anti-HIV-1_LightChain | 1576 | 9218, 16860, 24502, 32144, 39786, 47428, 55070 |
| anti-HIV-1_LightChain | 1577 | 9219, 16861, 24503, 32145, 39787, 47429, 55071 |
| anti-HIV-1_LightChain | 1578 | 9220, 16862, 24504, 32146, 39788, 47430, 55072 |
| anti-HIV-1_LightChain | 1579 | 9221, 16863, 24505, 32147, 39789, 47431, 55073 |
| anti-HIV-1_LightChain | 1580 | 9222, 16864, 24506, 32148, 39790, 47432, 55074 |
| anti-HIV-1_LightChain | 1581 | 9223, 16865, 24507, 32149, 39791, 47433, 55075 |
| anti-HIV-1_LightChain | 1582 | 9224, 16866, 24508, 32150, 39792, 47434, 55076 |
| anti-HIV-1_LightChain | 1583 | 9225, 16867, 24509, 32151, 39793, 47435, 55077 |
| anti-HIV-1_LightChain | 1584 | 9226, 16868, 24510, 32152, 39794, 47436, 55078 |
| anti-HIV-1_LightChain | 1585 | 9227, 16869, 24511, 32153, 39795, 47437, 55079 |
| anti-HIV-1_LightChain | 1586 | 9228, 16870, 24512, 32154, 39796, 47438, 55080 |
| anti-HIV-1_LightChain | 1587 | 9229, 16871, 24513, 32155, 39797, 47439, 55081 |
| anti-HIV-1_LightChain | 1588 | 9230, 16872, 24514, 32156, 39798, 47440, 55082 |
| anti-HIV-1_LightChain | 1589 | 9231, 16873, 24515, 32157, 39799, 47441, 55083 |
| anti-HIV-1_LightChain | 1590 | 9232, 16874, 24516, 32158, 39800, 47442, 55084 |
| anti-HIV-1_LightChain | 1591 | 9233, 16875, 24517, 32159, 39801, 47443, 55085 |
| anti-HIV-1_LightChain | 1592 | 9234, 16876, 24518, 32160, 39802, 47444, 55086 |

TABLE 3-continued

RNA and amino acid sequences of exemplified antibodies

| Name | Protein SEQ ID NO | RNA SEQ ID NO |
| --- | --- | --- |
| anti-HIV-1_LightChain | 1593 | 9235, 16877, 24519, 32161, 39803, 47445, 55087 |
| anti-HIV-1_LightChain | 1594 | 9236, 16878, 24520, 32162, 39804, 47446, 55088 |
| anti-HIV-1_LightChain | 1595 | 9237, 16879, 24521, 32163, 39805, 47447, 55089 |
| anti-HIV-1_LightChain | 1596 | 9238, 16880, 24522, 32164, 39806, 47448, 55090 |
| anti-HIV-1_LightChain | 1597 | 9239, 16881, 24523, 32165, 39807, 47449, 55091 |
| anti-HIV-1_LightChain | 1598 | 9240, 16882, 24524, 32166, 39808, 47450, 55092 |
| anti-HIV-1_LightChain | 1599 | 9241, 16883, 24525, 32167, 39809, 47451, 55093 |
| anti-HIV-1_LightChain | 1600 | 9242, 16884, 24526, 32168, 39810, 47452, 55094 |
| anti-HIV-1_LightChain | 1601 | 9243, 16885, 24527, 32169, 39811, 47453, 55095 |
| anti-HIV-1_LightChain | 1602 | 9244, 16886, 24528, 32170, 39812, 47454, 55096 |
| anti-HIV-1_LightChain | 1603 | 9245, 16887, 24529, 32171, 39813, 47455, 55097 |
| anti-HIV-1_LightChain | 1604 | 9246, 16888, 24530, 32172, 39814, 47456, 55098 |
| anti-HIV-1_LightChain | 1605 | 9247, 16889, 24531, 32173, 39815, 47457, 55099 |
| anti-HIV-1_LightChain | 1606 | 9248, 16890, 24532, 32174, 39816, 47458, 55100 |
| anti-HIV-1_LightChain | 1607 | 9249, 16891, 24533, 32175, 39817, 47459, 55101 |
| anti-HIV-1_LightChain | 1608 | 9250, 16892, 24534, 32176, 39818, 47460, 55102 |
| anti-HIV-1_HeavyChain | 1609 | 9251, 16893, 24535, 32177, 39819, 47461, 55103 |
| anti-HIV-1_HeavyChain | 1610 | 9252, 16894, 24536, 32178, 39820, 47462, 55104 |
| anti-HIV-1_HeavyChain | 1611 | 9253, 16895, 24537, 32179, 39821, 47463, 55105 |
| anti-HIV-1_HeavyChain | 1612 | 9254, 16896, 24538, 32180, 39822, 47464, 55106 |
| anti-HIV-1_HeavyChain | 1613 | 9255, 16897, 24539, 32181, 39823, 47465, 55107 |
| anti-HIV-1_HeavyChain | 1614 | 9256, 16898, 24540, 32182, 39824, 47466, 55108 |
| anti-HIV-1_HeavyChain | 1615 | 9257, 16899, 24541, 32183, 39825, 47467, 55109 |
| anti-HIV-1_HeavyChain | 1616 | 9258, 16900, 24542, 32184, 39826, 47468, 55110 |
| anti-HIV-1_HeavyChain | 1617 | 9259, 16901, 24543, 32185, 39827, 47469, 55111 |
| anti-HIV-1_HeavyChain | 1618 | 9260, 16902, 24544, 32186, 39828, 47470, 55112 |
| anti-HIV-1_HeavyChain | 1619 | 9261, 16903, 24545, 32187, 39829, 47471, 55113 |
| anti-HIV-1_HeavyChain | 1620 | 9262, 16904, 24546, 32188, 39830, 47472, 55114 |
| anti-HIV-1_HeavyChain | 1621 | 9263, 16905, 24547, 32189, 39831, 47473, 55115 |
| anti-HIV-1_HeavyChain | 1622 | 9264, 16906, 24548, 32190, 39832, 47474, 55116 |
| anti-HIV-1_HeavyChain | 1623 | 9265, 16907, 24549, 32191, 39833, 47475, 55117 |
| anti-HIV-1_HeavyChain | 1624 | 9266, 16908, 24550, 32192, 39834, 47476, 55118 |
| anti-HIV-1_HeavyChain | 1625 | 9267, 16909, 24551, 32193, 39835, 47477, 55119 |
| anti-HIV-1_HeavyChain | 1626 | 9268, 16910, 24552, 32194, 39836, 47478, 55120 |
| anti-HIV-1_HeavyChain | 1627 | 9269, 16911, 24553, 32195, 39837, 47479, 55121 |
| anti-HIV-1_HeavyChain | 1628 | 9270, 16912, 24554, 32196, 39838, 47480, 55122 |
| anti-HIV-1_HeavyChain | 1629 | 9271, 16913, 24555, 32197, 39839, 47481, 55123 |
| anti-HIV-1_HeavyChain | 1630 | 9272, 16914, 24556, 32198, 39840, 47482, 55124 |
| anti-HIV-1_HeavyChain | 1631 | 9273, 16915, 24557, 32199, 39841, 47483, 55125 |
| anti-HIV-1_HeavyChain | 1632 | 9274, 16916, 24558, 32200, 39842, 47484, 55126 |
| anti-HIV-1_HeavyChain | 1633 | 9275, 16917, 24559, 32201, 39843, 47485, 55127 |
| anti-HIV-1_HeavyChain | 1634 | 9276, 16918, 24560, 32202, 39844, 47486, 55128 |
| anti-HIV-1_HeavyChain | 1635 | 9277, 16919, 24561, 32203, 39845, 47487, 55129 |
| anti-HIV-1_HeavyChain | 1636 | 9278, 16920, 24562, 32204, 39846, 47488, 55130 |
| anti-HIV-1_HeavyChain | 1637 | 9279, 16921, 24563, 32205, 39847, 47489, 55131 |
| anti-HIV-1_HeavyChain | 1638 | 9280, 16922, 24564, 32206, 39848, 47490, 55132 |
| anti-HIV-1_HeavyChain | 1639 | 9281, 16923, 24565, 32207, 39849, 47491, 55133 |
| anti-HIV-1_HeavyChain | 1640 | 9282, 16924, 24566, 32208, 39850, 47492, 55134 |
| anti-HIV-1_HeavyChain | 1641 | 9283, 16925, 24567, 32209, 39851, 47493, 55135 |
| anti-HIV-1_HeavyChain | 1642 | 9284, 16926, 24568, 32210, 39852, 47494, 55136 |
| anti-HIV-1_HeavyChain | 1643 | 9285, 16927, 24569, 32211, 39853, 47495, 55137 |
| anti-HIV-1_HeavyChain | 1644 | 9286, 16928, 24570, 32212, 39854, 47496, 55138 |
| anti-HIV-1_HeavyChain | 1645 | 9287, 16929, 24571, 32213, 39855, 47497, 55139 |
| anti-HIV-1_HeavyChain | 1646 | 9288, 16930, 24572, 32214, 39856, 47498, 55140 |
| anti-HIV-1_HeavyChain | 1647 | 9289, 16931, 24573, 32215, 39857, 47499, 55141 |
| anti-HIV-1_HeavyChain | 1648 | 9290, 16932, 24574, 32216, 39858, 47500, 55142 |
| anti-HIV-1_HeavyChain | 1649 | 9291, 16933, 24575, 32217, 39859, 47501, 55143 |
| anti-HIV-1_HeavyChain | 1650 | 9292, 16934, 24576, 32218, 39860, 47502, 55144 |
| anti-HIV-1_HeavyChain | 1651 | 9293, 16935, 24577, 32219, 39861, 47503, 55145 |
| anti-HIV-1_HeavyChain | 1652 | 9294, 16936, 24578, 32220, 39862, 47504, 55146 |
| anti-HIV-1_HeavyChain | 1653 | 9295, 16937, 24579, 32221, 39863, 47505, 55147 |
| anti-HIV-1_HeavyChain | 1654 | 9296, 16938, 24580, 32222, 39864, 47506, 55148 |
| anti-HIV-1_HeavyChain | 1655 | 9297, 16939, 24581, 32223, 39865, 47507, 55149 |
| anti-HIV_C38-VRC18.02_HeavyChain | 1656 | 9298, 16940, 24582, 32224, 39856, 47508, 55150 |
| anti-HIV_44-VRC13.02_HeavyChain | 1657 | 9299, 16941, 24583, 32225, 39867, 47509, 55151 |
| anti-HIV-1_LightChain | 1658 | 9300, 16942, 24584, 32226, 39868, 47510, 55152 |
| anti-HIV-1_LightChain | 1659 | 9301, 16943, 24585, 32227, 39869, 47511, 55153 |
| anti-HIV-1_LightChain | 1660 | 9302, 16944, 24586, 32228, 39870, 47512, 55154 |
| anti-HIV-1_LightChain | 1661 | 9303, 16945, 24587, 32229, 39871, 47513, 55155 |
| anti-HIV-1_LightChain | 1662 | 9304, 16946, 24588, 32230, 39872, 47514, 55156 |
| anti-HIV-1_LightChain | 1663 | 9305, 16947, 24589, 32231, 39873, 47515, 55157 |
| anti-HIV-1_LightChain | 1664 | 9306, 16948, 24590, 32232, 39874, 47516, 55158 |
| anti-HIV-1_HeavyChain | 1665 | 9307, 16949, 24591, 32233, 39875, 47517, 55159 |
| anti-HIV-1_HeavyChain | 1666 | 9308, 16950, 24592, 32234, 39876, 47518, 55160 |
| anti-HIV-1_HeavyChain | 1667 | 9309, 16951, 24593, 32235, 39877, 47519, 55161 |
| anti-HIV-1_HeavyChain | 1668 | 9310, 16952, 24594, 32236, 39878, 47520, 55162 |

TABLE 3-continued

RNA and amino acid sequences of exemplified antibodies

| Name | Protein SEQ ID NO | RNA SEQ ID NO |
|---|---|---|
| anti-HIV-1__HeavyChain | 1669 | 9311, 16953, 24595, 32237, 39879, 47521, 55163 |
| anti-HIV-1__HeavyChain | 1670 | 9312, 16954, 24596, 32238, 39880, 47522, 55164 |
| anti-HIV-1__HeavyChain | 1671 | 9313, 16955, 24597, 32239, 39881, 47523, 55165 |
| anti-HIV__45__LightChain | 1672 | 9314, 16956, 24598, 32240, 39882, 47524, 55166 |
| anti-HIV__45__LightChain | 1673 | 9315, 16957, 24599, 32241, 39883, 47525, 55167 |
| anti-HIV__45__LightChain | 1674 | 9316, 16958, 24600, 32242, 39884, 47526, 55168 |
| anti-HIV__45__HeavyChain | 1675 | 9317, 16959, 24601, 32243, 39885, 47527, 55169 |
| anti-HIV__45__HeavyChain | 1676 | 9318, 16960, 24602, 32244, 39886, 47528, 55170 |
| anti-HIV__45__HeavyChain | 1677 | 9319, 16961, 24603, 32245, 39887, 47529, 55171 |
| anti-HIV__cap256-206-252885__VR-Chain | 1678 | 9320, 16962, 24604, 32246, 39888, 47530, 55172 |
| anti-HIV__cap256-206-249183__VR-Chain | 1679 | 9321, 16963, 24605, 32247, 39889, 47531, 55173 |
| anti-HIV__cap256-206-220956__VR-Chain | 1680 | 9322, 16964, 24606, 32248, 39890, 47532, 55174 |
| anti-HIV__cap256-206-220629__VR-Chain | 1681 | 9323, 16965, 24607, 32249, 39891, 47533, 55175 |
| anti-HIV__cap256-206-200599__VR-Chain | 1682 | 9324, 16966, 24608, 32250, 39892, 47534, 55176 |
| anti-HIV__cap256-206-186347__VR-Chain | 1683 | 9325, 16967, 24609, 32251, 39893, 47535, 55177 |
| anti-HIV__cap256-206-186226__VR-Chain | 1684 | 9326, 16968, 24610, 32252, 39894, 47536, 55178 |
| anti-HIV__cap256-206-179686__VR-Chain | 1685 | 9327, 16969, 24611, 32253, 39895, 47537, 55179 |
| anti-HIV__cap256-206-173707__VR-Chain | 1686 | 9328, 16970, 24612, 32254, 39896, 47538, 55180 |
| anti-HIV__cap256-206-173339__VR-Chain | 1687 | 9329, 16971, 24613, 32255, 39897, 47539, 55181 |
| anti-HIV__cap256-206-172689__VR-Chain | 1688 | 9330, 16972, 24614, 32256, 39898, 47540, 55182 |
| anti-HIV__cap256-206-162744__VR-Chain | 1689 | 9331, 16973, 24615, 32257, 39899, 47541, 55183 |
| anti-HIV__cap256-206-146057__VR-Chain | 1690 | 9332, 16974, 24616, 32258, 39900, 47542, 55184 |
| anti-HIV__cap256-206-139519__VR-Chain | 1691 | 9333, 16975, 24617, 32259, 39901, 47543, 55185 |
| anti-HIV__cap256-206-136316__VR-Chain | 1692 | 9334, 16976, 24618, 32260, 39902, 47544, 55186 |
| anti-HIV__cap256-206-116098__VR-Chain | 1693 | 9335, 16977, 24619, 32261, 39903, 47545, 55187 |
| anti-HIV__cap256-206-115862__VR-Chain | 1694 | 9336, 16978, 24620, 32262, 39904, 47546, 55188 |
| anti-HIV__cap256-206-107018__VR-Chain | 1695 | 9337, 16979, 24621, 32263, 39905, 47547, 55189 |
| anti-HIV__cap256-206-098644__VR-Chain | 1696 | 9338, 16980, 24622, 32264, 39906, 47548, 55190 |
| anti-HIV__cap256-206-098135__VR-Chain | 1697 | 9339, 16981, 24623, 32265, 39907, 47549, 55191 |
| anti-HIV__cap256-206-096276__VR-Chain | 1698 | 9340, 16982, 24624, 32266, 39908, 47550, 55192 |
| anti-HIV__cap256-206-092794__VR-Chain | 1699 | 9341, 16983, 24625, 32267, 39909, 47551, 55193 |
| anti-HIV__cap256-206-086817__VR-Chain | 1700 | 9342, 16984, 24626, 32268, 39910, 47552, 55194 |
| anti-HIV__cap256-206-086446__VR-Chain | 1701 | 9343, 16985, 24627, 32269, 39911, 47553, 55195 |
| anti-HIV__cap256-206-086180__VR-Chain | 1702 | 9344, 16986, 24628, 32270, 39912, 47554, 55196 |
| anti-HIV__cap256-206-083708__VR-Chain | 1703 | 9345, 16987, 24629, 32271, 39913, 47555, 55197 |
| anti-HIV__cap256-206-079556__VR-Chain | 1704 | 9346, 16988, 24630, 32272, 39914, 47556, 55198 |
| anti-HIV__cap256-206-078657__VR-Chain | 1705 | 9347, 16989, 24631, 32273, 39915, 47557, 55199 |
| anti-HIV__cap256-206-075802__VR-Chain | 1706 | 9348, 16990, 24632, 32274, 39916, 47558, 55200 |
| anti-HIV__cap256-206-069097__VR-Chain | 1707 | 9349, 16991, 24633, 32275, 39917, 47559, 55201 |
| anti-HIV__cap256-206-067758__VR-Chain | 1708 | 9350, 16992, 24634, 32276, 39918, 47560, 55202 |
| anti-HIV__cap256-206-057019__VR-Chain | 1709 | 9351, 16993, 24635, 32277, 39919, 47561, 55203 |
| anti-HIV__cap256-206-055385__VR-Chain | 1710 | 9352, 16994, 24636, 32278, 39920, 47562, 55204 |
| anti-HIV__cap256-206-053187__VR-Chain | 1711 | 9353, 16995, 24637, 32279, 39921, 47563, 55205 |
| anti-HIV__cap256-206-053139__VR-Chain | 1712 | 9354, 16996, 24638, 32280, 39922, 47564, 55206 |
| anti-HIV__cap256-206-050350__VR-Chain | 1713 | 9355, 16997, 24639, 32281, 39923, 47565, 55207 |
| anti-HIV__cap256-206-046207__VR-Chain | 1714 | 9356, 16998, 24640, 32282, 39924, 47566, 55208 |
| anti-HIV__cap256-206-043389__VR-Chain | 1715 | 9357, 16999, 24641, 32283, 39925, 47567, 55209 |
| anti-HIV__cap256-206-042555__VR-Chain | 1716 | 9358, 17000, 24642, 32284, 39926, 47568, 55210 |
| anti-HIV__cap256-206-029720__VR-Chain | 1717 | 9359, 17001, 24643, 32285, 39927, 47596, 55211 |
| anti-HIV__cap256-206-028848__VR-Chain | 1718 | 9360, 17002, 24644, 32286, 39928, 47570, 55212 |
| anti-HIV__cap256-206-027652__VR-Chain | 1719 | 9361, 17003, 24645, 32287, 39929, 47571, 55213 |
| anti-HIV__cap256-206-024075__VR-Chain | 1720 | 9362, 17004, 24646, 32288, 39930, 47572, 55214 |
| anti-HIV__cap256-206-008748__VR-Chain | 1721 | 9363, 17005, 24647, 32289, 39931, 47573, 55215 |
| anti-HIV__cap256-206-008530__VR-Chain | 1722 | 9364, 17009, 24648, 32290, 39932, 47574, 55216 |
| anti-HIV__cap256-176-723043__VR-Chain | 1723 | 9365, 17007, 24649, 32291, 39933, 47575, 55217 |
| anti-HIV__cap256-176-600049__VR-Chain | 1724 | 9366, 17008, 24650, 32292, 39934, 47576, 55218 |
| anti-HIV__cap256-176-531926__VR-Chain | 1725 | 9367, 17009, 24651, 32293, 39935, 47577, 55219 |
| anti-HIV__cap256-176-504134__VR-Chain | 1726 | 9368, 17010, 24652, 32294, 39936, 47578, 55220 |
| anti-HIV__cap256-119-186229__VR-Chain | 1727 | 9369, 17011, 24653, 32295, 39937, 47579, 55221 |
| anti-HIV__cap256-119-183891__VR-Chain | 1728 | 9370, 17012, 24654, 32296, 39938, 47580, 55222 |
| anti-HIV__cap256-119-183631__VR-Chain | 1729 | 9371, 17013, 24655, 32297, 39939, 47581, 55223 |
| anti-HIV__cap256-119-182676__VR-Chain | 1730 | 9372, 17014, 24656, 32298, 39940, 47582, 55224 |
| anti-HIV__cap256-119-180772__VR-Chain | 1731 | 9373, 17015, 24657, 32299, 39941, 47583, 55225 |
| anti-HIV__cap256-119-180508__VR-Chain | 1732 | 9374, 17016, 24658, 32300, 39942, 47584, 55226 |
| anti-HIV__cap256-119-180260__VR-Chain | 1733 | 9375, 17017, 24659, 32301, 39943, 47585, 55227 |
| anti-HIV__cap256-119-180173__VR-Chain | 1734 | 9376, 17018, 24660, 32302, 39944, 47586, 55228 |
| anti-HIV__cap256-119-179839__VR-Chain | 1735 | 9377, 17019, 24661, 32303, 39945, 47587, 55229 |
| anti-HIV__cap256-119-179262__VR-Chain | 1736 | 9378, 17020, 24662, 32304, 39946, 47588, 55230 |
| anti-HIV__cap256-119-178995__VR-Chain | 1737 | 9379, 17021, 24663, 32305, 39947, 47589, 55231 |
| anti-HIV__cap256-119-178455__VR-Chain | 1738 | 9380, 17022, 24664, 32306, 39948, 47590, 55232 |
| anti-HIV__cap256-119-177993__VR-Chain | 1739 | 9381, 17023, 24665, 32307, 39949, 47591, 55233 |
| anti-HIV__cap256-119-177727__VR-Chain | 1740 | 9382, 17024, 24666, 32308, 39950, 47592, 55234 |
| anti-HIV__cap256-119-176746__VR-Chain | 1741 | 9383, 17025, 24667, 32309, 39951, 47593, 55235 |
| anti-HIV__cap256-119-176241__VR-Chain | 1742 | 9384, 17026, 24668, 32310, 39952, 47594, 55236 |
| anti-HIV__cap256-119-175215__VR-Chain | 1743 | 9385, 17027, 24669, 32311, 39953, 47595, 55237 |
| anti-HIV__cap256-119-173928__VR-Chain | 1744 | 9386, 17028, 24670, 32312, 39954, 47596, 55238 |

TABLE 3-continued

RNA and amino acid sequences of exemplified antibodies

| Name | Protein SEQ ID NO | RNA SEQ ID NO |
| --- | --- | --- |
| anti-HIV_cap256-119-173495_VR-Chain | 1745 | 9387, 17029, 24671, 32313, 39955, 47597, 55239 |
| anti-HIV_cap256-119-172882_VR-Chain | 1746 | 9388, 17030, 24672, 32314, 39956, 47598, 55240 |
| anti-HIV_cap256-119-172429_VR-Chain | 1747 | 9389, 17031, 24673, 32315, 39957, 47599, 55241 |
| anti-HIV_cap256-119-172223_VR-Chain | 1748 | 9390, 17032, 24674, 32316, 39958, 47600, 55242 |
| anti-HIV_cap256-119-171838_VR-Chain | 1749 | 9391, 17033, 24675, 32317, 39959, 47601, 55243 |
| anti-HIV_cap256-119-171587_VR-Chain | 1750 | 9392, 17034, 24676, 32318, 39960, 47602, 55244 |
| anti-HIV_cap256-119-169596_VR-Chain | 1751 | 9393, 17035, 24677, 32319, 39961, 47603, 55245 |
| anti-HIV_cap256-119-169523_VR-Chain | 1752 | 9394, 17036, 24678, 32320, 39962, 47604, 55246 |
| anti-HIV_cap256-119-169462_VR-Chain | 1753 | 9395, 17037, 24679, 32321, 39963, 47605, 55247 |
| anti-HIV_cap256-119-169092_VR-Chain | 1754 | 9396, 17038, 24680, 32322, 39964, 47606, 55248 |
| anti-HIV_cap256-119-168680_VR-Chain | 1755 | 9397, 17039, 24681, 32323, 39965, 47607, 55249 |
| anti-HIV_cap256-119-166385_VR-Chain | 1756 | 9398, 17040, 24682, 32324, 39966, 47608, 55250 |
| anti-HIV_cap256-119-165943_VR-Chain | 1757 | 9399, 17041, 24683, 32325, 39967, 47609, 55251 |
| anti-HIV_cap256-119-165738_VR-Chain | 1758 | 9400, 17042, 24684, 32326, 39968, 47610, 55252 |
| anti-HIV_cap256-119-164913_VR-Chain | 1759 | 9401, 17043, 24685, 32327, 39969, 47611, 55253 |
| anti-HIV_cap256-119-164167_VR-Chain | 1760 | 9402, 17044, 24686, 32328, 39970, 47612, 55254 |
| anti-HIV_cap256-119-163558_VR-Chain | 1761 | 9403, 17045, 24687, 32329, 39971, 47613, 55255 |
| anti-HIV_cap256-119-162043_VR-Chain | 1762 | 9404, 17046, 24688, 32330, 39972, 47614, 55256 |
| anti-HIV_cap256-119-161718_VR-Chain | 1763 | 9405, 17047, 24689, 32331, 39973, 47615, 55257 |
| anti-HIV_cap256-119-161675_VR-Chain | 1764 | 9406, 17048, 24690, 32332, 39974, 47616, 55258 |
| anti-HIV_cap256-119-161053_VR-Chain | 1765 | 9407, 17049, 24691, 32333, 39975, 47617, 55259 |
| anti-HIV_cap256-119-159499_VR-Chain | 1766 | 9408, 17050, 24692, 32334, 39976, 47618, 55260 |
| anti-HIV_cap256-119-159114_VR-Chain | 1767 | 9409, 17051, 24693, 32335, 39977, 47619, 55261 |
| anti-HIV_cap256-119-156751_VR-Chain | 1768 | 9410, 17052, 24694, 32336, 39978, 47620, 55262 |
| anti-HIV_cap256-119-155656_VR-Chain | 1769 | 9411, 17053, 24695, 32337, 39979, 47621, 55263 |
| anti-HIV_cap256-119-154420_VR-Chain | 1770 | 9412, 17054, 24696, 32338, 39980, 47622, 55264 |
| anti-HIV_cap256-119-153954_VR-Chain | 1771 | 9413, 17055, 24697, 32339, 39981, 47623, 55265 |
| anti-HIV_cap256-119-153864_VR-Chain | 1772 | 9414, 17056, 24698, 32340, 39982, 47624, 55266 |
| anti-HIV_cap256-119-153793_VR-Chain | 1773 | 9415, 17057, 24699, 32341, 39983, 47625, 55267 |
| anti-HIV_cap256-119-153462_VR-Chain | 1774 | 9416, 17058, 24700, 32342, 39984, 47626, 55268 |
| anti-HIV_cap256-119-153124_VR-Chain | 1775 | 9417, 17059, 24701, 32343, 39985, 47627, 55269 |
| anti-HIV_cap256-119-153025_VR-Chain | 1776 | 9418, 17060, 24702, 32344, 39986, 47628, 55270 |
| anti-HIV_cap256-119-152713_VR-Chain | 1777 | 9419, 17061, 24703, 32345, 39987, 47629, 55271 |
| anti-HIV_cap256-119-151794_VR-Chain | 1778 | 9420, 17062, 24704, 32346, 39988, 47630, 55272 |
| anti-HIV_cap256-119-150980_VR-Chain | 1779 | 9421, 17063, 24705, 32347, 39989, 47631, 55273 |
| anti-HIV_cap256-119-148895_VR-Chain | 1780 | 9422, 17064, 24706, 32348, 39990, 47632, 55274 |
| anti-HIV_cap256-119-148848_VR-Chain | 1781 | 9423, 17065, 24707, 32349, 39991, 47633, 55275 |
| anti-HIV_cap256-119-148743_VR-Chain | 1782 | 9424, 17066, 24708, 32350, 39992, 47634, 55276 |
| anti-HIV_cap256-119-148595_VR-Chain | 1783 | 9425, 17067, 24709, 32351, 39993, 47635, 55277 |
| anti-HIV_cap256-119-148490_VR-Chain | 1784 | 9426, 17068, 24710, 32352, 39994, 47636, 55278 |
| anti-HIV_cap256-119-148470_VR-Chain | 1785 | 9427, 17069, 24711, 32353, 39995, 47637, 55279 |
| anti-HIV_cap256-119-148107_VR-Chain | 1786 | 9428, 17070, 24712, 32354, 39996, 47638, 55280 |
| anti-HIV_cap256-119-147933_VR-Chain | 1787 | 9429, 17071, 24713, 32355, 39997, 47639, 55281 |
| anti-HIV_cap256-119-147434_VR-Chain | 1788 | 9430, 17072, 24714, 32356, 39998, 47640, 55282 |
| anti-HIV_cap256-119-146106_VR-Chain | 1789 | 9431, 17073, 24715, 32357, 39999, 47641, 55283 |
| anti-HIV_cap256-119-145604_VR-Chain | 1790 | 9432, 17074, 24716, 32358, 40000, 47642, 55284 |
| anti-HIV_cap256-119-143998_VR-Chain | 1791 | 9433, 17075, 24717, 32359, 40001, 47643, 55285 |
| anti-HIV_cap256-119-143441_VR-Chain | 1792 | 9434, 17076, 24718, 32360, 40002, 47644, 55286 |
| anti-HIV_cap256-119-141307_VR-Chain | 1793 | 9435, 17077, 24719, 32361, 40003, 47645, 55287 |
| anti-HIV_cap256-119-140896_VR-Chain | 1794 | 9436, 17078, 24720, 32362, 40004, 47646, 55288 |
| anti-HIV_cap256-119-140090_VR-Chain | 1795 | 9437, 17079, 24721, 32363, 40005, 47647, 55289 |
| anti-HIV_cap256-119-140037_VR-Chain | 1796 | 9438, 17080, 24722, 32364, 40006, 47648, 55290 |
| anti-HIV_cap256-119-139135_VR-Chain | 1797 | 9439, 17081, 24723, 32365, 40007, 47649, 55291 |
| anti-HIV_cap256-119-137881_VR-Chain | 1798 | 9440, 17082, 24724, 32366, 40008, 47650, 55292 |
| anti-HIV_cap256-119-137643_VR-Chain | 1799 | 9441, 17083, 24725, 32367, 40009, 47651, 55293 |
| anti-HIV_cap256-119-137170_VR-Chain | 1800 | 9442, 17084, 24726, 32368, 40010, 47652, 55294 |
| anti-HIV_cap256-119-136616_VR-Chain | 1801 | 9443, 17085, 24727, 32369, 40011, 47653, 55295 |
| anti-HIV_cap256-119-136206_VR-Chain | 1802 | 9444, 17086, 24728, 32370, 40012, 47654, 55296 |
| anti-HIV_cap256-119-135565_VR-Chain | 1803 | 9445, 17087, 24729, 32371, 40013, 47655, 55297 |
| anti-HIV_cap256-119-135025_VR-Chain | 1804 | 9446, 17088, 24730, 32372, 40014, 47656, 55298 |
| anti-HIV_cap256-119-133983_VR-Chain | 1805 | 9447, 17089, 24731, 32373, 40015, 47657, 55299 |
| anti-HIV_cap256-119-133917_VR-Chain | 1806 | 9448, 17090, 24732, 32374, 40016, 47658, 55300 |
| anti-HIV_cap256-119-132663_VR-Chain | 1807 | 9449, 17091, 24733, 32375, 40017, 47659, 55301 |
| anti-HIV_cap256-119-132113_VR-Chain | 1808 | 9450, 17092, 24734, 32376, 40018, 47660, 55302 |
| anti-HIV_cap256-119-131839_VR-Chain | 1809 | 9451, 17093, 24735, 32377, 40019, 47661, 55303 |
| anti-HIV_cap256-119-130626_VR-Chain | 1810 | 9452, 17094, 24736, 32378, 40020, 47662, 55304 |
| anti-HIV_cap256-119-130191_VR-Chain | 1811 | 9453, 17095, 24737, 32379, 40021, 47663, 55305 |
| anti-HIV_cap256-119-129798_VR-Chain | 1812 | 9454, 17096, 24738, 32380, 40022, 47664, 55306 |
| anti-HIV_cap256-119-128745_VR-Chain | 1813 | 9455, 17097, 24739, 32381, 40023, 47665, 55307 |
| anti-HIV_cap256-119-128593_VR-Chain | 1814 | 9456, 17098, 24740, 32382, 40024, 47666, 55308 |
| anti-HIV_cap256-119-128152_VR-Chain | 1815 | 9457, 17099, 24741, 32383, 40025, 47667, 55309 |
| anti-HIV_cap256-119-127693_VR-Chain | 1816 | 9458, 17100, 24742, 32384, 40026, 47668, 55310 |
| anti-HIV_cap256-119-126684_VR-Chain | 1817 | 9459, 17101, 24743, 32385, 40027, 47669, 55311 |
| anti-HIV_cap256-119-126056_VR-Chain | 1818 | 9460, 17102, 24744, 32386, 40028, 47670, 55312 |
| anti-HIV_cap256-119-125765_VR-Chain | 1819 | 9461, 17103, 24745, 32387, 40029, 47671, 55313 |
| anti-HIV_cap256-119-125106_VR-Chain | 1820 | 9462, 17104, 24746, 32388, 40030, 47672, 55314 |

TABLE 3-continued

RNA and amino acid sequences of exemplified antibodies

| Name | Protein SEQ ID NO | RNA SEQ ID NO |
| --- | --- | --- |
| anti-HIV_cap256-119-124026_VR-Chain | 1821 | 9463, 17105, 24747, 32389, 40031, 47673, 55315 |
| anti-HIV_cap256-119-121783_VR-Chain | 1822 | 9464, 17106, 24748, 32390, 40032, 47674, 55316 |
| anti-HIV_cap256-119-121208_VR-Chain | 1823 | 9465, 17107, 24749, 32391, 40033, 47675, 55317 |
| anti-HIV_cap256-119-120945_VR-Chain | 1824 | 9466, 17108, 24750, 32392, 40034, 47676, 55318 |
| anti-HIV_cap256-119-118229_VR-Chain | 1825 | 9467, 17109, 24751, 32393, 40035, 47677, 55319 |
| anti-HIV_cap256-119-118025_VR-Chain | 1826 | 9468, 17110, 24752, 32394, 40036, 47678, 55320 |
| anti-HIV_cap256-119-117418_VR-Chain | 1827 | 9469, 17111, 24753, 32395, 40037, 47679, 55321 |
| anti-HIV_cap256-119-117250_VR-Chain | 1828 | 9470, 17112, 24754, 32396, 40038, 47680, 55322 |
| anti-HIV_cap256-119-117230_VR-Chain | 1829 | 9471, 17113, 24755, 32397, 40039, 47681, 55323 |
| anti-HIV_cap256-119-116999_VR-Chain | 1830 | 9472, 17114, 24756, 32398, 40040, 47682, 55324 |
| anti-HIV_cap256-119-116558_VR-Chain | 1831 | 9473, 17115, 24757, 32399, 40041, 47683, 55325 |
| anti-HIV_cap256-119-116484_VR-Chain | 1832 | 9474, 17116, 24758, 32400, 40042, 47684, 55326 |
| anti-HIV_cap256-119-114844_VR-Chain | 1833 | 9475, 17117, 24759, 32401, 40043, 47685, 55327 |
| anti-HIV_cap256-119-114141_VR-Chain | 1834 | 9476, 17118, 24760, 32402, 40044, 47686, 55328 |
| anti-HIV_cap256-119-111917_VR-Chain | 1835 | 9477, 17119, 24761, 32403, 40045, 47687, 55329 |
| anti-HIV_cap256-119-111862_VR-Chain | 1836 | 9478, 17120, 24762, 32404, 40046, 47688, 55330 |
| anti-HIV_cap256-119-110064_VR-Chain | 1837 | 9479, 17121, 24763, 32405, 40047, 47689, 55331 |
| anti-HIV_cap256-119-109192_VR-Chain | 1838 | 9480, 17122, 24764, 32406, 40048, 47690, 55332 |
| anti-HIV_cap256-119-108793_VR-Chain | 1839 | 9481, 17123, 24765, 32407, 40049, 47691, 55333 |
| anti-HIV_cap256-119-108127_VR-Chain | 1840 | 9482, 17124, 24766, 32408, 40050, 47692, 55334 |
| anti-HIV_cap256-119-107758_VR-Chain | 1841 | 9483, 17125, 24767, 32409, 40051, 47693, 55335 |
| anti-HIV_cap256-119-107209_VR-Chain | 1842 | 9484, 17126, 24768, 32410, 40052, 47694, 55336 |
| anti-HIV_cap256-119-107184_VR-Chain | 1843 | 9485, 17127, 24769, 32411, 40053, 47695, 55337 |
| anti-HIV_cap256-119-106827_VR-Chain | 1844 | 9486, 17128, 24770, 32412, 40054, 47696, 55338 |
| anti-HIV_cap256-119-106511_VR-Chain | 1845 | 9487, 17129, 24771, 32413, 40055, 47697, 55339 |
| anti-HIV_cap256-119-106327_VR-Chain | 1846 | 9488, 17130, 24772, 32414, 40056, 47698, 55340 |
| anti-HIV_cap256-119-105486_VR-Chain | 1847 | 9489, 17131, 24773, 32415, 40057, 47699, 55341 |
| anti-HIV_cap256-119-105197_VR-Chain | 1848 | 9490, 17132, 24774, 32416, 40058, 47700, 55342 |
| anti-HIV_cap256-119-104946_VR-Chain | 1849 | 9491, 17133, 24775, 32417, 40059, 47701, 55343 |
| anti-HIV_cap256-119-103667_VR-Chain | 1850 | 9492, 17134, 24776, 32418, 40060, 47702, 55344 |
| anti-HIV_cap256-119-103385_VR-Chain | 1851 | 9493, 17135, 24777, 32419, 40061, 47703, 55345 |
| anti-HIV_cap256-119-103267_VR-Chain | 1852 | 9494, 17136, 24778, 32420, 40062, 47704, 55346 |
| anti-HIV_cap256-119-103011_VR-Chain | 1853 | 9495, 17137, 24779, 32421, 40063, 47705, 55347 |
| anti-HIV_cap256-119-102072_VR-Chain | 1854 | 9496, 17138, 24780, 32422, 40064, 47706, 55348 |
| anti-HIV_cap256-119-101945_VR-Chain | 1855 | 9497, 17139, 24781, 32423, 40065, 47707, 55349 |
| anti-HIV_cap256-119-101319_VR-Chain | 1856 | 9498, 17140, 24782, 32424, 40066, 47708, 55350 |
| anti-HIV_cap256-119-100871_VR-Chain | 1857 | 9499, 17141, 24783, 32425, 40067, 47709, 55351 |
| anti-HIV_cap256-119-100838_VR-Chain | 1858 | 9500, 17142, 24784, 32426, 40068, 47710, 55352 |
| anti-HIV_cap256-119-100025_VR-Chain | 1859 | 9501, 17143, 24785, 32427, 40069, 47711, 55353 |
| anti-HIV_cap256-119-100000_VR-Chain | 1860 | 9502, 17144, 24786, 32428, 40070, 47712, 55354 |
| anti-HIV_cap256-119-098890_VR-Chain | 1861 | 9503, 17145, 24787, 32429, 40071, 47713, 55355 |
| anti-HIV_cap256-119-098715_VR-Chain | 1862 | 9504, 17146, 24788, 32430, 40072, 47714, 55356 |
| anti-HIV_cap256-119-098632_VR-Chain | 1863 | 9505, 17147, 24789, 32431, 40073, 47715, 55357 |
| anti-HIV_cap256-119-097199_VR-Chain | 1864 | 9506, 17148, 24790, 32432, 40074, 47716, 55358 |
| anti-HIV_cap256-119-096189_VR-Chain | 1865 | 9507, 17149, 24791, 32433, 40075, 47717, 55359 |
| anti-HIV_cap256-119-094581_VR-Chain | 1866 | 9508, 17150, 24792, 32434, 40076, 47718, 55360 |
| anti-HIV_cap256-119-094200_VR-Chain | 1867 | 9509, 17151, 24793, 32435, 40077, 47719, 55361 |
| anti-HIV_cap256-119-094158_VR-Chain | 1868 | 9510, 17152, 24794, 32436, 40078, 47720, 55362 |
| anti-HIV_cap256-119-092814_VR-Chain | 1869 | 9511, 17153, 24795, 32437, 40079, 47721, 55363 |
| anti-HIV_cap256-119-092808_VR-Chain | 1870 | 9512, 17154, 24796, 32438, 40080, 47722, 55364 |
| anti-HIV_cap256-119-092573_VR-Chain | 1871 | 9513, 17155, 24797, 32439, 40081, 47723, 55365 |
| anti-HIV_cap256-119-090815_VR-Chain | 1872 | 9514, 17156, 24798, 32440, 40082, 47724, 55366 |
| anti-HIV_cap256-119-090368_VR-Chain | 1873 | 9515, 17157, 24799, 32441, 40083, 47725, 55367 |
| anti-HIV_cap256-119-089710_VR-Chain | 1874 | 9516, 17158, 24800, 32442, 40084, 47726, 55368 |
| anti-HIV_cap256-119-088555_VR-Chain | 1875 | 9517, 17159, 24801, 32443, 40085, 47727, 55369 |
| anti-HIV_cap256-119-087962_VR-Chain | 1876 | 9518, 17160, 24802, 32444, 40086, 47728, 55370 |
| anti-HIV_cap256-119-086903_VR-Chain | 1877 | 9519, 17161, 24803, 32445, 40087, 47729, 55371 |
| anti-HIV_cap256-119-086804_VR-Chain | 1878 | 9520, 17162, 24804, 32446, 40088, 47730, 55372 |
| anti-HIV_cap256-119-085910_VR-Chain | 1879 | 9521, 17163, 24805, 32447, 40089, 47731, 55373 |
| anti-HIV_cap256-119-085772_VR-Chain | 1880 | 9522, 17164, 24806, 32448, 40090, 47732, 55374 |
| anti-HIV_cap256-119-084603_VR-Chain | 1881 | 9523, 17165, 24807, 32449, 40091, 47733, 55375 |
| anti-HIV_cap256-119-084276_VR-Chain | 1882 | 9524, 17166, 24808, 32450, 40092, 47734, 55376 |
| anti-HIV_cap256-119-082288_VR-Chain | 1883 | 9525, 17167, 24809, 32451, 40093, 47735, 55377 |
| anti-HIV_cap256-119-080383_VR-Chain | 1884 | 9526, 17168, 24810, 32452, 40094, 47736, 55378 |
| anti-HIV_cap256-119-079333_VR-Chain | 1885 | 9527, 17169, 24811, 32453, 40095, 47737, 55379 |
| anti-HIV_cap256-119-078618_VR-Chain | 1886 | 9528, 17170, 24812, 32454, 40096, 47738, 55380 |
| anti-HIV_cap256-119-077466_VR-Chain | 1887 | 9529, 17171, 24813, 32455, 40097, 47739, 55381 |
| anti-HIV_cap256-119-076284_VR-Chain | 1888 | 9530, 17172, 24814, 32456, 40098, 47740, 55382 |
| anti-HIV_cap256-119-074680_VR-Chain | 1889 | 9531, 17173, 24815, 32457, 40099, 47741, 55383 |
| anti-HIV_cap256-119-074081_VR-Chain | 1890 | 9532, 17174, 24816, 32458, 40100, 47742, 55384 |
| anti-HIV_cap256-119-071704_VR-Chain | 1891 | 9533, 17175, 24817, 32459, 40101, 47743, 55385 |
| anti-HIV_cap256-119-071266_VR-Chain | 1892 | 9534, 17176, 24818, 32460, 40102, 47744, 55386 |
| anti-HIV_cap256-119-069667_VR-Chain | 1893 | 9535, 17177, 24819, 32461, 40103, 47745, 55387 |
| anti-HIV_cap256-119-069591_VR-Chain | 1894 | 9536, 17178, 24820, 32462, 40104, 47746, 55388 |
| anti-HIV_cap256-119-068691_VR-Chain | 1895 | 9537, 17179, 24821, 32463, 40105, 47747, 55389 |
| anti-HIV_cap256-119-068488_VR-Chain | 1896 | 9538, 17180, 24822, 32464, 40106, 47748, 55390 |

TABLE 3-continued

RNA and amino acid sequences of exemplified antibodies

| Name | Protein SEQ ID NO | RNA SEQ ID NO |
|---|---|---|
| anti-HIV_cap256-119-067536_VR-Chain | 1897 | 9539, 17181, 24823, 32465, 40107, 47749, 55391 |
| anti-HIV_cap256-119-065852_VR-Chain | 1898 | 9540, 17182, 24824, 32466, 40108, 47750, 55392 |
| anti-HIV_cap256-119-065457_VR-Chain | 1899 | 9541, 17183, 24825, 32467, 40109, 47751, 55393 |
| anti-HIV_cap256-119-064501_VR-Chain | 1900 | 9542, 17184, 24826, 32468, 40110, 47752, 55394 |
| anti-HIV_cap256-119-063568_VR-Chain | 1901 | 9543, 17185, 24827, 32469, 40111, 47753, 55395 |
| anti-HIV_cap256-119-063103_VR-Chain | 1902 | 9544, 17186, 24828, 32470, 40112, 47754, 55396 |
| anti-HIV_cap256-119-061027_VR-Chain | 1903 | 9545, 17187, 24829, 32471, 40113, 47755, 55397 |
| anti-HIV_cap256-119-058232_VR-Chain | 1904 | 9546, 17188, 24830, 32472, 40114, 47756, 55398 |
| anti-HIV_cap256-119-057341_VR-Chain | 1905 | 9547, 17189, 24831, 32473, 40115, 47757, 55399 |
| anti-HIV_cap256-119-056895_VR-Chain | 1906 | 9548, 17190, 24832, 32474, 40116, 47758, 55400 |
| anti-HIV_cap256-119-056402_VR-Chain | 1907 | 9549, 17191, 24833, 32475, 40117, 47759, 55401 |
| anti-HIV_cap256-119-056034_VR-Chain | 1908 | 9550, 17192, 24834, 32476, 40118, 47760, 55402 |
| anti-HIV_cap256-119-055042_VR-Chain | 1909 | 9551, 17193, 24835, 32477, 40119, 47761, 55403 |
| anti-HIV_cap256-119-054776_VR-Chain | 1910 | 9552, 17194, 24836, 32478, 40120, 47762, 55404 |
| anti-HIV_cap256-119-054539_VR-Chain | 1911 | 9553, 17195, 24837, 32479, 40121, 47763, 55405 |
| anti-HIV_cap256-119-054112_VR-Chain | 1912 | 9554, 17199, 24838, 32480, 40122, 47764, 55406 |
| anti-HIV_cap256-119-053339_VR-Chain | 1913 | 9555, 17197, 24839, 32481, 40123, 47765, 55407 |
| anti-HIV_cap256-119-052404_VR-Chain | 1914 | 9556, 17198, 24840, 32482, 40124, 47766, 55408 |
| anti-HIV_cap256-119-051123_VR-Chain | 1915 | 9557, 17199, 24841, 32483, 40125, 47767, 55409 |
| anti-HIV_cap256-119-051077_VR-Chain | 1916 | 9558, 17200, 24842, 32484, 40126, 47768, 55410 |
| anti-HIV_cap256-119-050442_VR-Chain | 1917 | 9559, 17201, 24843, 32485, 40127, 47769, 55411 |
| anti-HIV_cap256-119-049433_VR-Chain | 1918 | 9560, 17202, 24844, 32486, 40128, 47770, 55412 |
| anti-HIV_cap256-119-047532_VR-Chain | 1919 | 9561, 17203, 24845, 32487, 40129, 47771, 55413 |
| anti-HIV_cap256-119-047489_VR-Chain | 1920 | 9562, 17204, 24846, 32488, 40130, 47772, 55414 |
| anti-HIV_cap256-119-046020_VR-Chain | 1921 | 9563, 17205, 24847, 32489, 40131, 47773, 55415 |
| anti-HIV_cap256-119-044746_VR-Chain | 1922 | 9564, 17206, 24848, 32490, 40132, 47774, 55416 |
| anti-HIV_cap256-119-044740_VR-Chain | 1923 | 9565, 17207, 24849, 32491, 40133, 47775, 55417 |
| anti-HIV_cap256-119-043790_VR-Chain | 1924 | 9566, 17208, 24850, 32492, 40134, 47776, 55418 |
| anti-HIV_cap256-119-042880_VR-Chain | 1925 | 9567, 17209, 24851, 32493, 40135, 47777, 55419 |
| anti-HIV_cap256-119-042606_VR-Chain | 1926 | 9568, 17210, 24852, 32494, 40136, 47778, 55420 |
| anti-HIV_cap256-119-042444_VR-Chain | 1927 | 9569, 17211, 24853, 32495, 40137, 47779, 55421 |
| anti-HIV_cap256-119-040328_VR-Chain | 1928 | 9570, 17212, 24854, 32496, 40138, 47780, 55422 |
| anti-HIV_cap256-119-040164_VR-Chain | 1929 | 9571, 17213, 24855, 32497, 40139, 47781, 55423 |
| anti-HIV_cap256-119-039130_VR-Chain | 1930 | 9572, 17214, 24856, 32498, 40140, 47782, 55424 |
| anti-HIV_cap256-119-038138_VR-Chain | 1931 | 9573, 17215, 24857, 32499, 40141, 47783, 55425 |
| anti-HIV_cap256-119-037868_VR-Chain | 1932 | 9574, 17216, 24858, 32500, 40142, 47784, 55426 |
| anti-HIV_cap256-119-037102_VR-Chain | 1933 | 9575, 17217, 24859, 32501, 40143, 47785, 55427 |
| anti-HIV_cap256-119-036683_VR-Chain | 1934 | 9576, 17218, 24860, 32502, 40144, 47786, 55428 |
| anti-HIV_cap256-119-036495_VR-Chain | 1935 | 9577, 17219, 24861, 32503, 40145, 47787, 55429 |
| anti-HIV_cap256-119-035375_VR-Chain | 1936 | 9578, 17220, 24862, 32504, 40146, 47788, 55430 |
| anti-HIV_cap256-119-035165_VR-Chain | 1937 | 9579, 17221, 24863, 32505, 40147, 47789, 55431 |
| anti-HIV_cap256-119-035109_VR-Chain | 1938 | 9580, 17222, 24864, 32506, 40148, 47790, 55432 |
| anti-HIV_cap256-119-033789_VR-Chain | 1939 | 9581, 17223, 24865, 32507, 40149, 47791, 55433 |
| anti-HIV_cap256-119-033641_VR-Chain | 1940 | 9582, 17224, 24866, 32508, 40150, 47792, 55434 |
| anti-HIV_cap256-119-032113_VR-Chain | 1941 | 9583, 17225, 24867, 32509, 40151, 47793, 55435 |
| anti-HIV_cap256-119-031739_VR-Chain | 1942 | 9584, 17226, 24868, 32510, 40152, 47794, 55436 |
| anti-HIV_cap256-119-030932_VR-Chain | 1943 | 9585, 17227, 24869, 32511, 40153, 47795, 55437 |
| anti-HIV_cap256-119-030740_VR-Chain | 1944 | 9586, 17228, 24870, 32512, 40154, 47796, 55438 |
| anti-HIV_cap256-119-030197_VR-Chain | 1945 | 9587, 17229, 24871, 32513, 40155, 47797, 55439 |
| anti-HIV_cap256-119-027047_VR-Chain | 1946 | 9588, 17230, 24872, 32514, 40156, 47798, 55440 |
| anti-HIV_cap256-119-026950_VR-Chain | 1947 | 9589, 17231, 24873, 32515, 40157, 47799, 55441 |
| anti-HIV_cap256-119-026279_VR-Chain | 1948 | 9590, 17232, 24874, 32516, 40158, 47800, 55442 |
| anti-HIV_cap256-119-025355_VR-Chain | 1949 | 9591, 17233, 24875, 32517, 40159, 47801, 55443 |
| anti-HIV_cap256-119-025301_VR-Chain | 1950 | 9592, 17234, 24876, 32518, 40160, 47802, 55444 |
| anti-HIV_cap256-119-025010_VR-Chain | 1951 | 9593, 17235, 24877, 32519, 40161, 47803, 55445 |
| anti-HIV_cap256-119-024631_VR-Chain | 1952 | 9594, 17236, 24878, 32520, 40162, 47804, 55446 |
| anti-HIV_cap256-119-024467_VR-Chain | 1953 | 9595, 17237, 24879, 32521, 40163, 47805, 55447 |
| anti-HIV_cap256-119-023805_VR-Chain | 1954 | 9596, 17238, 24880, 32522, 40164, 47806, 55448 |
| anti-HIV_cap256-119-021736_VR-Chain | 1955 | 9597, 17239, 24881, 32523, 40165, 47807, 55449 |
| anti-HIV_cap256-119-021203_VR-Chain | 1956 | 9598, 17240, 24882, 32524, 40166, 47808, 55450 |
| anti-HIV_cap256-119-020569_VR-Chain | 1957 | 9599, 17241, 24883, 32525, 40167, 47809, 55451 |
| anti-HIV_cap256-119-019432_VR-Chain | 1958 | 9600, 17242, 24884, 32526, 40168, 47810, 55452 |
| anti-HIV_cap256-119-018827_VR-Chain | 1959 | 9601, 17243, 24885, 32527, 40169, 47811, 55453 |
| anti-HIV_cap256-119-018483_VR-Chain | 1960 | 9602, 17244, 24886, 32528, 40170, 47812, 55454 |
| anti-HIV_cap256-119-018118_VR-Chain | 1961 | 9603, 17245, 24887, 32529, 40171, 47813, 55455 |
| anti-HIV_cap256-119-017782_VR-Chain | 1962 | 9604, 17246, 24888, 32530, 40172, 47814, 55456 |
| anti-HIV_cap256-119-017669_VR-Chain | 1963 | 9605, 17247, 24889, 32531, 40173, 47815, 55457 |
| anti-HIV_cap256-119-016976_VR-Chain | 1964 | 9606, 17248, 24890, 32532, 40174, 47816, 55458 |
| anti-HIV_cap256-119-015432_VR-Chain | 1965 | 9607, 17249, 24891, 32533, 40175, 47817, 55459 |
| anti-HIV_cap256-119-015281_VR-Chain | 1966 | 9608, 17250, 24892, 32534, 40176, 47818, 55460 |
| anti-HIV_cap256-119-014957_VR-Chain | 1967 | 9609, 17251, 24893, 32535, 40177, 47819, 55461 |
| anti-HIV_cap256-119-014777_VR-Chain | 1968 | 9610, 17252, 24894, 32536, 40178, 47820, 55462 |
| anti-HIV_cap256-119-014313_VR-Chain | 1969 | 9611, 17253, 24895, 32537, 40179, 47821, 55463 |
| anti-HIV_cap256-119-014219_VR-Chain | 1970 | 9612, 17254, 24896, 32538, 40180, 47822, 55464 |
| anti-HIV_cap256-119-013631_VR-Chain | 1971 | 9613, 17255, 24897, 32539, 40181, 47823, 55465 |
| anti-HIV_cap256-119-012924_VR-Chain | 1972 | 9614, 17256, 24898, 32540, 40182, 47824, 55466 |

TABLE 3-continued

RNA and amino acid sequences of exemplified antibodies

| Name | Protein SEQ ID NO | RNA SEQ ID NO |
| --- | --- | --- |
| anti-HIV__cap256-119-011793__VR-Chain | 1973 | 9615, 17257, 24899, 32541, 40183, 47825, 55467 |
| anti-HIV__cap256-119-011413__VR-Chain | 1974 | 9619, 17258, 24900, 32542, 40184, 47826, 55468 |
| anti-HIV__cap256-119-011323__VR-Chain | 1975 | 9617, 17259, 24901, 32543, 40185, 47827, 55469 |
| anti-HIV__cap256-119-011233__VR-Chain | 1976 | 9618, 17260, 24902, 32544, 40186, 47828, 55470 |
| anti-HIV__cap256-119-009038__VR-Chain | 1977 | 9619, 17261, 24903, 32545, 40187, 47829, 55471 |
| anti-HIV__cap256-119-008756__VR-Chain | 1978 | 9620, 17262, 24904, 32546, 40188, 47830, 55472 |
| anti-HIV__cap256-119-008055__VR-Chain | 1979 | 9621, 17263, 24905, 32547, 40189, 47831, 55473 |
| anti-HIV__cap256-119-006949__VR-Chain | 1980 | 9622, 17264, 24906, 32548, 40190, 47832, 55474 |
| anti-HIV__cap256-119-006685__VR-Chain | 1981 | 9623, 17265, 24907, 32549, 40191, 47833, 55475 |
| anti-HIV__cap256-119-006015__VR-Chain | 1982 | 9624, 17266, 24908, 32550, 40192, 47834, 55476 |
| anti-HIV__cap256-119-005841__VR-Chain | 1983 | 9625, 17267, 24909, 32551, 40193, 47835, 55477 |
| anti-HIV__cap256-119-005824__VR-Chain | 1984 | 9626, 17268, 24910, 32552, 40194, 47836, 55478 |
| anti-HIV__cap256-119-005494__VR-Chain | 1985 | 9627, 17269, 24911, 32553, 40195, 47837, 55479 |
| anti-HIV__cap256-119-004949__VR-Chain | 1986 | 9628, 17270, 24912, 32554, 40196, 47838, 55480 |
| anti-HIV__cap256-119-004422__VR-Chain | 1987 | 9629, 17271, 24913, 32555, 40197, 47839, 55481 |
| anti-HIV__cap256-119-003932__VR-Chain | 1988 | 9630, 17272, 24914, 32556, 40198, 47840, 55482 |
| anti-HIV__cap256-119-003577__VR-Chain | 1989 | 9631, 17273, 24915, 32557, 40199, 47841, 55483 |
| anti-HIV__cap256-119-002155__VR-Chain | 1990 | 9632, 17274, 24916, 32558, 40200, 47842, 55484 |
| anti-HIV__cap256-119-002017__VR-Chain | 1991 | 9633, 17275, 24917, 32559, 40201, 47843, 55485 |
| anti-HIV__cap256-119-001312__VR-Chain | 1992 | 9634, 17276, 24918, 32560, 40202, 47844, 55486 |
| anti-HIV__cap256-119-001017__VR-Chain | 1993 | 9635, 17277, 24919, 32561, 40203, 47845, 55487 |
| anti-HIV__cap256-119-000594__VR-Chain | 1994 | 9636, 17278, 24920, 32562, 40204, 47846, 55488 |
| anti-HIV__cap256-059-241099__VR-Chain | 1995 | 9637, 17279, 24921, 32563, 40205, 47847, 55489 |
| anti-HIV__cap256-059-207529__VR-Chain | 1996 | 9638, 17280, 24922, 32564, 40206, 47848, 55490 |
| anti-HIV__cap256-059-205541__VR-Chain | 1997 | 9639, 17281, 24923, 32565, 40207, 47849, 55491 |
| anti-HIV__cap256-059-188439__VR-Chain | 1998 | 9640, 17282, 24924, 32566, 40208, 47850, 55492 |
| anti-HIV__cap256-059-187234__VR-Chain | 1999 | 9641, 17283, 24925, 32567, 40209, 47851, 55493 |
| anti-HIV__cap256-059-187047__VR-Chain | 2000 | 9642, 17284, 24926, 32568, 40210, 47852, 55494 |
| anti-HIV__cap256-059-186068__VR-Chain | 2001 | 9643, 17285, 24927, 32569, 40211, 47853, 55495 |
| anti-HIV__cap256-059-182835__VR-Chain | 2002 | 9644, 17286, 24928, 32570, 40212, 47854, 55496 |
| anti-HIV__cap256-059-176659__VR-Chain | 2003 | 9645, 17287, 24929, 32571, 40213, 47855, 55497 |
| anti-HIV__cap256-059-172956__VR-Chain | 2004 | 9646, 17288, 24930, 32572, 40214, 47856, 55498 |
| anti-HIV__cap256-059-171272__VR-Chain | 2005 | 9647, 17289, 24931, 32573, 40215, 47857, 55499 |
| anti-HIV__cap256-059-168734__VR-Chain | 2006 | 9648, 17290, 24932, 32574, 40216, 47858, 55500 |
| anti-HIV__cap256-059-155838__VR-Chain | 2007 | 9649, 17291, 24933, 32575, 40217, 47859, 55501 |
| anti-HIV__cap256-059-149799__VR-Chain | 2008 | 9650, 17292, 24934, 32576, 40218, 47860, 55502 |
| anti-HIV__cap256-059-148168__VR-Chain | 2009 | 9651, 17293, 24935, 32577, 40219, 47861, 55503 |
| anti-HIV__cap256-059-144685__VR-Chain | 2010 | 9652, 17294, 24936, 32578, 40220, 47862, 55504 |
| anti-HIV__cap256-059-140017__VR-Chain | 2011 | 9653, 17295, 24937, 32579, 40221, 47863, 55505 |
| anti-HIV__cap256-059-137547__VR-Chain | 2012 | 9654, 17296, 24938, 32580, 40222, 47864, 55506 |
| anti-HIV__cap256-059-131908__VR-Chain | 2013 | 9655, 17297, 24939, 32581, 40223, 47865, 55507 |
| anti-HIV__cap256-059-116006__VR-Chain | 2014 | 9656, 17298, 24940, 32582, 40224, 47866, 55508 |
| anti-HIV__cap256-059-115783__VR-Chain | 2015 | 9657, 17299, 24941, 32583, 40225, 47867, 55509 |
| anti-HIV__cap256-059-114609__VR-Chain | 2016 | 9658, 17300, 24942, 32584, 40226, 47868, 55510 |
| anti-HIV__cap256-059-113952__VR-Chain | 2017 | 9659, 17301, 24943, 32585, 40227, 47869, 55511 |
| anti-HIV__cap256-059-113878__VR-Chain | 2018 | 9660, 17302, 24944, 32586, 40228, 47870, 55512 |
| anti-HIV__cap256-059-113622__VR-Chain | 2019 | 9661, 17303, 24945, 32587, 40229, 47871, 55513 |
| anti-HIV__cap256-059-109427__VR-Chain | 2020 | 9662, 17304, 24946, 32588, 40230, 47872, 55514 |
| anti-HIV__cap256-059-109081__VR-Chain | 2021 | 9663, 17305, 24947, 32589, 40231, 47873, 55515 |
| anti-HIV__cap256-059-107590__VR-Chain | 2022 | 9664, 17306, 24948, 32590, 40232, 47874, 55516 |
| anti-HIV__cap256-059-107504__VR-Chain | 2023 | 9665, 17307, 24949, 32591, 40233, 47875, 55517 |
| anti-HIV__cap256-059-099614__VR-Chain | 2024 | 9666, 17308, 24950, 32592, 40234, 47876, 55518 |
| anti-HIV__cap256-059-098972__VR-Chain | 2025 | 9667, 17309, 24951, 32593, 40235, 47877, 55519 |
| anti-HIV__cap256-059-097236__VR-Chain | 2026 | 9668, 17310, 24952, 32594, 40236, 47878, 55520 |
| anti-HIV__cap256-059-091487__VR-Chain | 2027 | 9669, 17311, 24953, 32595, 40237, 47879, 55521 |
| anti-HIV__cap256-059-089812__VR-Chain | 2028 | 9670, 17312, 24954, 32596, 40238, 47880, 55522 |
| anti-HIV__cap256-059-088468__VR-Chain | 2029 | 9671, 17313, 24955, 32597, 40239, 47881, 55523 |
| anti-HIV__cap256-059-088341__VR-Chain | 2030 | 9672, 17314, 24956, 32598, 40240, 47882, 55524 |
| anti-HIV__cap256-059-086533__VR-Chain | 2031 | 9673, 17315, 24957, 32599, 40241, 47883, 55525 |
| anti-HIV__cap256-059-086043__VR-Chain | 2032 | 9674, 17316, 24958, 32600, 40242, 47884, 55526 |
| anti-HIV__cap256-059-084191__VR-Chain | 2033 | 9675, 17317, 24959, 32601, 40243, 47885, 55527 |
| anti-HIV__cap256-059-082135__VR-Chain | 2034 | 9676, 17318, 24960, 32602, 40244, 47886, 55528 |
| anti-HIV__cap256-059-079417__VR-Chain | 2035 | 9677, 17319, 24961, 32603, 40245, 47887, 55529 |
| anti-HIV__cap256-059-076027__VR-Chain | 2036 | 9678, 17320, 24962, 32604, 40246, 47888, 55530 |
| anti-HIV__cap256-059-075082__VR-Chain | 2037 | 9679, 17321, 24963, 32605, 40247, 47889, 55531 |
| anti-HIV__cap256-059-072575__VR-Chain | 2038 | 9680, 17322, 24964, 32606, 40248, 47890, 55532 |
| anti-HIV__cap256-059-071926__VR-Chain | 2039 | 9681, 17323, 24965, 32607, 40249, 47891, 55533 |
| anti-HIV__cap256-059-069638__VR-Chain | 2040 | 9682, 17324, 24966, 32608, 40250, 47892, 55534 |
| anti-HIV__cap256-059-069165__VR-Chain | 2041 | 9683, 17325, 24967, 32609, 40251, 47893, 55535 |
| anti-HIV__cap256-059-068956__VR-Chain | 2042 | 9684, 17326, 24968, 32610, 40252, 47894, 55536 |
| anti-HIV__cap256-059-068876__VR-Chain | 2043 | 9685, 17327, 24969, 32611, 40253, 47895, 55537 |
| anti-HIV__cap256-059-067733__VR-Chain | 2044 | 9686, 17328, 24970, 32612, 40254, 47896, 55538 |
| anti-HIV__cap256-059-067450__VR-Chain | 2045 | 9687, 17329, 24971, 32613, 40255, 47897, 55539 |
| anti-HIV__cap256-059-065694__VR-Chain | 2046 | 9688, 17330, 24972, 32614, 40256, 47898, 55540 |
| anti-HIV__cap256-059-065109__VR-Chain | 2047 | 9689, 17331, 24973, 32615, 40257, 47899, 55541 |
| anti-HIV__cap256-059-065060__VR-Chain | 2048 | 9690, 17332, 24974, 32616, 40258, 47900, 55542 |

TABLE 3-continued

RNA and amino acid sequences of exemplified antibodies

| Name | Protein SEQ ID NO | RNA SEQ ID NO |
|---|---|---|
| anti-HIV_cap256-059-064001_VR-Chain | 2049 | 9691, 17333, 24975, 32617, 40256, 47901, 55543 |
| anti-HIV_cap256-059-063270_VR-Chain | 2050 | 9692, 17334, 24976, 32618, 40260, 47902, 55544 |
| anti-HIV_cap256-059-061357_VR-Chain | 2051 | 9693, 17335, 24977, 32619, 40261, 47903, 55545 |
| anti-HIV_cap256-059-059834_VR-Chain | 2052 | 9694, 17336, 24978, 32620, 40262, 47904, 55546 |
| anti-HIV_cap256-059-059313_VR-Chain | 2053 | 9695, 17337, 24979, 32621, 40263, 47905, 55547 |
| anti-HIV_cap256-059-057130_VR-Chain | 2054 | 9696, 17338, 24980, 32622, 40264, 47906, 55548 |
| anti-HIV_cap256-059-050520_VR-Chain | 2055 | 9697, 17339, 24981, 32623, 40265, 47907, 55549 |
| anti-HIV_cap256-059-049839_VR-Chain | 2056 | 9698, 17340, 24982, 32624, 40266, 47908, 55550 |
| anti-HIV_cap256-059-048503_VR-Chain | 2057 | 9699, 17341, 24983, 32625, 40267, 47909, 55551 |
| anti-HIV_cap256-059-045516_VR-Chain | 2058 | 9700, 17342, 24984, 32626, 40268, 47910, 55552 |
| anti-HIV_cap256-059-044188_VR-Chain | 2059 | 9701, 17343, 24985, 32627, 40269, 47911, 55553 |
| anti-HIV_cap256-059-044105_VR-Chain | 2060 | 9702, 17344, 24986, 32628, 40270, 47912, 55554 |
| anti-HIV_cap256-059-042100_VR-Chain | 2061 | 9703, 17345, 24987, 32629, 40271, 47913, 55555 |
| anti-HIV_cap256-059-040742_VR-Chain | 2062 | 9704, 17346, 24988, 32630, 40272, 47914, 55556 |
| anti-HIV_cap256-059-040554_VR-Chain | 2063 | 9705, 17347, 24989, 32631, 40273, 47915, 55557 |
| anti-HIV_cap256-059-039660_VR-Chain | 2064 | 9706, 17348, 24990, 32632, 40274, 47916, 55558 |
| anti-HIV_cap256-059-039298_VR-Chain | 2065 | 9707, 17349, 24991, 32633, 40275, 47917, 55559 |
| anti-HIV_cap256-059-037873_VR-Chain | 2066 | 9708, 17350, 24992, 32634, 40276, 47918, 55560 |
| anti-HIV_cap256-059-037633_VR-Chain | 2067 | 9709, 17351, 24993, 32635, 40277, 47919, 55561 |
| anti-HIV_cap256-059-036817_VR-Chain | 2068 | 9710, 17352, 24994, 32636, 40278, 47920, 55562 |
| anti-HIV_cap256-059-032787_VR-Chain | 2069 | 9711, 17353, 24995, 32637, 40279, 47921, 55563 |
| anti-HIV_cap256-059-032427_VR-Chain | 2070 | 9712, 17354, 24996, 32638, 40280, 47922, 55564 |
| anti-HIV_cap256-059-029390_VR-Chain | 2071 | 9713, 17355, 24997, 32639, 40281, 47923, 55565 |
| anti-HIV_cap256-059-027877_VR-Chain | 2072 | 9714, 17356, 24998, 32640, 40282, 47924, 55566 |
| anti-HIV_cap256-059-026640_VR-Chain | 2073 | 9715, 17357, 24999, 32641, 40283, 47925, 55567 |
| anti-HIV_cap256-059-026017_VR-Chain | 2074 | 9716, 17358, 25000, 32642, 40284, 47926, 55568 |
| anti-HIV_cap256-059-024100_VR-Chain | 2075 | 9717, 17359, 25001, 32643, 40285, 47927, 55569 |
| anti-HIV_cap256-059-023966_VR-Chain | 2076 | 9718, 17360, 25002, 32644, 40286, 47928, 55570 |
| anti-HIV_cap256-059-020534_VR-Chain | 2077 | 9719, 17361, 25003, 32645, 40287, 47929, 55571 |
| anti-HIV_cap256-059-019513_VR-Chain | 2078 | 9720, 17362, 25004, 32646, 40288, 47930, 55572 |
| anti-HIV_cap256-059-012963_VR-Chain | 2079 | 9721, 17363, 25005, 32647, 40289, 47931, 55573 |
| anti-HIV_cap256-059-010396_VR-Chain | 2080 | 9722, 17364, 25006, 32648, 40290, 47932, 55574 |
| anti-HIV_cap256-059-008136_VR-Chain | 2081 | 9723, 17365, 25007, 32649, 40291, 47933, 55575 |
| anti-HIV_cap256-059-006147_VR-Chain | 2082 | 9724, 17366, 25008, 32650, 40292, 47934, 55576 |
| anti-HIV_cap256-059-005081_VR-Chain | 2083 | 9725, 17367, 25009, 32651, 40293, 47935, 55577 |
| anti-HIV_cap256-059-005006_VR-Chain | 2084 | 9726, 17368, 25010, 32652, 40294, 47936, 55578 |
| anti-HIV_cap256-059-004451_VR-Chain | 2085 | 9727, 17369, 25011, 32653, 40295, 47937, 55579 |
| anti-HIV_cap256-059-003571_VR-Chain | 2086 | 9728, 17370, 25012, 32654, 40296, 47938, 55580 |
| anti-HIV_cap256-059-003449_VR-Chain | 2087 | 9729, 17371, 25013, 32655, 40297, 47939, 55581 |
| anti-HIV_cap256-059-002712_VR-Chain | 2088 | 9730, 17372, 25014, 32656, 40298, 47940, 55582 |
| anti-HIV_cap256-059-001573_VR-Chain | 2089 | 9731, 17373, 25015, 32657, 40299, 47941, 55583 |
| anti-HIV_cap256-059-001379_VR-Chain | 2090 | 9732, 17374, 25016, 32658, 40300, 47942, 55584 |
| anti-HIV_cap256-059-001029_VR-Chain | 2091 | 9733, 17375, 25017, 32659, 40301, 47943, 55585 |
| anti-HIV_cap256-048-165087_VR-Chain | 2092 | 9734, 17376, 25018, 32660, 40302, 47944, 55586 |
| anti-HIV_cap256-048-158861_VR-Chain | 2093 | 9735, 17377, 25019, 32661, 40303, 47945, 55587 |
| anti-HIV_cap256-048-158280_VR-Chain | 2094 | 9736, 17378, 25020, 32662, 40304, 47946, 55588 |
| anti-HIV_cap256-048-157928_VR-Chain | 2095 | 9737, 17379, 25021, 32663, 40305, 47947, 55589 |
| anti-HIV_cap256-048-157056_VR-Chain | 2096 | 9738, 17380, 25022, 32664, 40306, 47948, 55590 |
| anti-HIV_cap256-048-156422_VR-Chain | 2097 | 9739, 17381, 25023, 32665, 40307, 47949, 55591 |
| anti-HIV_cap256-048-152863_VR-Chain | 2098 | 9740, 17382, 25024, 32666, 40308, 47950, 55592 |
| anti-HIV_cap256-048-152770_VR-Chain | 2099 | 9741, 17383, 25025, 32667, 40309, 47951, 55593 |
| anti-HIV_cap256-048-150027_VR-Chain | 2100 | 9742, 17384, 25026, 32668, 40310, 47952, 55594 |
| anti-HIV_cap256-048-148246_VR-Chain | 2101 | 9743, 17385, 25027, 32669, 40311, 47953, 55595 |
| anti-HIV_cap256-048-147428_VR-Chain | 2102 | 9744, 17386, 25028, 32670, 40312, 47954, 55596 |
| anti-HIV_cap256-048-146603_VR-Chain | 2103 | 9745, 17387, 25029, 32671, 40313, 47955, 55597 |
| anti-HIV_cap256-048-145735_VR-Chain | 2104 | 9746, 17388, 25030, 32672, 40314, 47956, 55598 |
| anti-HIV_cap256-048-145116_VR-Chain | 2105 | 9747, 17389, 25031, 32673, 40315, 47957, 55599 |
| anti-HIV_cap256-048-144077_VR-Chain | 2106 | 9748, 17390, 25032, 32674, 40316, 47958, 55600 |
| anti-HIV_cap256-048-142876_VR-Chain | 2107 | 9749, 17391, 25033, 32675, 40317, 47959, 55601 |
| anti-HIV_cap256-048-140582_VR-Chain | 2108 | 9750, 17392, 25034, 32676, 40318, 47960, 55602 |
| anti-HIV_cap256-048-139355_VR-Chain | 2109 | 9751, 17393, 25035, 32677, 40319, 47961, 55603 |
| anti-HIV_cap256-048-139151_VR-Chain | 2110 | 9752, 17394, 25036, 32678, 40320, 47962, 55604 |
| anti-HIV_cap256-048-137672_VR-Chain | 2111 | 9753, 17395, 25037, 32679, 40321, 47963, 55605 |
| anti-HIV_cap256-048-137506_VR-Chain | 2112 | 9754, 17396, 25038, 32680, 40322, 47964, 55606 |
| anti-HIV_cap256-048-137270_VR-Chain | 2113 | 9755, 17397, 25039, 32681, 40323, 47965, 55607 |
| anti-HIV_cap256-048-135447_VR-Chain | 2114 | 9756, 17398, 25040, 32682, 40324, 47966, 55608 |
| anti-HIV_cap256-048-131966_VR-Chain | 2115 | 9757, 17399, 25041, 32683, 40325, 47967, 55609 |
| anti-HIV_cap256-048-131008_VR-Chain | 2116 | 9758, 17400, 25042, 32684, 40326, 47968, 55610 |
| anti-HIV_cap256-048-129369_VR-Chain | 2117 | 9759, 17401, 25043, 32685, 40327, 47969, 55611 |
| anti-HIV_cap256-048-128476_VR-Chain | 2118 | 9760, 17402, 25044, 32686, 40328, 47970, 55612 |
| anti-HIV_cap256-048-128270_VR-Chain | 2119 | 9761, 17403, 25045, 32687, 40329, 47971, 55613 |
| anti-HIV_cap256-048-126220_VR-Chain | 2120 | 9762, 17404, 25046, 32688, 40330, 47972, 55614 |
| anti-HIV_cap256-048-125713_VR-Chain | 2121 | 9763, 17405, 25047, 32689, 40331, 47973, 55615 |
| anti-HIV_cap256-048-123934_VR-Chain | 2122 | 9764, 17406, 25048, 32690, 40332, 47974, 55616 |
| anti-HIV_cap256-048-122673_VR-Chain | 2123 | 9765, 17407, 25049, 32691, 40333, 47975, 55617 |
| anti-HIV_cap256-048-122208_VR-Chain | 2124 | 9796, 17408, 25050, 32692, 40334, 47976, 55618 |

TABLE 3-continued

RNA and amino acid sequences of exemplified antibodies

| Name | Protein SEQ ID NO | RNA SEQ ID NO |
| --- | --- | --- |
| anti-HIV_cap256-048-121552_VR-Chain | 2125 | 9767, 17409, 25051, 32693, 40335, 47977, 55619 |
| anti-HIV_cap256-048-120643_VR-Chain | 2126 | 9768, 17410, 25052, 32694, 40336, 47978, 55620 |
| anti-HIV_cap256-048-118458_VR-Chain | 2127 | 9769, 17411, 25053, 32695, 40337, 47979, 55621 |
| anti-HIV_cap256-048-118112_VR-Chain | 2128 | 9770, 17412, 25054, 32696, 40338, 47980, 55622 |
| anti-HIV_cap256-048-116469_VR-Chain | 2129 | 9771, 17413, 25055, 32697, 40339, 47981, 55623 |
| anti-HIV_cap256-048-113917_VR-Chain | 2130 | 9772, 17414, 25056, 32698, 40340, 47982, 55624 |
| anti-HIV_cap256-048-112368_VR-Chain | 2131 | 9773, 17415, 25057, 32699, 40341, 47983, 55625 |
| anti-HIV_cap256-048-112047_VR-Chain | 2132 | 9774, 17416, 25058, 32700, 40342, 47984, 55626 |
| anti-HIV_cap256-048-112029_VR-Chain | 2133 | 9775, 17417, 25059, 32701, 40343, 47985, 55627 |
| anti-HIV_cap256-048-110957_VR-Chain | 2134 | 9776, 17418, 25060, 32702, 40344, 47986, 55628 |
| anti-HIV_cap256-048-110526_VR-Chain | 2135 | 9777, 17419, 25061, 32703, 40345, 47987, 55629 |
| anti-HIV_cap256-048-109336_VR-Chain | 2136 | 9778, 17420, 25062, 32704, 40346, 47988, 55630 |
| anti-HIV_cap256-048-108152_VR-Chain | 2137 | 9779, 17421, 25063, 32705, 40347, 47989, 55631 |
| anti-HIV_cap256-048-107799_VR-Chain | 2138 | 9780, 17422, 25064, 32706, 40348, 47990, 55632 |
| anti-HIV_cap256-048-107384_VR-Chain | 2139 | 9781, 17423, 25065, 32707, 40349, 47991, 55633 |
| anti-HIV_cap256-048-106530_VR-Chain | 2140 | 9782, 17424, 25066, 32708, 40350, 47992, 55634 |
| anti-HIV_cap256-048-106464_VR-Chain | 2141 | 9783, 17425, 25067, 32709, 40351, 47993, 55635 |
| anti-HIV_cap256-048-106411_VR-Chain | 2142 | 9784, 17426, 25068, 32710, 40352, 47994, 55636 |
| anti-HIV_cap256-048-106306_VR-Chain | 2143 | 9785, 17427, 25069, 32711, 40353, 47995, 55637 |
| anti-HIV_cap256-048-104496_VR-Chain | 2144 | 9786, 17428, 25070, 32712, 40354, 47996, 55638 |
| anti-HIV_cap256-048-103074_VR-Chain | 2145 | 9787, 17429, 25071, 32713, 40355, 47997, 55639 |
| anti-HIV_cap256-048-100832_VR-Chain | 2146 | 9788, 17430, 25072, 32714, 40356, 47998, 55640 |
| anti-HIV_cap256-048-100188_VR-Chain | 2147 | 9789, 17431, 25073, 32715, 40357, 47999, 55641 |
| anti-HIV_cap256-048-099645_VR-Chain | 2148 | 9790, 17432, 25074, 32716, 40358, 48000, 55642 |
| anti-HIV_cap256-048-098137_VR-Chain | 2149 | 9791, 17433, 25075, 32717, 40359, 48001, 55643 |
| anti-HIV_cap256-048-097878_VR-Chain | 2150 | 9792, 17434, 25076, 32718, 40360, 48002, 55644 |
| anti-HIV_cap256-048-097510_VR-Chain | 2151 | 9793, 17435, 25077, 32719, 40361, 48003, 55645 |
| anti-HIV_cap256-048-097313_VR-Chain | 2152 | 9794, 17436, 25078, 32720, 40362, 48004, 55646 |
| anti-HIV_cap256-048-096626_VR-Chain | 2153 | 9795, 17437, 25079, 32721, 40363, 48005, 55647 |
| anti-HIV_cap256-048-096483_VR-Chain | 2154 | 9796, 17438, 25080, 32722, 40364, 48006, 55648 |
| anti-HIV_cap256-048-095691_VR-Chain | 2155 | 9797, 17439, 25081, 32723, 40365, 48007, 55649 |
| anti-HIV_cap256-048-095525_VR-Chain | 2156 | 9798, 17440, 25082, 32724, 40366, 48008, 55650 |
| anti-HIV_cap256-048-094783_VR-Chain | 2157 | 9799, 17441, 25083, 32725, 40367, 48009, 55651 |
| anti-HIV_cap256-048-094356_VR-Chain | 2158 | 9800, 17442, 25084, 32726, 40368, 48010, 55652 |
| anti-HIV_cap256-048-090756_VR-Chain | 2159 | 9801, 17443, 25085, 32727, 40369, 48011, 55653 |
| anti-HIV_cap256-048-089065_VR-Chain | 2160 | 9802, 17444, 25086, 32728, 40370, 48012, 55654 |
| anti-HIV_cap256-048-084986_VR-Chain | 2161 | 9803, 17445, 25087, 32729, 40371, 48013, 55655 |
| anti-HIV_cap256-048-083355_VR-Chain | 2162 | 9804, 17446, 25088, 32730, 40372, 48014, 55656 |
| anti-HIV_cap256-048-082462_VR-Chain | 2163 | 9805, 17447, 25089, 32731, 40373, 48015, 55657 |
| anti-HIV_cap256-048-082246_VR-Chain | 2164 | 9806, 17448, 25090, 32732, 40374, 48016, 55658 |
| anti-HIV_cap256-048-080752_VR-Chain | 2165 | 9807, 17449, 25091, 32733, 40375, 48017, 55659 |
| anti-HIV_cap256-048-078409_VR-Chain | 2166 | 9808, 17450, 25092, 32734, 40376, 48018, 55660 |
| anti-HIV_cap256-048-078273_VR-Chain | 2167 | 9809, 17451, 25093, 32735, 40377, 48019, 55661 |
| anti-HIV_cap256-048-078062_VR-Chain | 2168 | 9810, 17452, 25094, 32736, 40378, 48020, 55662 |
| anti-HIV_cap256-048-077798_VR-Chain | 2169 | 9811, 17453, 25095, 32737, 40379, 48021, 55663 |
| anti-HIV_cap256-048-073853_VR-Chain | 2170 | 9812, 17454, 25096, 32738, 40380, 48022, 55664 |
| anti-HIV_cap256-048-071661_VR-Chain | 2171 | 9813, 17455, 25097, 32739, 40381, 48023, 55665 |
| anti-HIV_cap256-048-071360_VR-Chain | 2172 | 9814, 17456, 25098, 32740, 40382, 48024, 55666 |
| anti-HIV_cap256-048-070955_VR-Chain | 2173 | 9815, 17457, 25099, 32741, 40383, 48025, 55667 |
| anti-HIV_cap256-048-070061_VR-Chain | 2174 | 9816, 17458, 25100, 32742, 40384, 48026, 55668 |
| anti-HIV_cap256-048-069669_VR-Chain | 2175 | 9817, 17459, 25101, 32743, 40385, 48027, 55669 |
| anti-HIV_cap256-048-069205_VR-Chain | 2176 | 9818, 17460, 25102, 32744, 40386, 48028, 55670 |
| anti-HIV_cap256-048-068882_VR-Chain | 2177 | 9819, 17461, 25103, 32745, 40387, 48029, 55671 |
| anti-HIV_cap256-048-067764_VR-Chain | 2178 | 9820, 17462, 25104, 32746, 40388, 48030, 55672 |
| anti-HIV_cap256-048-066845_VR-Chain | 2179 | 9821, 17463, 25105, 32747, 40389, 48031, 55673 |
| anti-HIV_cap256-048-065226_VR-Chain | 2180 | 9822, 17464, 25106, 32748, 40390, 48032, 55674 |
| anti-HIV_cap256-048-063717_VR-Chain | 2181 | 9823, 17465, 25107, 32749, 40391, 48033, 55675 |
| anti-HIV_cap256-048-063150_VR-Chain | 2182 | 9824, 17466, 25108, 32750, 40392, 48034, 55676 |
| anti-HIV_cap256-048-062431_VR-Chain | 2183 | 9825, 17467, 25109, 32751, 40393, 48035, 55677 |
| anti-HIV_cap256-048-060745_VR-Chain | 2184 | 9826, 17468, 25110, 32752, 40394, 48036, 55678 |
| anti-HIV_cap256-048-060420_VR-Chain | 2185 | 9827, 17469, 25111, 32753, 40395, 48037, 55679 |
| anti-HIV_cap256-048-060014_VR-Chain | 2186 | 9828, 17470, 25112, 32754, 40396, 48038, 55680 |
| anti-HIV_cap256-048-059747_VR-Chain | 2187 | 9829, 17471, 25113, 32755, 40397, 48039, 55681 |
| anti-HIV_cap256-048-058393_VR-Chain | 2188 | 9830, 17472, 25114, 32756, 40398, 48040, 55682 |
| anti-HIV_cap256-048-058159_VR-Chain | 2189 | 9831, 17473, 25115, 32757, 40399, 48041, 55683 |
| anti-HIV_cap256-048-057127_VR-Chain | 2190 | 9832, 17474, 25116, 32758, 40400, 48042, 55684 |
| anti-HIV_cap256-048-056251_VR-Chain | 2191 | 9833, 17475, 25117, 32759, 40401, 48043, 55685 |
| anti-HIV_cap256-048-055421_VR-Chain | 2192 | 9834, 17476, 25118, 32760, 40402, 48044, 55686 |
| anti-HIV_cap256-048-054989_VR-Chain | 2193 | 9835, 17477, 25119, 32761, 40403, 48045, 55687 |
| anti-HIV_cap256-048-054759_VR-Chain | 2194 | 9836, 17478, 25120, 32762, 40404, 48046, 55688 |
| anti-HIV_cap256-048-052573_VR-Chain | 2195 | 9837, 17479, 25121, 32763, 40405, 48047, 55689 |
| anti-HIV_cap256-048-051477_VR-Chain | 2196 | 9838, 17480, 25122, 32764, 40406, 48048, 55690 |
| anti-HIV_cap256-048-051299_VR-Chain | 2197 | 9839, 17481, 25123, 32765, 40407, 48049, 55691 |
| anti-HIV_cap256-048-050815_VR-Chain | 2198 | 9840, 17482, 25124, 32766, 40408, 48050, 55692 |
| anti-HIV_cap256-048-049884_VR-Chain | 2199 | 9841, 17483, 25125, 32767, 40409, 48051, 55693 |
| anti-HIV_cap256-048-049170_VR-Chain | 2200 | 9842, 17484, 25126, 32768, 40410, 48052, 55694 |

TABLE 3-continued

RNA and amino acid sequences of exemplified antibodies

| Name | Protein SEQ ID NO | RNA SEQ ID NO |
| --- | --- | --- |
| anti-HIV__cap256-048-048531__VR-Chain | 2201 | 9843, 17485, 25127, 32769, 40411, 48053, 55695 |
| anti-HIV__cap256-048-048259__VR-Chain | 2202 | 9844, 17486, 25128, 32770, 40412, 48054, 55696 |
| anti-HIV__cap256-048-047313__VR-Chain | 2203 | 9845, 17487, 25129, 32771, 40413, 48055, 55697 |
| anti-HIV__cap256-048-046596__VR-Chain | 2204 | 9846, 17488, 25130, 32772, 40414, 48056, 55698 |
| anti-HIV__cap256-048-044781__VR-Chain | 2205 | 9847, 17489, 25131, 32773, 40415, 48057, 55699 |
| anti-HIV__cap256-048-042599__VR-Chain | 2206 | 9848, 17490, 25132, 32774, 40416, 48058, 55700 |
| anti-HIV__cap256-048-041276__VR-Chain | 2207 | 9849, 17491, 25133, 32775, 40417, 48059, 55701 |
| anti-HIV__cap256-048-040200__VR-Chain | 2208 | 9850, 17492, 25134, 32776, 40418, 48060, 55702 |
| anti-HIV__cap256-048-039061__VR-Chain | 2209 | 9851, 17493, 25135, 32777, 40419, 48061, 55703 |
| anti-HIV__cap256-048-038515__VR-Chain | 2210 | 9852, 17494, 25136, 32778, 40420, 48062, 55704 |
| anti-HIV__cap256-048-038255__VR-Chain | 2211 | 9853, 17495, 25137, 32779, 40421, 48063, 55705 |
| anti-HIV__cap256-048-038177__VR-Chain | 2212 | 9854, 17496, 25138, 32780, 40422, 48064, 55706 |
| anti-HIV__cap256-048-035513__VR-Chain | 2213 | 9855, 17497, 25139, 32781, 40423, 48065, 55707 |
| anti-HIV__cap256-048-034112__VR-Chain | 2214 | 9856, 17498, 25140, 32782, 40424, 48066, 55708 |
| anti-HIV__cap256-048-033983__VR-Chain | 2215 | 9857, 17499, 25141, 32783, 40425, 48067, 55709 |
| anti-HIV__cap256-048-032688__VR-Chain | 2216 | 9858, 17500, 25142, 32784, 40426, 48068, 55710 |
| anti-HIV__cap256-048-031092__VR-Chain | 2217 | 9859, 17501, 25143, 32785, 40427, 48069, 55711 |
| anti-HIV__cap256-048-030464__VR-Chain | 2218 | 9860, 17502, 25144, 32786, 40428, 48070, 55712 |
| anti-HIV__cap256-048-030289__VR-Chain | 2219 | 9861, 17503, 25145, 32787, 40429, 48071, 55713 |
| anti-HIV__cap256-048-030261__VR-Chain | 2220 | 9862, 17504, 25146, 32788, 40430, 48072, 55714 |
| anti-HIV__cap256-048-029362__VR-Chain | 2221 | 9863, 17505, 25147, 32789, 40431, 48073, 55715 |
| anti-HIV__cap256-048-027638__VR-Chain | 2222 | 9864, 17506, 25148, 32790, 40432, 48074, 55716 |
| anti-HIV__cap256-048-027613__VR-Chain | 2223 | 9865, 17507, 25149, 32791, 40433, 48075, 55717 |
| anti-HIV__cap256-048-026627__VR-Chain | 2224 | 9866, 17508, 25150, 32792, 40434, 48076, 55718 |
| anti-HIV__cap256-048-026239__VR-Chain | 2225 | 9867, 17509, 25151, 32793, 40435, 48077, 55719 |
| anti-HIV__cap256-048-025518__VR-Chain | 2226 | 9868, 17510, 25152, 32794, 40436, 48078, 55720 |
| anti-HIV__cap256-048-024854__VR-Chain | 2227 | 9869, 17511, 25153, 32795, 40437, 48079, 55721 |
| anti-HIV__cap256-048-024537__VR-Chain | 2228 | 9870, 17512, 25154, 32796, 40438, 48080, 55722 |
| anti-HIV__cap256-048-021781__VR-Chain | 2229 | 9871, 17513, 25155, 32797, 40439, 48081, 55723 |
| anti-HIV__cap256-048-021758__VR-Chain | 2230 | 9872, 17514, 25156, 32798, 40440, 48082, 55724 |
| anti-HIV__cap256-048-020988__VR-Chain | 2231 | 9873, 17515, 25157, 32799, 40441, 48083, 55725 |
| anti-HIV__cap256-048-020663__VR-Chain | 2232 | 9874, 17516, 25158, 32800, 40442, 48084, 55726 |
| anti-HIV__cap256-048-020590__VR-Chain | 2233 | 9875, 17517, 25159, 32801, 40443, 48085, 55727 |
| anti-HIV__cap256-048-019765__VR-Chain | 2234 | 9876, 17518, 25160, 32802, 40444, 48086, 55728 |
| anti-HIV__cap256-048-019254__VR-Chain | 2235 | 9877, 17519, 25161, 32803, 40445, 48087, 55729 |
| anti-HIV__cap256-048-018073__VR-Chain | 2236 | 9878, 17520, 25162, 32804, 40446, 48088, 55730 |
| anti-HIV__cap256-048-016775__VR-Chain | 2237 | 9879, 17521, 25163, 32805, 40447, 48089, 55731 |
| anti-HIV__cap256-048-016069__VR-Chain | 2238 | 9880, 17522, 25164, 32806, 40448, 48090, 55732 |
| anti-HIV__cap256-048-015867__VR-Chain | 2239 | 9881, 17523, 25165, 32807, 40449, 48091, 55733 |
| anti-HIV__cap256-048-015673__VR-Chain | 2240 | 9882, 17524, 25166, 32808, 40450, 48092, 55734 |
| anti-HIV__cap256-048-015156__VR-Chain | 2241 | 9883, 17525, 25167, 32809, 40451, 48093, 55735 |
| anti-HIV__cap256-048-014521__VR-Chain | 2242 | 9884, 17526, 25168, 32810, 40452, 48094, 55736 |
| anti-HIV__cap256-048-014475__VR-Chain | 2243 | 9885, 17527, 25169, 32811, 40453, 48095, 55737 |
| anti-HIV__cap256-048-013798__VR-Chain | 2244 | 9886, 17528, 25170, 32812, 40454, 48096, 55738 |
| anti-HIV__cap256-048-013271__VR-Chain | 2245 | 9887, 17529, 25171, 32813, 40455, 48097, 55739 |
| anti-HIV__cap256-048-013180__VR-Chain | 2246 | 9888, 17530, 25172, 32814, 40456, 48098, 55740 |
| anti-HIV__cap256-048-012148__VR-Chain | 2247 | 9889, 17531, 25173, 32815, 40457, 48099, 55741 |
| anti-HIV__cap256-048-011870__VR-Chain | 2248 | 9890, 17532, 25174, 32816, 40458, 48100, 55742 |
| anti-HIV__cap256-048-011530__VR-Chain | 2249 | 9891, 17533, 25175, 32817, 40459, 48101, 55743 |
| anti-HIV__cap256-048-010968__VR-Chain | 2250 | 9892, 17534, 25176, 32818, 40460, 48102, 55744 |
| anti-HIV__cap256-048-010224__VR-Chain | 2251 | 9893, 17535, 25177, 32819, 40461, 48103, 55745 |
| anti-HIV__cap256-048-009749__VR-Chain | 2252 | 9894, 17536, 25178, 32820, 40462, 48104, 55746 |
| anti-HIV__cap256-048-009623__VR-Chain | 2253 | 9895, 17537, 25179, 32821, 40463, 48105, 55747 |
| anti-HIV__cap256-048-008234__VR-Chain | 2254 | 9896, 17538, 25180, 32822, 40464, 48106, 55748 |
| anti-HIV__cap256-048-008149__VR-Chain | 2255 | 9897, 17539, 25181, 32823, 40465, 48107, 55749 |
| anti-HIV__cap256-048-007301__VR-Chain | 2256 | 9898, 17540, 25182, 32824, 40466, 48108, 55750 |
| anti-HIV__cap256-048-007174__VR-Chain | 2257 | 9899, 17541, 25183, 32825, 40467, 48109, 55751 |
| anti-HIV__cap256-048-007079__VR-Chain | 2258 | 9900, 17542, 25184, 32826, 40468, 48110, 55752 |
| anti-HIV__cap256-048-007033__VR-Chain | 2259 | 9901, 17543, 25185, 32827, 40469, 48111, 55753 |
| anti-HIV__cap256-048-006128__VR-Chain | 2260 | 9902, 17544, 25186, 32828, 40470, 48112, 55754 |
| anti-HIV__cap256-048-005999__VR-Chain | 2261 | 9903, 17545, 25187, 32829, 40471, 48113, 55755 |
| anti-HIV__cap256-048-005394__VR-Chain | 2262 | 9904, 17546, 25188, 32830, 40472, 48114, 55756 |
| anti-HIV__cap256-048-004226__VR-Chain | 2263 | 9905, 17547, 25189, 32831, 40473, 48115, 55757 |
| anti-HIV__cap256-048-004097__VR-Chain | 2264 | 9906, 17548, 25190, 32832, 40474, 48116, 55758 |
| anti-HIV__cap256-048-003289__VR-Chain | 2265 | 9907, 17549, 25191, 32833, 40475, 48117, 55759 |
| anti-HIV__cap256-048-002601__VR-Chain | 2266 | 9908, 17550, 25192, 32834, 40476, 48118, 55760 |
| anti-HIV__cap256-048-002129__VR-Chain | 2267 | 9909, 17551, 25193, 32835, 40477, 48119, 55761 |
| anti-HIV__cap256-048-001875__VR-Chain | 2268 | 9910, 17552, 25194, 32836, 40478, 48120, 55762 |
| anti-HIV__cap256-048-001302__VR-Chain | 2269 | 9911, 17553, 25195, 32837, 40479, 48121, 55763 |
| anti-HIV__cap256-048-001203__VR-Chain | 2270 | 9912, 17554, 25196, 32838, 40480, 48122, 55764 |
| anti-HIV__cap256-048-000383__VR-Chain | 2271 | 9913, 17555, 25197, 32839, 40481, 48123, 55765 |
| anti-HIV__cap256-038-261791__VR-Chain | 2272 | 9914, 17556, 25198, 32840, 40482, 48124, 55766 |
| anti-HIV__cap256-038-241540__VR-Chain | 2273 | 9915, 17557, 25199, 32841, 40483, 48125, 55767 |
| anti-HIV__cap256-038-235677__VR-Chain | 2274 | 9916, 17558, 25200, 32842, 40484, 48126, 55768 |
| anti-HIV__cap256-038-234314__VR-Chain | 2275 | 9917, 17559, 25201, 32843, 40485, 48127, 55769 |
| anti-HIV__cap256-038-234273__VR-Chain | 2276 | 9918, 17560, 25202, 32844, 40486, 48128, 55770 |

TABLE 3-continued

RNA and amino acid sequences of exemplified antibodies

| Name | Protein SEQ ID NO | RNA SEQ ID NO |
| --- | --- | --- |
| anti-HIV_cap256-038-223164_VR-Chain | 2277 | 9919, 17561, 25203, 32845, 40487, 48129, 55771 |
| anti-HIV_cap256-038-220289_VR-Chain | 2278 | 9920, 17562, 25204, 32846, 40488, 48130, 55772 |
| anti-HIV_cap256-038-220020_VR-Chain | 2279 | 9921, 17563, 25205, 32847, 40489, 48131, 55773 |
| anti-HIV_cap256-038-216853_VR-Chain | 2280 | 9922, 17564, 25206, 32848, 40490, 48132, 55774 |
| anti-HIV_cap256-038-213466_VR-Chain | 2281 | 9923, 17565, 25207, 32849, 40491, 48133, 55775 |
| anti-HIV_cap256-038-213212_VR-Chain | 2282 | 9924, 17566, 25208, 32850, 40492, 48134, 55776 |
| anti-HIV_cap256-038-213120_VR-Chain | 2283 | 9925, 17567, 25209, 32851, 40493, 48135, 55777 |
| anti-HIV_cap256-038-212592_VR-Chain | 2284 | 9926, 17568, 25210, 32852, 40494, 48136, 55778 |
| anti-HIV_cap256-038-211790_VR-Chain | 2285 | 9927, 17569, 25211, 32853, 40495, 48137, 55779 |
| anti-HIV_cap256-038-209916_VR-Chain | 2286 | 9928, 17570, 25212, 32854, 40496, 48138, 55780 |
| anti-HIV_cap256-038-207938_VR-Chain | 2287 | 9929, 17571, 25213, 32855, 40497, 48139, 55781 |
| anti-HIV_cap256-038-202245_VR-Chain | 2288 | 9930, 17572, 25214, 32856, 40498, 48140, 55782 |
| anti-HIV_cap256-038-197721_VR-Chain | 2289 | 9931, 17573, 25215, 32857, 40499, 48141, 55783 |
| anti-HIV_cap256-038-196679_VR-Chain | 2290 | 9932, 17574, 25216, 32858, 40500, 48142, 55784 |
| anti-HIV_cap256-038-196118_VR-Chain | 2291 | 9933, 17575, 25217, 32859, 40501, 48143, 55785 |
| anti-HIV_cap256-038-195382_VR-Chain | 2292 | 9934, 17576, 25218, 32860, 40502, 48144, 55786 |
| anti-HIV_cap256-038-180001_VR-Chain | 2293 | 9935, 17577, 25219, 32861, 40503, 48145, 55787 |
| anti-HIV_cap256-038-178021_VR-Chain | 2294 | 9936, 17578, 25220, 32862, 40504, 48146, 55788 |
| anti-HIV_cap256-038-177104_VR-Chain | 2295 | 9937, 17579, 25221, 32863, 40505, 48147, 55789 |
| anti-HIV_cap256-038-171261_VR-Chain | 2296 | 9938, 17580, 25222, 32864, 40506, 48148, 55790 |
| anti-HIV_cap256-038-169090_VR-Chain | 2297 | 9939, 17581, 25223, 32865, 40507, 48149, 55791 |
| anti-HIV_cap256-038-168705_VR-Chain | 2298 | 9940, 17582, 25224, 32866, 40508, 48150, 55792 |
| anti-HIV_cap256-038-167685_VR-Chain | 2299 | 9941, 17583, 25225, 32867, 40509, 48151, 55793 |
| anti-HIV_cap256-038-158775_VR-Chain | 2300 | 9942, 17584, 25226, 32868, 40510, 48152, 55794 |
| anti-HIV_cap256-038-157318_VR-Chain | 2301 | 9943, 17585, 25227, 32869, 40511, 48153, 55795 |
| anti-HIV_cap256-038-153058_VR-Chain | 2302 | 9944, 17586, 25228, 32870, 40512, 48154, 55796 |
| anti-HIV_cap256-038-150027_VR-Chain | 2303 | 9945, 17587, 25229, 32871, 40513, 48155, 55797 |
| anti-HIV_cap256-038-146372_VR-Chain | 2304 | 9946, 17588, 25230, 32872, 40514, 48156, 55798 |
| anti-HIV_cap256-038-141868_VR-Chain | 2305 | 9947, 17589, 25231, 32873, 40515, 48157, 55799 |
| anti-HIV_cap256-038-141616_VR-Chain | 2306 | 9948, 17590, 25232, 32874, 40516, 48158, 55800 |
| anti-HIV_cap256-038-127989_VR-Chain | 2307 | 9949, 17591, 25233, 32875, 40517, 48159, 55801 |
| anti-HIV_cap256-038-118109_VR-Chain | 2308 | 9950, 17592, 25234, 32876, 40518, 48160, 55802 |
| anti-HIV_cap256-038-112226_VR-Chain | 2309 | 9951, 17593, 25235, 32877, 40519, 48161, 55803 |
| anti-HIV_cap256-038-105918_VR-Chain | 2310 | 9952, 17594, 25236, 32878, 40520, 48162, 55804 |
| anti-HIV_cap256-038-104487_VR-Chain | 2311 | 9953, 17595, 25237, 32879, 40521, 48163, 55805 |
| anti-HIV_cap256-038-102308_VR-Chain | 2312 | 9954, 17596, 25238, 32880, 40522, 48164, 55806 |
| anti-HIV_cap256-038-091115_VR-Chain | 2313 | 9955, 17597, 25239, 32881, 40523, 48165, 55807 |
| anti-HIV_cap256-038-090262_VR-Chain | 2314 | 9956, 17598, 25240, 32882, 40524, 48166, 55808 |
| anti-HIV_cap256-038-083260_VR-Chain | 2315 | 9957, 17599, 25241, 32883, 40525, 48167, 55809 |
| anti-HIV_cap256-038-080981_VR-Chain | 2316 | 9958, 17600, 25242, 32884, 40526, 48168, 55810 |
| anti-HIV_cap256-038-080873_VR-Chain | 2317 | 9959, 17601, 25243, 32885, 40527, 48169, 55811 |
| anti-HIV_cap256-038-074413_VR-Chain | 2318 | 9960, 17602, 25244, 32886, 40528, 48170, 55812 |
| anti-HIV_cap256-038-073153_VR-Chain | 2319 | 9961, 17603, 25245, 32887, 40529, 48171, 55813 |
| anti-HIV_cap256-038-064227_VR-Chain | 2320 | 9962, 17604, 25246, 32888, 40530, 48172, 55814 |
| anti-HIV_cap256-038-061640_VR-Chain | 2321 | 9963, 17605, 25247, 32889, 40531, 48173, 55815 |
| anti-HIV_cap256-038-059482_VR-Chain | 2322 | 9964, 17606, 25248, 32890, 40532, 48174, 55816 |
| anti-HIV_cap256-038-054000_VR-Chain | 2323 | 9965, 17607, 25249, 32891, 40533, 48175, 55817 |
| anti-HIV_cap256-038-050554_VR-Chain | 2324 | 9966, 17608, 25250, 32892, 40534, 48176, 55818 |
| anti-HIV_cap256-038-044256_VR-Chain | 2325 | 9967, 17609, 25251, 32893, 40535, 48177, 55819 |
| anti-HIV_cap256-038-040944_VR-Chain | 2326 | 9968, 17610, 25252, 32894, 40536, 48178, 55820 |
| anti-HIV_cap256-038-040090_VR-Chain | 2327 | 9969, 17611, 25253, 32895, 40537, 48179, 55821 |
| anti-HIV_cap256-038-032874_VR-Chain | 2328 | 9970, 17612, 25254, 32896, 40538, 48180, 55822 |
| anti-HIV_cap256-038-025899_VR-Chain | 2329 | 9971, 17613, 25255, 32897, 40539, 48181, 55823 |
| anti-HIV_cap256-038-024581_VR-Chain | 2330 | 9972, 17614, 25256, 32898, 40540, 48182, 55824 |
| anti-HIV_cap256-038-013345_VR-Chain | 2331 | 9973, 17615, 25257, 32899, 40541, 48183, 55825 |
| anti-HIV_cap256-038-011559_VR-Chain | 2332 | 9974, 17616, 25258, 32900, 40542, 48184, 55826 |
| anti-HIV_cap256-038-009634_VR-Chain | 2333 | 9975, 17617, 25259, 32901, 40543, 48185, 55827 |
| anti-HIV_cap256-038-006730_VR-Chain | 2334 | 9976, 17618, 25260, 32902, 40544, 48186, 55828 |
| anti-HIV_cap256-038-004887_VR-Chain | 2335 | 9977, 17619, 25261, 32903, 40545, 48187, 55829 |
| anti-HIV_cap256-038-004840_VR-Chain | 2336 | 9978, 17620, 25262, 32904, 40546, 48188, 55830 |
| anti-HIV_cap256-038-002181_VR-Chain | 2337 | 9979, 17621, 25263, 32905, 40547, 48189, 55831 |
| anti-HIV_cap256-038-001902_VR-Chain | 2338 | 9980, 17622, 25264, 32906, 40548, 48190, 55832 |
| anti-HIV_cap256-038-000976_VR-Chain | 2339 | 9981, 17623, 25265, 32907, 40549, 48191, 55833 |
| anti-HIV_cap256-038-000384_VR-Chain | 2340 | 9982, 17624, 25266, 32908, 40550, 48192, 55834 |
| anti-HIV_206-314431_VR-Chain | 2341 | 9983, 17625, 25267, 32909, 40551, 48193, 55835 |
| anti-HIV_206-247594_VR-Chain | 2342 | 9984, 17626, 25268, 32910, 40552, 48194, 55836 |
| anti-HIV_206-116890_VR-Chain | 2343 | 9985, 17627, 25269, 32911, 40553, 48195, 55837 |
| anti-HIV_206-072383_VR-Chain | 2344 | 9986, 17628, 25270, 32912, 40554, 48196, 55838 |
| anti-HIV_206-037527_VR-Chain | 2345 | 9987, 17629, 25271, 32913, 40555, 48197, 55839 |
| anti-HIV_206-009095_VR-Chain | 2346 | 9988, 17630, 25272, 32914, 40556, 48198, 55840 |
| anti-HIV_176-503620_VR-Chain | 2347 | 9989, 17631, 25273, 32915, 40557, 48199, 55841 |
| anti-HIV_176-478729_VR-Chain | 2348 | 9990, 17632, 25274, 32916, 40558, 48200, 55842 |
| anti-HIV_176-245059_VR-Chain | 2349 | 9991, 17633, 25275, 32917, 40559, 48201, 55843 |
| anti-HIV_176-164413_VR-Chain | 2350 | 9992, 17634, 25276, 32918, 40560, 48202, 55844 |
| anti-HIV_176-094308_VR-Chain | 2351 | 9993, 17635, 25277, 32919, 40561, 48203, 55845 |
| anti-HIV_176-065321_VR-Chain | 2352 | 9994, 17636, 25278, 32920, 40562, 48204, 55846 |

TABLE 3-continued

RNA and amino acid sequences of exemplified antibodies

| Name | Protein SEQ ID NO | RNA SEQ ID NO |
|---|---|---|
| anti-HIV_119-099719_VR-Chain | 2353 | 9995, 17637, 25279, 32921, 40563, 48205, 55847 |
| anti-HIV_119-099536_VR-Chain | 2354 | 9996, 17638, 25280, 32922, 40564, 48206, 55848 |
| anti-HIV_119-098907_VR-Chain | 2355 | 9997, 17639, 25281, 32923, 40565, 48207, 55849 |
| anti-HIV_119-098555_VR-Chain | 2356 | 9998, 17640, 25282, 32924, 40566, 48208, 55850 |
| anti-HIV_119-097828_VR-Chain | 2357 | 9999, 17641, 25283, 32925, 40567, 48209, 55851 |
| anti-HIV_119-096480_VR-Chain | 2358 | 10000, 17642, 25284, 32926, 40568, 48210, 55852 |
| anti-HIV_119-095664_VR-Chain | 2359 | 10001, 17643, 25285, 32927, 40569, 48211, 55853 |
| anti-HIV_119-095212_VR-Chain | 2360 | 10002, 17644, 25286, 32928, 40570, 48212, 55854 |
| anti-HIV_119-094773_VR-Chain | 2361 | 10003, 17645, 25287, 32929, 40571, 48213, 55855 |
| anti-HIV_119-094508_VR-Chain | 2362 | 10004, 17646, 25288, 32930, 40572, 48214, 55856 |
| anti-HIV_119-093795_VR-Chain | 2363 | 10005, 17647, 25289, 32931, 40573, 48215, 55857 |
| anti-HIV_119-093732_VR-Chain | 2364 | 10006, 17648, 25290, 32932, 40574, 48216, 55858 |
| anti-HIV_119-092903_VR-Chain | 2365 | 10007, 17649, 25291, 32933, 40575, 48217, 55859 |
| anti-HIV_119-092284_VR-Chain | 2366 | 10008, 17650, 25292, 32934, 40579, 48218, 55860 |
| anti-HIV_119-091586_VR-Chain | 2367 | 10009, 17651, 25293, 32935, 40577, 48219, 55861 |
| anti-HIV_119-091023_VR-Chain | 2368 | 10010, 17652, 25294, 32936, 40578, 48220, 55862 |
| anti-HIV_119-090334_VR-Chain | 2369 | 10011, 17653, 25295, 32937, 40579, 48221, 55863 |
| anti-HIV_119-088694_VR-Chain | 2370 | 10012, 17654, 25296, 32938, 40580, 48222, 55864 |
| anti-HIV_119-088499_VR-Chain | 2371 | 10013, 17655, 25297, 32939, 40581, 48223, 55865 |
| anti-HIV_119-088298_VR-Chain | 2372 | 10014, 17656, 25298, 32940, 40582, 48224, 55866 |
| anti-HIV_119-087488_VR-Chain | 2373 | 10015, 17657, 25299, 32941, 40583, 48225, 55867 |
| anti-HIV_119-087423_VR-Chain | 2374 | 10016, 17658, 25300, 32942, 40584, 48226, 55868 |
| anti-HIV_119-087371_VR-Chain | 2375 | 10017, 17659, 25301, 32943, 40585, 48227, 55869 |
| anti-HIV_119-087279_VR-Chain | 2376 | 10018, 17660, 25302, 32944, 40586, 48228, 55870 |
| anti-HIV_119-087146_VR-Chain | 2377 | 10019, 17661, 25303, 32945, 40587, 48229, 55871 |
| anti-HIV_119-087048_VR-Chain | 2378 | 10020, 17662, 25304, 32946, 40588, 48230, 55872 |
| anti-HIV_119-085802_VR-Chain | 2379 | 10021, 17663, 25305, 32947, 40589, 48231, 55873 |
| anti-HIV_119-085784_VR-Chain | 2380 | 10022, 17664, 25306, 32948, 40590, 48232, 55874 |
| anti-HIV_119-085370_VR-Chain | 2381 | 10023, 17665, 25307, 32949, 40591, 48233, 55875 |
| anti-HIV_119-085276_VR-Chain | 2382 | 10024, 17666, 25308, 32950, 40592, 48234, 55876 |
| anti-HIV_119-084885_VR-Chain | 2383 | 10025, 17667, 25309, 32951, 40593, 48235, 55877 |
| anti-HIV_119-084874_VR-Chain | 2384 | 10026, 17668, 25310, 32952, 40594, 48236, 55878 |
| anti-HIV_119-084691_VR-Chain | 2385 | 10027, 17669, 25311, 32953, 40595, 48237, 55879 |
| anti-HIV_119-083793_VR-Chain | 2386 | 10028, 17670, 25312, 32954, 40596, 48238, 55880 |
| anti-HIV_119-083163_VR-Chain | 2387 | 10029, 17671, 25313, 32955, 40597, 48239, 55881 |
| anti-HIV_119-082331_VR-Chain | 2388 | 10030, 17672, 25314, 32956, 40598, 48240, 55882 |
| anti-HIV_119-082070_VR-Chain | 2389 | 10031, 17673, 25315, 32957, 40599, 48241, 55883 |
| anti-HIV_119-081512_VR-Chain | 2390 | 10032, 17674, 25316, 32958, 40600, 48242, 55884 |
| anti-HIV_119-080816_VR-Chain | 2391 | 10033, 17675, 25317, 32959, 40601, 48243, 55885 |
| anti-HIV_119-079302_VR-Chain | 2392 | 10034, 17676, 25318, 32960, 40602, 48244, 55886 |
| anti-HIV_119-079292_VR-Chain | 2393 | 10035, 17677, 25319, 32961, 40603, 48245, 55887 |
| anti-HIV_119-079289_VR-Chain | 2394 | 10036, 17678, 25320, 32962, 40604, 48246, 55888 |
| anti-HIV_119-078935_VR-Chain | 2395 | 10037, 17679, 25321, 32963, 40605, 48247, 55889 |
| anti-HIV_119-078702_VR-Chain | 2396 | 10038, 17680, 25322, 32964, 40606, 48248, 55890 |
| anti-HIV_119-078593_VR-Chain | 2397 | 10039, 17681, 25323, 32965, 40607, 48249, 55891 |
| anti-HIV_119-077708_VR-Chain | 2398 | 10040, 17682, 25324, 32966, 40608, 48250, 55892 |
| anti-HIV_119-076904_VR-Chain | 2399 | 10041, 17683, 25325, 32967, 40609, 48251, 55893 |
| anti-HIV_119-075862_VR-Chain | 2400 | 10042, 17684, 25326, 32968, 40610, 48252, 55894 |
| anti-HIV_119-075465_VR-Chain | 2401 | 10043, 17685, 25327, 32969, 40611, 48253, 55895 |
| anti-HIV_119-074822_VR-Chain | 2402 | 10044, 17686, 25328, 32970, 40612, 48254, 55896 |
| anti-HIV_119-074629_VR-Chain | 2403 | 10045, 17687, 25329, 32971, 40613, 48255, 55897 |
| anti-HIV_119-074500_VR-Chain | 2404 | 10046, 17688, 25330, 32972, 40614, 48256, 55898 |
| anti-HIV_119-073911_VR-Chain | 2405 | 10047, 17689, 25331, 32973, 40615, 48257, 55899 |
| anti-HIV_119-072765_VR-Chain | 2406 | 10048, 17690, 25332, 32974, 40616, 48258, 55900 |
| anti-HIV_119-072313_VR-Chain | 2407 | 10049, 17691, 25333, 32975, 40617, 48259, 55901 |
| anti-HIV_119-072280_VR-Chain | 2408 | 10050, 17692, 25334, 32976, 40618, 48260, 55902 |
| anti-HIV_119-071693_VR-Chain | 2409 | 10051, 17693, 25335, 32977, 40619, 48261, 55903 |
| anti-HIV_119-071353_VR-Chain | 2410 | 10052, 17694, 25336, 32978, 40620, 48262, 55904 |
| anti-HIV_119-069711_VR-Chain | 2411 | 10053, 17695, 25337, 32979, 40621, 48263, 55905 |
| anti-HIV_119-069061_VR-Chain | 2412 | 10054, 17696, 25338, 32980, 40622, 48264, 55906 |
| anti-HIV_119-068202_VR-Chain | 2413 | 10055, 17697, 25339, 32981, 40623, 48265, 55907 |
| anti-HIV_119-068063_VR-Chain | 2414 | 10056, 17698, 25340, 32982, 40624, 48266, 55908 |
| anti-HIV_119-067980_VR-Chain | 2415 | 10057, 17699, 25341, 32983, 40625, 48267, 55909 |
| anti-HIV_119-067866_VR-Chain | 2416 | 10058, 17700, 25342, 32984, 40626, 48268, 55910 |
| anti-HIV_119-067756_VR-Chain | 2417 | 10059, 17701, 25343, 32985, 40627, 48269, 55911 |
| anti-HIV_119-066859_VR-Chain | 2418 | 10060, 17702, 25344, 32986, 40628, 48270, 55912 |
| anti-HIV_119-065821_VR-Chain | 2419 | 10061, 17703, 25345, 32987, 40629, 48271, 55913 |
| anti-HIV_119-065191_VR-Chain | 2420 | 10062, 17704, 25346, 32988, 40630, 48272, 55914 |
| anti-HIV_119-064667_VR-Chain | 2421 | 10063, 17705, 25347, 32989, 40631, 48273, 55915 |
| anti-HIV_119-063791_VR-Chain | 2422 | 10064, 17706, 25348, 32990, 40632, 48274, 55916 |
| anti-HIV_119-062989_VR-Chain | 2423 | 10065, 17707, 25349, 32991, 40633, 48275, 55917 |
| anti-HIV_119-062286_VR-Chain | 2424 | 10066, 17708, 25350, 32992, 40634, 48276, 55918 |
| anti-HIV_119-061416_VR-Chain | 2425 | 10067, 17709, 25351, 32993, 40635, 48277, 55919 |
| anti-HIV_119-061344_VR-Chain | 2426 | 10068, 17710, 25352, 32994, 40636, 48278, 55920 |
| anti-HIV_119-060240_VR-Chain | 2427 | 10069, 17711, 25353, 32995, 40637, 48279, 55921 |
| anti-HIV_119-060184_VR-Chain | 2428 | 10070, 17712, 25354, 32996, 40638, 48280, 55922 |

TABLE 3-continued

RNA and amino acid sequences of exemplified antibodies

| Name | Protein SEQ ID NO | RNA SEQ ID NO |
| --- | --- | --- |
| anti-HIV__119-058035__VR-Chain | 2429 | 10071, 17713, 25355, 32997, 40639, 48281, 55923 |
| anti-HIV__119-057858__VR-Chain | 2430 | 10072, 17714, 25356, 32998, 40640, 48282, 55924 |
| anti-HIV__119-057473__VR-Chain | 2431 | 10073, 17715, 25357, 32999, 40641, 48283, 55925 |
| anti-HIV__119-057090__VR-Chain | 2432 | 10074, 17716, 25358, 33000, 40642, 48284, 55926 |
| anti-HIV__119-055754__VR-Chain | 2433 | 10075, 17717, 25359, 33001, 40643, 48285, 55927 |
| anti-HIV__119-054899__VR-Chain | 2434 | 10076, 17718, 25360, 33002, 40644, 48286, 55928 |
| anti-HIV__119-054501__VR-Chain | 2435 | 10077, 17719, 25361, 33003, 40645, 48287, 55929 |
| anti-HIV__119-051867__VR-Chain | 2436 | 10078, 17720, 25362, 33004, 40646, 48288, 55930 |
| anti-HIV__119-051814__VR-Chain | 2437 | 10079, 17721, 25363, 33005, 40647, 48289, 55931 |
| anti-HIV__119-051567__VR-Chain | 2438 | 10080, 17722, 25364, 33006, 40648, 48290, 55932 |
| anti-HIV__119-051483__VR-Chain | 2439 | 10081, 17723, 25365, 33007, 40649, 48291, 55933 |
| anti-HIV__119-050913__VR-Chain | 2440 | 10082, 17724, 25366, 33008, 40650, 48292, 55934 |
| anti-HIV__119-050187__VR-Chain | 2441 | 10083, 17725, 25367, 33009, 40651, 48293, 55935 |
| anti-HIV__119-049069__VR-Chain | 2442 | 10084, 17726, 25368, 33010, 40652, 48294, 55936 |
| anti-HIV__119-048517__VR-Chain | 2443 | 10085, 17727, 25369, 33011, 40653, 48295, 55937 |
| anti-HIV__119-048470__VR-Chain | 2444 | 10086, 17728, 25370, 33012, 40654, 48296, 55938 |
| anti-HIV__119-048303__VR-Chain | 2445 | 10087, 17729, 25371, 33013, 40655, 48297, 55939 |
| anti-HIV__119-048021__VR-Chain | 2446 | 10088, 17730, 25372, 33014, 40656, 48298, 55940 |
| anti-HIV__119-047928__VR-Chain | 2447 | 10089, 17731, 25373, 33015, 40657, 48299, 55941 |
| anti-HIV__119-047384__VR-Chain | 2448 | 10090, 17732, 25374, 33016, 40658, 48300, 55942 |
| anti-HIV__119-047145__VR-Chain | 2449 | 10091, 17733, 25375, 33017, 40659, 48301, 55943 |
| anti-HIV__119-046752__VR-Chain | 2450 | 10092, 17734, 25376, 33018, 40660, 48302, 55944 |
| anti-HIV__119-046660__VR-Chain | 2451 | 10093, 17735, 25377, 33019, 40661, 48303, 55945 |
| anti-HIV__119-046202__VR-Chain | 2452 | 10094, 17736, 25378, 33020, 40662, 48304, 55946 |
| anti-HIV__119-045790__VR-Chain | 2453 | 10095, 17737, 25379, 33021, 40663, 48305, 55947 |
| anti-HIV__119-044670__VR-Chain | 2454 | 10096, 17738, 25380, 33022, 40664, 48306, 55948 |
| anti-HIV__119-044140__VR-Chain | 2455 | 10097, 17739, 25381, 33023, 40665, 48307, 55949 |
| anti-HIV__119-042776__VR-Chain | 2456 | 10098, 17740, 25382, 33024, 40666, 48308, 55950 |
| anti-HIV__119-042581__VR-Chain | 2457 | 10099, 17741, 25383, 33025, 40667, 48309, 55951 |
| anti-HIV__119-040905__VR-Chain | 2458 | 10100, 17742, 25384, 33026, 40668, 48310, 55952 |
| anti-HIV__119-040322__VR-Chain | 2459 | 10101, 17743, 25385, 33027, 40669, 48311, 55953 |
| anti-HIV__119-039892__VR-Chain | 2460 | 10102, 17744, 25386, 33028, 40670, 48312, 55954 |
| anti-HIV__119-039764__VR-Chain | 2461 | 10103, 17745, 25387, 33029, 40671, 48313, 55955 |
| anti-HIV__119-039188__VR-Chain | 2462 | 10104, 17746, 25388, 33030, 40672, 48314, 55956 |
| anti-HIV__119-039058__VR-Chain | 2463 | 10105, 17747, 25389, 33031, 40673, 48315, 55957 |
| anti-HIV__119-038837__VR-Chain | 2464 | 10106, 17748, 25390, 33032, 40674, 48316, 55958 |
| anti-HIV__119-038396__VR-Chain | 2465 | 10107, 17749, 25391, 33033, 40675, 48317, 55959 |
| anti-HIV__119-036918__VR-Chain | 2466 | 10108, 17750, 25392, 33034, 40676, 48318, 55960 |
| anti-HIV__119-036592__VR-Chain | 2467 | 10109, 17751, 25393, 33035, 40677, 48319, 55961 |
| anti-HIV__119-036310__VR-Chain | 2468 | 10110, 17752, 25394, 33036, 40678, 48320, 55962 |
| anti-HIV__119-035618__VR-Chain | 2469 | 10111, 17753, 25395, 33037, 40679, 48321, 55963 |
| anti-HIV__119-035569__VR-Chain | 2470 | 10112, 17754, 25396, 33038, 40680, 48322, 55964 |
| anti-HIV__119-035466__VR-Chain | 2471 | 10113, 17755, 25397, 33039, 40681, 48323, 55965 |
| anti-HIV__119-035157__VR-Chain | 2472 | 10114, 17756, 25398, 33040, 40682, 48324, 55966 |
| anti-HIV__119-035121__VR-Chain | 2473 | 10115, 17757, 25399, 33041, 40683, 48325, 55967 |
| anti-HIV__119-035046__VR-Chain | 2474 | 10116, 17758, 25400, 33042, 40684, 48326, 55968 |
| anti-HIV__119-034754__VR-Chain | 2475 | 10117, 17759, 25401, 33043, 40685, 48327, 55969 |
| anti-HIV__119-034318__VR-Chain | 2476 | 10118, 17760, 25402, 33044, 40686, 48328, 55970 |
| anti-HIV__119-033780__VR-Chain | 2477 | 10119, 17761, 25403, 33045, 40687, 48329, 55971 |
| anti-HIV__119-033632__VR-Chain | 2478 | 10120, 17762, 25404, 33046, 40688, 48330, 55972 |
| anti-HIV__119-033183__VR-Chain | 2479 | 10121, 17763, 25405, 33047, 40689, 48331, 55973 |
| anti-HIV__119-030696__VR-Chain | 2480 | 10122, 17764, 25406, 33048, 40690, 48332, 55974 |
| anti-HIV__119-030059__VR-Chain | 2481 | 10123, 17765, 25407, 33049, 40691, 48333, 55975 |
| anti-HIV__119-029589__VR-Chain | 2482 | 10124, 17766, 25408, 33050, 40692, 48334, 55976 |
| anti-HIV__119-029448__VR-Chain | 2483 | 10125, 17767, 25409, 33051, 40693, 48335, 55977 |
| anti-HIV__119-029220__VR-Chain | 2484 | 10126, 17768, 25410, 33052, 40694, 48336, 55978 |
| anti-HIV__119-028317__VR-Chain | 2485 | 10127, 17769, 25411, 33053, 40695, 48337, 55979 |
| anti-HIV__119-028165__VR-Chain | 2486 | 10128, 17770, 25412, 33054, 40696, 48338, 55980 |
| anti-HIV__119-027147__VR-Chain | 2487 | 10129, 17771, 25413, 33055, 40697, 48339, 55981 |
| anti-HIV__119-026743__VR-Chain | 2488 | 10130, 17772, 25414, 33056, 40698, 48340, 55982 |
| anti-HIV__119-026508__VR-Chain | 2489 | 10131, 17773, 25415, 33057, 40699, 48341, 55983 |
| anti-HIV__119-025683__VR-Chain | 2490 | 10132, 17774, 25416, 33058, 40700, 48342, 55984 |
| anti-HIV__119-025614__VR-Chain | 2491 | 10133, 17775, 25417, 33059, 40701, 48343, 55985 |
| anti-HIV__119-025548__VR-Chain | 2492 | 10134, 17776, 25418, 33060, 40702, 48344, 55986 |
| anti-HIV__119-025526__VR-Chain | 2493 | 10135, 17777, 25419, 33061, 40703, 48345, 55987 |
| anti-HIV__119-023552__VR-Chain | 2494 | 10136, 17778, 25420, 33062, 40704, 48346, 55988 |
| anti-HIV__119-023092__VR-Chain | 2495 | 10137, 17779, 25421, 33063, 40705, 48347, 55989 |
| anti-HIV__119-022793__VR-Chain | 2496 | 10138, 17780, 25422, 33064, 40706, 48348, 55990 |
| anti-HIV__119-022395__VR-Chain | 2497 | 10139, 17781, 25423, 33065, 40707, 48349, 55991 |
| anti-HIV__119-022334__VR-Chain | 2498 | 10140, 17782, 25424, 33066, 40708, 48350, 55992 |
| anti-HIV__119-021866__VR-Chain | 2499 | 10141, 17783, 25425, 33067, 40709, 48351, 55993 |
| anti-HIV__119-021278__VR-Chain | 2500 | 10142, 17784, 25426, 33068, 40710, 48352, 55994 |
| anti-HIV__119-021183__VR-Chain | 2501 | 10143, 17785, 25427, 33069, 40711, 48353, 55995 |
| anti-HIV__119-019376__VR-Chain | 2502 | 10144, 17786, 25428, 33070, 40712, 48354, 55996 |
| anti-HIV__119-019238__VR-Chain | 2503 | 10145, 17787, 25429, 33071, 40713, 48355, 55997 |
| anti-HIV__119-018500__VR-Chain | 2504 | 10146, 17788, 25430, 33072, 40714, 48356, 55998 |

TABLE 3-continued

RNA and amino acid sequences of exemplified antibodies

| Name | Protein SEQ ID NO | RNA SEQ ID NO |
|---|---|---|
| anti-HIV__119-018318__VR-Chain | 2505 | 10147, 17789, 25431, 33073, 40715, 48357, 55999 |
| anti-HIV__119-018218__VR-Chain | 2506 | 10148, 17790, 25432, 33074, 40716, 48358, 56000 |
| anti-HIV__119-017876__VR-Chain | 2507 | 10149, 17791, 25433, 33075, 40717, 48359, 56001 |
| anti-HIV__119-017740__VR-Chain | 2508 | 10150, 17792, 25434, 33076, 40718, 48360, 56002 |
| anti-HIV__119-017128__VR-Chain | 2509 | 10151, 17793, 25435, 33077, 40719, 48361, 56003 |
| anti-HIV__119-017044__VR-Chain | 2510 | 10152, 17794, 25436, 33078, 40720, 48362, 56004 |
| anti-HIV__119-016644__VR-Chain | 2511 | 10153, 17795, 25437, 33079, 40721, 48363, 56005 |
| anti-HIV__119-015878__VR-Chain | 2512 | 10154, 17796, 25438, 33080, 40722, 48364, 56006 |
| anti-HIV__119-015538__VR-Chain | 2513 | 10155, 17797, 25439, 33081, 40723, 48365, 56007 |
| anti-HIV__119-015455__VR-Chain | 2514 | 10156, 17798, 25440, 33082, 40724, 48366, 56008 |
| anti-HIV__119-014425__VR-Chain | 2515 | 10157, 17799, 25441, 33083, 40725, 48367, 56009 |
| anti-HIV__119-013582__VR-Chain | 2516 | 10158, 17800, 25442, 33084, 40726, 48368, 56010 |
| anti-HIV__119-013364__VR-Chain | 2517 | 10159, 17801, 25443, 33085, 40727, 48369, 56011 |
| anti-HIV__119-012886__VR-Chain | 2518 | 10160, 17802, 25444, 33086, 40728, 48370, 56012 |
| anti-HIV__119-012249__VR-Chain | 2519 | 10161, 17803, 25445, 33087, 40729, 48371, 56013 |
| anti-HIV__119-012161__VR-Chain | 2520 | 10162, 17804, 25446, 33088, 40730, 48372, 56014 |
| anti-HIV__119-012110__VR-Chain | 2521 | 10163, 17805, 25447, 33089, 40731, 48373, 56015 |
| anti-HIV__119-012100__VR-Chain | 2522 | 10164, 17806, 25448, 33090, 40732, 48374, 56016 |
| anti-HIV__119-011651__VR-Chain | 2523 | 10165, 17807, 25449, 33091, 40733, 48375, 56017 |
| anti-HIV__119-011479__VR-Chain | 2524 | 10166, 17808, 25450, 33092, 40734, 48376, 56018 |
| anti-HIV__119-011232__VR-Chain | 2525 | 10167, 17809, 25451, 33093, 40735, 48377, 56019 |
| anti-HIV__119-011175__VR-Chain | 2526 | 10168, 17810, 25452, 33094, 40736, 48378, 56020 |
| anti-HIV__119-008396__VR-Chain | 2527 | 10169, 17811, 25453, 33095, 40737, 48379, 56021 |
| anti-HIV__119-007148__VR-Chain | 2528 | 10170, 17812, 25454, 33096, 40738, 48380, 56022 |
| anti-HIV__119-007029__VR-Chain | 2529 | 10171, 17813, 25455, 33097, 40739, 48381, 56023 |
| anti-HIV__119-004707__VR-Chain | 2530 | 10172, 17814, 25456, 33098, 40740, 48382, 56024 |
| anti-HIV__119-003910__VR-Chain | 2531 | 10173, 17815, 25457, 33099, 40741, 48383, 56025 |
| anti-HIV__119-002450__VR-Chain | 2532 | 10174, 17816, 25458, 33100, 40742, 48384, 56026 |
| anti-HIV__119-001552__VR-Chain | 2533 | 10175, 17817, 25459, 33101, 40743, 48385, 56027 |
| anti-HIV__059-188169__VR-Chain | 2534 | 10176, 17818, 25460, 33102, 40744, 48386, 56028 |
| anti-HIV__059-183739__VR-Chain | 2535 | 10177, 17819, 25461, 33103, 40745, 48387, 56029 |
| anti-HIV__059-182376__VR-Chain | 2536 | 10178, 17820, 25462, 33104, 40746, 48388, 56030 |
| anti-HIV__059-182199__VR-Chain | 2537 | 10179, 17821, 25463, 33105, 40747, 48389, 56031 |
| anti-HIV__059-169202__VR-Chain | 2538 | 10180, 17822, 25464, 33106, 40748, 48390, 56032 |
| anti-HIV__059-155645__VR-Chain | 2539 | 10181, 17823, 25465, 33107, 40749, 48391, 56033 |
| anti-HIV__059-151619__VR-Chain | 2540 | 10182, 17824, 25466, 33108, 40750, 48392, 56034 |
| anti-HIV__059-146503__VR-Chain | 2541 | 10183, 17825, 25467, 33109, 40751, 48393, 56035 |
| anti-HIV__059-136098__VR-Chain | 2542 | 10184, 17826, 25468, 33110, 40752, 48394, 56036 |
| anti-HIV__059-105516__VR-Chain | 2543 | 10185, 17827, 25469, 33111, 40753, 48395, 56037 |
| anti-HIV__059-095709__VR-Chain | 2544 | 10186, 17828, 25470, 33112, 40754, 48396, 56038 |
| anti-HIV__059-069468__VR-Chain | 2545 | 10187, 17829, 25471, 33113, 40755, 48397, 56039 |
| anti-HIV__059-060026__VR-Chain | 2546 | 10188, 17830, 25472, 33114, 40756, 48398, 56040 |
| anti-HIV__059-053668__VR-Chain | 2547 | 10189, 17831, 25473, 33115, 40757, 48399, 56041 |
| anti-HIV__059-052864__VR-Chain | 2548 | 10190, 17832, 25474, 33116, 40758, 48400, 56042 |
| anti-HIV__059-050968__VR-Chain | 2549 | 10191, 17833, 25475, 33117, 40759, 48401, 56043 |
| anti-HIV__059-046422__VR-Chain | 2550 | 10192, 17834, 25476, 33118, 40760, 48402, 56044 |
| anti-HIV__059-045120__VR-Chain | 2551 | 10193, 17835, 25477, 33119, 40761, 48403, 56045 |
| anti-HIV__059-039932__VR-Chain | 2552 | 10194, 17836, 25478, 33120, 40762, 48404, 56046 |
| anti-HIV__059-038595__VR-Chain | 2553 | 10195, 17837, 25479, 33121, 40763, 48405, 56047 |
| anti-HIV__059-035082__VR-Chain | 2554 | 10196, 17838, 25480, 33122, 40764, 48406, 56048 |
| anti-HIV__059-029204__VR-Chain | 2555 | 10197, 17839, 25481, 33123, 40765, 48407, 56049 |
| anti-HIV__059-025235__VR-Chain | 2556 | 10198, 17840, 25482, 33124, 40766, 48408, 56050 |
| anti-HIV__059-015192__VR-Chain | 2557 | 10199, 17841, 25483, 33125, 40767, 48409, 56051 |
| anti-HIV__059-007060__VR-Chain | 2558 | 10200, 17842, 25484, 33126, 40768, 48410, 56052 |
| anti-HIV__059-006953__VR-Chain | 2559 | 10201, 17843, 25485, 33127, 40769, 48411, 56053 |
| anti-HIV__059-005953__VR-Chain | 2560 | 10202, 17844, 25486, 33128, 40770, 48412, 56054 |
| anti-HIV__059-003725__VR-Chain | 2561 | 10203, 17845, 25487, 33129, 40771, 48413, 56055 |
| anti-HIV__059-002618__VR-Chain | 2562 | 10204, 17846, 25488, 33130, 40772, 48414, 56056 |
| anti-HIV__059-001522__VR-Chain | 2563 | 10205, 17847, 25489, 33131, 40773, 48415, 56057 |
| anti-HIV__059-000731__VR-Chain | 2564 | 10206, 17848, 25490, 33132, 40774, 48416, 56058 |
| anti-HIV__059-000634__VR-Chain | 2565 | 10207, 17849, 25491, 33133, 40775, 48417, 56059 |
| anti-HIV__048-250757__VR-Chain | 2566 | 10208, 17850, 25492, 33134, 40776, 48418, 56060 |
| anti-HIV__048-250716__VR-Chain | 2567 | 10209, 17851, 25493, 33135, 40777, 48419, 56061 |
| anti-HIV__048-250463__VR-Chain | 2568 | 10210, 17852, 25494, 33136, 40778, 48420, 56062 |
| anti-HIV__048-248153__VR-Chain | 2569 | 10211, 17853, 25495, 33137, 40779, 48421, 56063 |
| anti-HIV__048-247532__VR-Chain | 2570 | 10212, 17854, 25496, 33138, 40780, 48422, 56064 |
| anti-HIV__048-245846__VR-Chain | 2571 | 10213, 17855, 25497, 33139, 40781, 48423, 56065 |
| anti-HIV__048-244016__VR-Chain | 2572 | 10214, 17856, 25498, 33140, 40782, 48424, 56066 |
| anti-HIV__048-243682__VR-Chain | 2573 | 10215, 17857, 25499, 33141, 40783, 48425, 56067 |
| anti-HIV__048-243588__VR-Chain | 2574 | 10216, 17858, 25500, 33142, 40784, 48426, 56068 |
| anti-HIV__048-241775__VR-Chain | 2575 | 10217, 17859, 25501, 33143, 40785, 48427, 56069 |
| anti-HIV__048-237996__VR-Chain | 2576 | 10218, 17860, 25502, 33144, 40786, 48428, 56070 |
| anti-HIV__048-237730__VR-Chain | 2577 | 10219, 17861, 25503, 33145, 40787, 48429, 56071 |
| anti-HIV__048-237253__VR-Chain | 2578 | 10220, 17862, 25504, 33146, 40788, 48430, 56072 |
| anti-HIV__048-234100__VR-Chain | 2579 | 10221, 17863, 25505, 33147, 40789, 48431, 56073 |
| anti-HIV__048-230882__VR-Chain | 2580 | 10222, 17864, 25506, 33148, 40790, 48432, 56074 |

TABLE 3-continued

RNA and amino acid sequences of exemplified antibodies

| Name | Protein SEQ ID NO | RNA SEQ ID NO |
|---|---|---|
| anti-HIV__048-229473__VR-Chain | 2581 | 10223, 17865, 25507, 33149, 40791, 48433, 56075 |
| anti-HIV__048-228238__VR-Chain | 2582 | 10224, 17869, 25508, 33150, 40792, 48434, 56079 |
| anti-HIV__048-228027__VR-Chain | 2583 | 10225, 17867, 25509, 33151, 40793, 48435, 56077 |
| anti-HIV__048-227795__VR-Chain | 2584 | 10226, 17868, 25510, 33152, 40794, 48436, 56078 |
| anti-HIV__048-227770__VR-Chain | 2585 | 10227, 17869, 25511, 33153, 40795, 48437, 56079 |
| anti-HIV__048-225298__VR-Chain | 2586 | 10228, 17870, 25512, 33154, 40796, 48438, 56080 |
| anti-HIV__048-225090__VR-Chain | 2587 | 10229, 17871, 25513, 33155, 40797, 48439, 56081 |
| anti-HIV__048-224187__VR-Chain | 2588 | 10230, 17872, 25514, 33156, 40798, 48440, 56082 |
| anti-HIV__048-223055__VR-Chain | 2589 | 10231, 17873, 25515, 33157, 40799, 48441, 56083 |
| anti-HIV__048-222711__VR-Chain | 2590 | 10232, 17874, 25516, 33158, 40800, 48442, 56084 |
| anti-HIV__048-221209__VR-Chain | 2591 | 10233, 17875, 25517, 33159, 40801, 48443, 56085 |
| anti-HIV__048-220929__VR-Chain | 2592 | 10234, 17876, 25518, 33160, 40802, 48444, 56086 |
| anti-HIV__048-219430__VR-Chain | 2593 | 10235, 17877, 25519, 33161, 40803, 48445, 56087 |
| anti-HIV__048-216250__VR-Chain | 2594 | 10236, 17878, 25520, 33162, 40804, 48446, 56088 |
| anti-HIV__048-216133__VR-Chain | 2595 | 10237, 17879, 25521, 33163, 40805, 48447, 56089 |
| anti-HIV__048-214886__VR-Chain | 2596 | 10238, 17880, 25522, 33164, 40806, 48448, 56090 |
| anti-HIV__048-214709__VR-Chain | 2597 | 10239, 17881, 25523, 33165, 40807, 48449, 56091 |
| anti-HIV__048-214001__VR-Chain | 2598 | 10240, 17882, 25524, 33166, 40808, 48450, 56092 |
| anti-HIV__048-213230__VR-Chain | 2599 | 10241, 17883, 25525, 33167, 40809, 48451, 56093 |
| anti-HIV__048-212574__VR-Chain | 2600 | 10242, 17884, 25526, 33168, 40810, 48452, 56094 |
| anti-HIV__048-212207__VR-Chain | 2601 | 10243, 17885, 25527, 33169, 40811, 48453, 56095 |
| anti-HIV__048-209146__VR-Chain | 2602 | 10244, 17886, 25528, 33170, 40812, 48454, 56096 |
| anti-HIV__048-208206__VR-Chain | 2603 | 10245, 17887, 25529, 33171, 40813, 48455, 56097 |
| anti-HIV__048-208194__VR-Chain | 2604 | 10246, 17888, 25530, 33172, 40814, 48456, 56098 |
| anti-HIV__048-207744__VR-Chain | 2605 | 10247, 17889, 25531, 33173, 40815, 48457, 56099 |
| anti-HIV__048-206501__VR-Chain | 2606 | 10248, 17890, 25532, 33174, 40816, 48458, 56100 |
| anti-HIV__048-204221__VR-Chain | 2607 | 10249, 17891, 25533, 33175, 40817, 48459, 56101 |
| anti-HIV__048-204015__VR-Chain | 2608 | 10250, 17892, 25534, 33176, 40818, 48460, 56102 |
| anti-HIV__048-201240__VR-Chain | 2609 | 10251, 17893, 25535, 33177, 40819, 48461, 56103 |
| anti-HIV__048-200455__VR-Chain | 2610 | 10252, 17894, 25536, 33178, 40820, 48462, 56104 |
| anti-HIV__048-200319__VR-Chain | 2611 | 10253, 17895, 25537, 33179, 40821, 48463, 56105 |
| anti-HIV__048-197896__VR-Chain | 2612 | 10254, 17896, 25538, 33180, 40822, 48464, 56106 |
| anti-HIV__048-193813__VR-Chain | 2613 | 10255, 17897, 25539, 33181, 40823, 48465, 56107 |
| anti-HIV__048-192098__VR-Chain | 2614 | 10256, 17898, 25540, 33182, 40824, 48466, 56108 |
| anti-HIV__048-191786__VR-Chain | 2615 | 10257, 17899, 25541, 33183, 40825, 48467, 56109 |
| anti-HIV__048-188746__VR-Chain | 2616 | 10258, 17900, 25542, 33184, 40826, 48468, 56110 |
| anti-HIV__048-185937__VR-Chain | 2617 | 10259, 17901, 25543, 33185, 40827, 48469, 56111 |
| anti-HIV__048-184849__VR-Chain | 2618 | 10260, 17902, 25544, 33186, 40828, 48470, 56112 |
| anti-HIV__048-183089__VR-Chain | 2619 | 10261, 17903, 25545, 33187, 40829, 48471, 56113 |
| anti-HIV__048-181509__VR-Chain | 2620 | 10262, 17904, 25546, 33188, 40830, 48472, 56114 |
| anti-HIV__048-180990__VR-Chain | 2621 | 10263, 17905, 25547, 33189, 40831, 48473, 56115 |
| anti-HIV__048-177532__VR-Chain | 2622 | 10264, 17906, 25548, 33190, 40832, 48474, 56116 |
| anti-HIV__048-177426__VR-Chain | 2623 | 10265, 17907, 25549, 33191, 40833, 48475, 56117 |
| anti-HIV__048-177389__VR-Chain | 2624 | 10266, 17908, 25550, 33192, 40834, 48476, 56118 |
| anti-HIV__048-174266__VR-Chain | 2625 | 10267, 17909, 25551, 33193, 40835, 48477, 56119 |
| anti-HIV__048-172847__VR-Chain | 2626 | 10268, 17910, 25552, 33194, 40836, 48478, 56120 |
| anti-HIV__048-172845__VR-Chain | 2627 | 10269, 17911, 25553, 33195, 40837, 48479, 56121 |
| anti-HIV__048-172363__VR-Chain | 2628 | 10270, 17912, 25554, 33196, 40838, 48480, 56122 |
| anti-HIV__048-171609__VR-Chain | 2629 | 10271, 17913, 25555, 33197, 40839, 48481, 56123 |
| anti-HIV__048-170705__VR-Chain | 2630 | 10272, 17914, 25556, 33198, 40840, 48482, 56124 |
| anti-HIV__048-168381__VR-Chain | 2631 | 10273, 17915, 25557, 33199, 40841, 48483, 56125 |
| anti-HIV__048-166619__VR-Chain | 2632 | 10274, 17916, 25558, 33200, 40842, 48484, 56126 |
| anti-HIV__048-162036__VR-Chain | 2633 | 10275, 17917, 25559, 33201, 40843, 48485, 56127 |
| anti-HIV__048-160042__VR-Chain | 2634 | 10276, 17918, 25560, 33202, 40844, 48486, 56128 |
| anti-HIV__048-159676__VR-Chain | 2635 | 10277, 17919, 25561, 33203, 40845, 48487, 56129 |
| anti-HIV__048-159500__VR-Chain | 2636 | 10278, 17920, 25562, 33204, 40846, 48488, 56130 |
| anti-HIV__048-159421__VR-Chain | 2637 | 10279, 17921, 25563, 33205, 40847, 48489, 56131 |
| anti-HIV__048-159333__VR-Chain | 2638 | 10280, 17922, 25564, 33206, 40848, 48490, 56132 |
| anti-HIV__048-158932__VR-Chain | 2639 | 10281, 17923, 25565, 33207, 40849, 48491, 56133 |
| anti-HIV__048-155811__VR-Chain | 2640 | 10282, 17924, 25566, 33208, 40850, 48492, 56134 |
| anti-HIV__048-155464__VR-Chain | 2641 | 10283, 17925, 25567, 33209, 40851, 48493, 56135 |
| anti-HIV__048-155392__VR-Chain | 2642 | 10284, 17926, 25568, 33210, 40852, 48494, 56136 |
| anti-HIV__048-155389__VR-Chain | 2643 | 10285, 17927, 25569, 33211, 40853, 48495, 56137 |
| anti-HIV__048-154449__VR-Chain | 2644 | 10286, 17928, 25570, 33212, 40854, 48496, 56138 |
| anti-HIV__048-153379__VR-Chain | 2645 | 10287, 17929, 25571, 33213, 40855, 48497, 56139 |
| anti-HIV__048-153171__VR-Chain | 2646 | 10288, 17930, 25572, 33214, 40856, 48498, 56140 |
| anti-HIV__048-152324__VR-Chain | 2647 | 10289, 17931, 25573, 33215, 40857, 48499, 56141 |
| anti-HIV__048-146102__VR-Chain | 2648 | 10290, 17932, 25574, 33216, 40858, 48500, 56142 |
| anti-HIV__048-145984__VR-Chain | 2649 | 10291, 17933, 25575, 33217, 40859, 48501, 56143 |
| anti-HIV__048-145371__VR-Chain | 2650 | 10292, 17934, 25576, 33218, 40860, 48502, 56144 |
| anti-HIV__048-144907__VR-Chain | 2651 | 10293, 17935, 25577, 33219, 40861, 48503, 56145 |
| anti-HIV__048-142298__VR-Chain | 2652 | 10294, 17936, 25578, 33220, 40862, 48504, 56146 |
| anti-HIV__048-142277__VR-Chain | 2653 | 10295, 17937, 25579, 33221, 40863, 48505, 56147 |
| anti-HIV__048-141934__VR-Chain | 2654 | 10296, 17938, 25580, 33222, 40864, 48506, 56148 |
| anti-HIV__048-141207__VR-Chain | 2655 | 10297, 17939, 25581, 33223, 40865, 48507, 56149 |
| anti-HIV__048-140796__VR-Chain | 2656 | 10298, 17940, 25582, 33224, 40866, 48508, 56150 |

TABLE 3-continued

RNA and amino acid sequences of exemplified antibodies

| Name | Protein SEQ ID NO | RNA SEQ ID NO |
|---|---|---|
| anti-HIV__048-139893__VR-Chain | 2657 | 10299, 17941, 25583, 33225, 40867, 48509, 56151 |
| anti-HIV__048-138820__VR-Chain | 2658 | 10300, 17942, 25584, 33226, 40868, 48510, 56152 |
| anti-HIV__048-135858__VR-Chain | 2659 | 10301, 17943, 25585, 33227, 40869, 48511, 56153 |
| anti-HIV__048-134968__VR-Chain | 2660 | 10302, 17944, 25586, 33228, 40870, 48512, 56154 |
| anti-HIV__048-134312__VR-Chain | 2661 | 10303, 17945, 25587, 33229, 40871, 48513, 56155 |
| anti-HIV__048-132253__VR-Chain | 2662 | 10304, 17946, 25588, 33230, 40872, 48514, 56156 |
| anti-HIV__048-130710__VR-Chain | 2663 | 10305, 17947, 25589, 33231, 40873, 48515, 56157 |
| anti-HIV__048-128564__VR-Chain | 2664 | 10306, 17948, 25590, 33232, 40874, 48516, 56158 |
| anti-HIV__048-126702__VR-Chain | 2665 | 10307, 17949, 25591, 33233, 40875, 48517, 56159 |
| anti-HIV__048-124521__VR-Chain | 2666 | 10308, 17950, 25592, 33234, 40876, 48518, 56160 |
| anti-HIV__048-122740__VR-Chain | 2667 | 10309, 17951, 25593, 33235, 40877, 48519, 56161 |
| anti-HIV__048-119536__VR-Chain | 2668 | 10310, 17952, 25594, 33236, 40878, 48520, 56162 |
| anti-HIV__048-116929__VR-Chain | 2669 | 10311, 17953, 25595, 33237, 40879, 48521, 56163 |
| anti-HIV__048-116577__VR-Chain | 2670 | 10312, 17954, 25596, 33238, 40880, 48522, 56164 |
| anti-HIV__048-116045__VR-Chain | 2671 | 10313, 17955, 25597, 33239, 40881, 48523, 56165 |
| anti-HIV__048-115875__VR-Chain | 2672 | 10314, 17956, 25598, 33240, 40882, 48524, 56166 |
| anti-HIV__048-115599__VR-Chain | 2673 | 10315, 17957, 25599, 33241, 40883, 48525, 56167 |
| anti-HIV__048-113988__VR-Chain | 2674 | 10316, 17958, 25600, 33242, 40884, 48526, 56168 |
| anti-HIV__048-112989__VR-Chain | 2675 | 10317, 17959, 25601, 33243, 40885, 48527, 56169 |
| anti-HIV__048-112435__VR-Chain | 2676 | 10318, 17960, 25602, 33244, 40886, 48528, 56170 |
| anti-HIV__048-111339__VR-Chain | 2677 | 10319, 17961, 25603, 33245, 40887, 48529, 56171 |
| anti-HIV__048-111055__VR-Chain | 2678 | 10320, 17962, 25604, 33246, 40888, 48530, 56172 |
| anti-HIV__048-111027__VR-Chain | 2679 | 10321, 17963, 25605, 33247, 40889, 48531, 56173 |
| anti-HIV__048-109721__VR-Chain | 2080 | 10322, 17964, 25606, 33248, 40890, 48532, 56174 |
| anti-HIV__048-109666__VR-Chain | 2681 | 10323, 17965, 25607, 33249, 40891, 48533, 56175 |
| anti-HIV__048-109196__VR-Chain | 2682 | 10324, 17966, 25608, 33250, 40892, 48534, 56176 |
| anti-HIV__048-109051__VR-Chain | 2683 | 10325, 17967, 25609, 33251, 40893, 48535, 56177 |
| anti-HIV__048-108570__VR-Chain | 2684 | 10326, 17968, 25610, 33252, 40894, 48536, 56178 |
| anti-HIV__048-108033__VR-Chain | 2685 | 10327, 17969, 25611, 33253, 40895, 48537, 56179 |
| anti-HIV__048-107279__VR-Chain | 2686 | 10328, 17970, 25612, 33254, 40896, 48538, 56180 |
| anti-HIV__048-106271__VR-Chain | 2687 | 10329, 17971, 25613, 33255, 40897, 48539, 56181 |
| anti-HIV__048-106054__VR-Chain | 2688 | 10330, 17972, 25614, 33256, 40898, 48540, 56182 |
| anti-HIV__048-104848__VR-Chain | 2689 | 10331, 17973, 25615, 33257, 40899, 48541, 56183 |
| anti-HIV__048-104638__VR-Chain | 2690 | 10332, 17974, 25616, 33258, 40900, 48542, 56184 |
| anti-HIV__048-104567__VR-Chain | 2691 | 10333, 17975, 25617, 33259, 40901, 48543, 56185 |
| anti-HIV__048-102804__VR-Chain | 2692 | 10334, 17976, 25618, 33260, 40902, 48544, 56186 |
| anti-HIV__048-101676__VR-Chain | 2693 | 10335, 17977, 25619, 33261, 40903, 48545, 56187 |
| anti-HIV__048-097603__VR-Chain | 2694 | 10336, 17978, 25620, 33262, 40904, 48546, 56188 |
| anti-HIV__048-097107__VR-Chain | 2695 | 10337, 17979, 25621, 33263, 40905, 48547, 56189 |
| anti-HIV__048-096871__VR-Chain | 2696 | 10338, 17980, 25622, 33264, 40906, 48548, 56190 |
| anti-HIV__048-096668__VR-Chain | 2697 | 10339, 17981, 25623, 33265, 40907, 48549, 56191 |
| anti-HIV__048-095236__VR-Chain | 2698 | 10340, 17982, 25624, 33266, 40908, 48550, 56192 |
| anti-HIV__048-094155__VR-Chain | 2699 | 10341, 17983, 25625, 33267, 40909, 48551, 56193 |
| anti-HIV__048-093219__VR-Chain | 2700 | 10342, 17984, 25626, 33268, 40910, 48552, 56194 |
| anti-HIV__048-092976__VR-Chain | 2701 | 10343, 17985, 25627, 33269, 40911, 48553, 56195 |
| anti-HIV__048-090866__VR-Chain | 2702 | 10344, 17986, 25628, 33270, 40912, 48554, 56196 |
| anti-HIV__048-090650__VR-Chain | 2703 | 10345, 17987, 25629, 33271, 40913, 48555, 56197 |
| anti-HIV__048-089009__VR-Chain | 2704 | 10346, 17988, 25630, 33272, 40914, 48556, 56198 |
| anti-HIV__048-088654__VR-Chain | 2705 | 10347, 17989, 25631, 33273, 40915, 48557, 56199 |
| anti-HIV__048-086513__VR-Chain | 2706 | 10348, 17990, 25632, 33274, 40916, 48558, 56200 |
| anti-HIV__048-086024__VR-Chain | 2707 | 10349, 17991, 25633, 33275, 40917, 48559, 56201 |
| anti-HIV__048-085857__VR-Chain | 2708 | 10350, 17992, 25634, 33276, 40918, 48560, 56202 |
| anti-HIV__048-084277__VR-Chain | 2709 | 10351, 17993, 25635, 33277, 40919, 48561, 56203 |
| anti-HIV__048-084245__VR-Chain | 2710 | 10352, 17994, 25636, 33278, 40920, 48562, 56204 |
| anti-HIV__048-082487__VR-Chain | 2711 | 10353, 17995, 25637, 33279, 40921, 48563, 56205 |
| anti-HIV__048-081787__VR-Chain | 2712 | 10354, 17996, 25638, 33280, 40922, 48564, 56206 |
| anti-HIV__048-081062__VR-Chain | 2713 | 10355, 17997, 25639, 33281, 40923, 48565, 56207 |
| anti-HIV__048-079639__VR-Chain | 2714 | 10356, 17998, 25640, 33282, 40924, 48566, 56208 |
| anti-HIV__048-079126__VR-Chain | 2715 | 10357, 17999, 25641, 33283, 40925, 48567, 56209 |
| anti-HIV__048-073118__VR-Chain | 2716 | 10358, 18000, 25642, 33284, 40926, 48568, 56210 |
| anti-HIV__048-070264__VR-Chain | 2717 | 10359, 18001, 25643, 33285, 40927, 48569, 56211 |
| anti-HIV__048-069426__VR-Chain | 2718 | 10360, 18002, 25644, 33286, 40928, 48570, 56212 |
| anti-HIV__048-068564__VR-Chain | 2719 | 10361, 18003, 25645, 33287, 40929, 48571, 56213 |
| anti-HIV__048-068345__VR-Chain | 2720 | 10362, 18004, 25646, 33288, 40930, 48572, 56214 |
| anti-HIV__048-067337__VR-Chain | 2721 | 10363, 18005, 25647, 33289, 40931, 48573, 56215 |
| anti-HIV__048-067180__VR-Chain | 2722 | 10364, 18006, 25648, 33290, 40932, 48574, 56216 |
| anti-HIV__048-063017__VR-Chain | 2723 | 10365, 18007, 25649, 33291, 40933, 48575, 56217 |
| anti-HIV__048-061885__VR-Chain | 2724 | 10366, 18008, 25650, 33292, 40934, 48576, 56218 |
| anti-HIV__048-061671__VR-Chain | 2725 | 10367, 18009, 25651, 33293, 40935, 48577, 56219 |
| anti-HIV__048-060700__VR-Chain | 2726 | 10368, 18010, 25652, 33294, 40936, 48578, 56220 |
| anti-HIV__048-060592__VR-Chain | 2727 | 10369, 18011, 25653, 33295, 40937, 48579, 56221 |
| anti-HIV__048-060300__VR-Chain | 2728 | 10370, 18012, 25654, 33296, 40938, 48580, 56222 |
| anti-HIV__048-059141__VR-Chain | 2729 | 10371, 18013, 25655, 33297, 40939, 48581, 56223 |
| anti-HIV__048-057777__VR-Chain | 2730 | 10372, 18014, 25656, 33298, 40940, 48582, 56224 |
| anti-HIV__048-056928__VR-Chain | 2731 | 10373, 18015, 25657, 33299, 40941, 48583, 56225 |
| anti-HIV__048-056131__VR-Chain | 2732 | 10374, 18016, 25658, 33300, 40942, 48584, 56226 |

TABLE 3-continued

RNA and amino acid sequences of exemplified antibodies

| Name | Protein SEQ ID NO | RNA SEQ ID NO |
| --- | --- | --- |
| anti-HIV__048-055864__VR-Chain | 2733 | 10375, 18017, 25659, 33301, 40943, 48585, 56227 |
| anti-HIV__048-055094__VR-Chain | 2734 | 10376, 18018, 25660, 33302, 40944, 48586, 56228 |
| anti-HIV__048-054343__VR-Chain | 2735 | 10377, 18019, 25661, 33303, 40945, 48587, 56229 |
| anti-HIV__048-054193__VR-Chain | 2736 | 10378, 18020, 25662, 33304, 40946, 48588, 56230 |
| anti-HIV__048-052521__VR-Chain | 2737 | 10379, 18021, 25663, 33305, 40947, 48589, 56231 |
| anti-HIV__048-049037__VR-Chain | 2738 | 10380, 18022, 25664, 33306, 40948, 48590, 56232 |
| anti-HIV__048-048720__VR-Chain | 2739 | 10381, 18023, 25665, 33307, 40949, 48591, 56233 |
| anti-HIV__048-048542__VR-Chain | 2740 | 10382, 18024, 25666, 33308, 40950, 48592, 56234 |
| anti-HIV__048-047777__VR-Chain | 2741 | 10383, 18025, 25667, 33309, 40951, 48593, 56235 |
| anti-HIV__048-046841__VR-Chain | 2742 | 10384, 18026, 25668, 33310, 40952, 48594, 56236 |
| anti-HIV__048-046202__VR-Chain | 2743 | 10385, 18027, 25669, 33311, 40953, 48595, 56237 |
| anti-HIV__048-046059__VR-Chain | 2744 | 10386, 18028, 25670, 33312, 40954, 48596, 56238 |
| anti-HIV__048-043568__VR-Chain | 2745 | 10387, 18029, 25671, 33313, 40955, 48597, 56239 |
| anti-HIV__048-042713__VR-Chain | 2746 | 10388, 18030, 25672, 33314, 40956, 48598, 56240 |
| anti-HIV__048-042440__VR-Chain | 2747 | 10389, 18031, 25673, 33315, 40957, 48599, 56241 |
| anti-HIV__048-040511__VR-Chain | 2748 | 10390, 18032, 25674, 33316, 40958, 48600, 56242 |
| anti-HIV__048-039195__VR-Chain | 2749 | 10391, 18033, 25675, 33317, 40959, 48601, 56243 |
| anti-HIV__048-036935__VR-Chain | 2750 | 10392, 18034, 25676, 33318, 40960, 48602, 56244 |
| anti-HIV__048-034478__VR-Chain | 2751 | 10393, 18035, 25677, 33319, 40961, 48603, 56245 |
| anti-HIV__048-031641__VR-Chain | 2752 | 10394, 18036, 25678, 33320, 40962, 48604, 56246 |
| anti-HIV__048-029760__VR-Chain | 2753 | 10395, 18037, 25679, 33321, 40963, 48605, 56247 |
| anti-HIV__048-027970__VR-Chain | 2754 | 10396, 18038, 25680, 33322, 40964, 48606, 56248 |
| anti-HIV__048-027337__VR-Chain | 2755 | 10397, 18039, 25681, 33323, 40965, 48607, 56249 |
| anti-HIV__048-027217__VR-Chain | 2756 | 10398, 18040, 25682, 33324, 40966, 48608, 56250 |
| anti-HIV__048-026760__VR-Chain | 2757 | 10399, 18041, 25683, 33325, 40967, 48609, 56251 |
| anti-HIV__048-024800__VR-Chain | 2758 | 10400, 18042, 25684, 33326, 40968, 48610, 56252 |
| anti-HIV__048-024313__VR-Chain | 2759 | 10401, 18043, 25685, 33327, 40969, 48611, 56253 |
| anti-HIV__048-021748__VR-Chain | 2760 | 10402, 18044, 25686, 33328, 40970, 48612, 56254 |
| anti-HIV__048-020991__VR-Chain | 2761 | 10403, 18045, 25687, 33329, 40971, 48613, 56255 |
| anti-HIV__048-020340__VR-Chain | 2762 | 10404, 18046, 25688, 33330, 40972, 48614, 56256 |
| anti-HIV__048-019993__VR-Chain | 2763 | 10405, 18047, 25689, 33331, 40973, 48615, 56257 |
| anti-HIV__048-019947__VR-Chain | 2764 | 10406, 18048, 25690, 33332, 40974, 48616, 56258 |
| anti-HIV__048-017871__VR-Chain | 2765 | 10407, 18049, 25691, 33333, 40975, 48617, 56259 |
| anti-HIV__048-015931__VR-Chain | 2766 | 10408, 18050, 25692, 33334, 40976, 48618, 56260 |
| anti-HIV__048-015920__VR-Chain | 2767 | 10409, 18051, 25693, 33335, 40977, 48619, 56261 |
| anti-HIV__048-013898__VR-Chain | 2768 | 10410, 18052, 25694, 33336, 40978, 48620, 56262 |
| anti-HIV__048-013429__VR-Chain | 2769 | 10411, 18053, 25695, 33337, 40979, 48621, 56263 |
| anti-HIV__048-012358__VR-Chain | 2770 | 10412, 18054, 25696, 33338, 40980, 48622, 56264 |
| anti-HIV__048-011158__VR-Chain | 2771 | 10413, 18055, 25697, 33339, 40981, 48623, 56265 |
| anti-HIV__048-010720__VR-Chain | 2772 | 10414, 18056, 25698, 33340, 40982, 48624, 56266 |
| anti-HIV__048-009445__VR-Chain | 2773 | 10415, 18057, 25699, 33341, 40983, 48625, 56267 |
| anti-HIV__048-006126__VR-Chain | 2774 | 10416, 18058, 25700, 33342, 40984, 48626, 56268 |
| anti-HIV__048-005652__VR-Chain | 2775 | 10417, 18059, 25701, 33343, 40985, 48627, 56269 |
| anti-HIV__048-005532__VR-Chain | 2776 | 10418, 18060, 25702, 33344, 40986, 48628, 56270 |
| anti-HIV__048-005189__VR-Chain | 2777 | 10419, 18061, 25703, 33345, 40987, 48629, 56271 |
| anti-HIV__048-005088__VR-Chain | 2778 | 10420, 18062, 25704, 33346, 40988, 48630, 56272 |
| anti-HIV__048-004023__VR-Chain | 2779 | 10421, 18063, 25705, 33347, 40989, 48631, 56273 |
| anti-HIV__048-001580__VR-Chain | 2780 | 10422, 18064, 25706, 33348, 40990, 48632, 56274 |
| anti-HIV__038-221120__VR-Chain | 2781 | 10423, 18065, 25707, 33349, 40991, 48633, 56275 |
| anti-HIV__038-197677__VR-Chain | 2782 | 10424, 18066, 25708, 33350, 40992, 48634, 56276 |
| anti-HIV__038-196765__VR-Chain | 2783 | 10425, 18067, 25709, 33351, 40993, 48635, 56277 |
| anti-HIV__038-186200__VR-Chain | 2784 | 10426, 18068, 25710, 33352, 40994, 48636, 56278 |
| anti-HIV__038-126170__VR-Chain | 2785 | 10427, 18069, 25711, 33353, 40995, 48637, 56279 |
| anti-HIV__038-108545__VR-Chain | 2786 | 10428, 18070, 25712, 33354, 40996, 48638, 56280 |
| anti-HIV__038-107263__VR-Chain | 2787 | 10429, 18071, 25713, 33355, 40997, 48639, 56281 |
| anti-HIV__038-104530__VR-Chain | 2788 | 10430, 18072, 25714, 33356, 40998, 48640, 56282 |
| anti-HIV__038-099169__VR-Chain | 2789 | 10431, 18073, 25715, 33357, 40999, 48641, 56283 |
| anti-HIV__038-075067__VR-Chain | 2790 | 10432, 18074, 25716, 33358, 41000, 48642, 56284 |
| anti-HIV__038-072368__VR-Chain | 2791 | 10433, 18075, 25717, 33359, 41001, 48643, 56285 |
| anti-HIV__038-068503__VR-Chain | 2792 | 10434, 18076, 25718, 33360, 41002, 48644, 56286 |
| anti-HIV__038-068016__VR-Chain | 2793 | 10435, 18077, 25719, 33361, 41003, 48645, 56287 |
| anti-HIV__038-063958__VR-Chain | 2794 | 10436, 18078, 25720, 33362, 41004, 48646, 56288 |
| anti-HIV__038-033733__VR-Chain | 2795 | 10437, 18079, 25721, 33363, 41005, 48647, 56289 |
| anti-HIV__038-030557__VR-Chain | 2796 | 10438, 18080, 25722, 33364, 41006, 48648, 56290 |
| anti-HIV__038-024298__VR-Chain | 2797 | 10439, 18081, 25723, 33365, 41007, 48649, 56291 |
| anti-HIV__038-011154__VR-Chain | 2798 | 10440, 18082, 25724, 33366, 41008, 48650, 56292 |
| anti-HIV-1__LightChain | 2799 | 10441, 18083, 25725, 33367, 41009, 48651, 56293 |
| anti-HIV-1__LightChain | 2800 | 10442, 18084, 25726, 33368, 41010, 48652, 56294 |
| anti-HIV-1__LightChain | 2801 | 10443, 18085, 25727, 33369, 41011, 48653, 56295 |
| anti-HIV-1__LightChain | 2802 | 10444, 18086, 25728, 33370, 41012, 48654, 56296 |
| anti-HIV-1__LightChain | 2803 | 10445, 18087, 25729, 33371, 41013, 48655, 56297 |
| anti-HIV-1__LightChain | 2804 | 10446, 18088, 25730, 33372, 41014, 48656, 56298 |
| anti-HIV-1__LightChain | 2805 | 10447, 18089, 25731, 33373, 41015, 48657, 56299 |
| anti-HIV-1__LightChain | 2806 | 10448, 18090, 25732, 33374, 41016, 48658, 56300 |
| anti-HIV-1__LightChain | 2807 | 10449, 18091, 25733, 33375, 41017, 48659, 56301 |
| anti-HIV-1__LightChain | 2808 | 10450, 18092, 25734, 33376, 41018, 48660, 56302 |

TABLE 3-continued

RNA and amino acid sequences of exemplified antibodies

| Name | Protein SEQ ID NO | RNA SEQ ID NO |
| --- | --- | --- |
| anti-HIV-1_LightChain | 2809 | 10451, 18093, 25735, 33377, 41019, 48661, 56303 |
| anti-HIV-1_LightChain | 2810 | 10452, 18094, 25736, 33378, 41020, 48662, 56304 |
| anti-HIV-1_LightChain | 2811 | 10453, 18095, 25737, 33379, 41021, 48663, 56305 |
| anti-HIV-1_LightChain | 2812 | 10454, 18096, 25738, 33380, 41022, 48664, 56306 |
| anti-HIV-1_LightChain | 2813 | 10455, 18097, 25739, 33381, 41023, 48665, 56307 |
| anti-HIV-1_LightChain | 2814 | 10456, 18098, 25740, 33382, 41024, 48666, 56308 |
| anti-HIV-1_LightChain | 2815 | 10457, 18099, 25741, 33383, 41025, 48667, 56309 |
| anti-HIV-1_LightChain | 2816 | 10458, 18100, 25742, 33384, 41026, 48668, 56310 |
| anti-HIV-1_LightChain | 2817 | 10459, 18101, 25743, 33385, 41027, 48669, 56311 |
| anti-HIV-1_LightChain | 2818 | 10460, 18102, 25744, 33386, 41028, 48670, 56312 |
| anti-HIV-1_LightChain | 2819 | 10461, 18103, 25745, 33387, 41029, 48671, 56313 |
| anti-HIV-1_LightChain | 2820 | 10462, 18104, 25746, 33388, 41030, 48672, 56314 |
| anti-HIV-1_HeavyChain | 2821 | 10463, 18105, 25747, 33389, 41031, 48673, 56315 |
| anti-HIV-1_HeavyChain | 2822 | 10464, 18106, 25748, 33390, 41032, 48674, 56316 |
| anti-HIV-1_HeavyChain | 2823 | 10465, 18107, 25749, 33391, 41033, 48675, 56317 |
| anti-HIV-1_HeavyChain | 2824 | 10466, 18108, 25750, 33392, 41034, 48676, 56318 |
| anti-HIV-1_HeavyChain | 2825 | 10467, 18109, 25751, 33393, 41035, 48677, 56319 |
| anti-HIV-1_HeavyChain | 2826 | 10468, 18110, 25752, 33394, 41036, 48678, 56320 |
| anti-HIV-1_HeavyChain | 2827 | 10469, 18111, 25753, 33395, 41037, 48679, 56321 |
| anti-HIV-1_HeavyChain | 2828 | 10470, 18112, 25754, 33396, 41038, 48680, 56322 |
| anti-HIV-1_HeavyChain | 2829 | 10471, 18113, 25755, 33397, 41039, 48681, 56323 |
| anti-HIV-1_HeavyChain | 2830 | 10472, 18114, 25756, 33398, 41040, 48682, 56324 |
| anti-HIV-1_HeavyChain | 2831 | 10473, 18115, 25757, 33399, 41041, 48683, 56325 |
| anti-HIV-1_HeavyChain | 2832 | 10474, 18116, 25758, 33400, 41042, 48684, 56326 |
| anti-HIV-1_HeavyChain | 2833 | 10475, 18117, 25759, 33401, 41043, 48685, 56327 |
| anti-HIV-1_HeavyChain | 2834 | 10476, 18118, 25760, 33402, 41044, 48686, 56328 |
| anti-HIV-1_HeavyChain | 2835 | 10477, 18119, 25761, 33403, 41045, 48687, 56329 |
| anti-HIV-1_HeavyChain | 2836 | 10478, 18120, 25762, 33404, 41046, 48688, 56330 |
| anti-HIV-1_HeavyChain | 2837 | 10479, 18121, 25763, 33405, 41047, 48689, 56331 |
| anti-HIV-1_HeavyChain | 2838 | 10480, 18122, 25764, 33406, 41048, 48690, 56332 |
| anti-HIV-1_HeavyChain | 2839 | 10481, 18123, 25765, 33407, 41049, 48691, 56333 |
| anti-HIV-1_HeavyChain | 2840 | 10482, 18124, 25766, 33408, 41050, 48692, 56334 |
| anti-HIV-1_HeavyChain | 2841 | 10483, 18125, 25767, 33409, 41051, 48693, 56335 |
| anti-HIV-1_HeavyChain | 2842 | 10484, 18126, 25768, 33410, 41052, 48694, 56336 |
| anti-HIV-1_HeavyChain | 2843 | 10485, 18127, 25769, 33411, 41053, 48695, 56337 |
| anti-HIV-1_HeavyChain | 2844 | 10486, 18128, 25770, 33412, 41054, 48696, 56338 |
| anti-HIV-1_HeavyChain | 2845 | 10487, 18129, 25771, 33413, 41055, 48697, 56339 |
| anti-HIV-1_HeavyChain | 2846 | 10488, 18130, 25772, 33414, 41056, 48698, 56340 |
| anti-HIV-1_HeavyChain | 2847 | 10489, 18131, 25773, 33415, 41057, 48699, 56341 |
| anti-HIV-1_LightChain | 2848 | 10490, 18132, 25774, 33416, 41058, 48700, 56342 |
| anti-HIV-1_HeavyChain | 2849 | 10491, 18133, 25775, 33417, 41059, 48701, 56343 |
| anti-HIV-1_HeavyChain | 2850 | 10492, 18134, 25776, 33418, 41060, 48702, 56344 |
| anti-HIV-1_HeavyChain | 2851 | 10493, 18135, 25777, 33419, 41061, 48703, 56345 |
| anti-HIV-1_HeavyChain | 2852 | 10494, 18136, 25778, 33420, 41062, 48704, 56346 |
| anti-HIV-1_HeavyChain | 2853 | 10495, 18137, 25779, 33421, 41063, 48705, 56347 |
| anti-HIV-1_HeavyChain | 2854 | 10496, 18138, 25780, 33422, 41064, 48706, 56348 |
| anti-HIV-1_HeavyChain | 2855 | 10497, 18139, 25781, 33423, 41065, 48707, 56349 |
| anti-HIV-1_HeavyChain | 2856 | 10498, 18140, 25782, 33424, 41066, 48708, 56350 |
| anti-HIV-1_HeavyChain | 2857 | 10499, 18141, 25783, 33425, 41067, 48709, 56351 |
| anti-HIV-1_HeavyChain | 2858 | 10500, 18142, 25784, 33426, 41068, 48710, 56352 |
| anti-HIV-1_HeavyChain | 2859 | 10501, 18143, 25785, 33427, 41069, 48711, 56353 |
| anti-HIV-1_HeavyChain | 2860 | 10502, 18144, 25786, 33428, 41070, 48712, 56354 |
| anti-HIV-1_HeavyChain | 2861 | 10503, 18145, 25787, 33429, 41071, 48713, 56355 |
| anti-HIV-1_HeavyChain | 2862 | 10504, 18146, 25788, 33430, 41072, 48714, 56356 |
| anti-HIV-1_HeavyChain | 2863 | 10505, 18147, 25789, 33431, 41073, 48715, 56357 |
| anti-HIV-1_HeavyChain | 2864 | 10506, 18148, 25790, 33432, 41074, 48716, 56358 |
| anti-HIV-1_HeavyChain | 2865 | 10507, 18149, 25791, 33433, 41075, 48717, 56359 |
| anti-HIV-1_HeavyChain | 2866 | 10508, 18150, 25792, 33434, 41076, 48718, 56360 |
| anti-HIV-1_HeavyChain | 2867 | 10509, 18151, 25793, 33435, 41077, 48719, 56361 |
| anti-HIV-1_HeavyChain | 2868 | 10510, 18152, 25794, 33436, 41078, 48720, 56362 |
| anti-HIV-1_HeavyChain | 2869 | 10511, 18153, 25795, 33437, 41079, 48721, 56363 |
| anti-HIV-1_HeavyChain | 2870 | 10512, 18154, 25796, 33438, 41080, 48722, 56364 |
| anti-HIV-1_HeavyChain | 2871 | 10513, 18155, 25797, 33439, 41081, 48723, 56365 |
| anti-HIV-1_HeavyChain | 2872 | 10514, 18156, 25798, 33440, 41082, 48724, 56366 |
| anti-HIV-1_HeavyChain | 2873 | 10515, 18157, 25799, 33441, 41083, 48725, 56367 |
| anti-HIV-1_HeavyChain | 2874 | 10516, 18158, 25800, 33442, 41084, 48726, 56368 |
| anti-HIV-1_HeavyChain | 2875 | 10517, 18159, 25801, 33443, 41085, 48727, 56369 |
| anti-HIV-1_HeavyChain | 2876 | 10518, 18160, 25802, 33444, 41086, 48728, 56370 |
| anti-HIV-1_HeavyChain | 2877 | 10519, 18161, 25803, 33445, 41087, 48729, 56371 |
| anti-HIV-1_HeavyChain | 2878 | 10520, 18162, 25804, 33446, 41088, 48730, 56372 |
| anti-HIV-1_HeavyChain | 2879 | 10521, 18163, 25805, 33447, 41089, 48731, 56373 |
| anti-HIV-1_HeavyChain | 2880 | 10522, 18164, 25806, 33448, 41090, 48732, 56374 |
| anti-HIV-1_HeavyChain | 2881 | 10523, 18165, 25807, 33449, 41091, 48733, 56375 |
| anti-HIV-1_HeavyChain | 2882 | 10524, 18166, 25808, 33450, 41092, 48734, 56376 |
| anti-HIV-1_HeavyChain | 2883 | 10525, 18167, 25809, 33451, 41093, 48735, 56377 |
| anti-HIV-1_HeavyChain | 2884 | 10526, 18168, 25810, 33452, 41094, 48736, 56378 |

TABLE 3-continued

RNA and amino acid sequences of exemplified antibodies

| Name | Protein SEQ ID NO | RNA SEQ ID NO |
| --- | --- | --- |
| anti-HIV-1_HeavyChain | 2885 | 10527, 18169, 25811, 33453, 41095, 48737, 56379 |
| anti-HIV-1_HeavyChain | 2886 | 10528, 18170, 25812, 33454, 41096, 48738, 56380 |
| anti-HIV-1_HeavyChain | 2887 | 10529, 18171, 25813, 33455, 41097, 48739, 56381 |
| anti-HIV-1_HeavyChain | 2888 | 10530, 18172, 25814, 33456, 41098, 48740, 56382 |
| anti-HIV-1_HeavyChain | 2889 | 10531, 18173, 25815, 33457, 41099, 48741, 56383 |
| anti-HIV-1_HeavyChain | 2890 | 10532, 18174, 25816, 33458, 41100, 48742, 56384 |
| anti-HIV-1_HeavyChain | 2891 | 10533, 18175, 25817, 33459, 41101, 48743, 56385 |
| anti-HIV-1_HeavyChain | 2892 | 10534, 18176, 25818, 33460, 41102, 48744, 56386 |
| anti-HIV-1_HeavyChain | 2893 | 10535, 18177, 25819, 33461, 41103, 48745, 56387 |
| anti-HIV-1_HeavyChain | 2894 | 10536, 18178, 25820, 33462, 41104, 48746, 56388 |
| anti-HIV-1_HeavyChain | 2895 | 10537, 18179, 25821, 33463, 41105, 48747, 56389 |
| anti-HIV-1_HeavyChain | 2896 | 10538, 18180, 25822, 33464, 41106, 48748, 56390 |
| anti-HIV-1_HeavyChain | 2897 | 10539, 18181, 25823, 33465, 41107, 48749, 56391 |
| anti-HIV-1_HeavyChain | 2898 | 10540, 18182, 25824, 33466, 41108, 48750, 56392 |
| anti-HIV-1_HeavyChain | 2899 | 10541, 18183, 25825, 33467, 41109, 48751, 56393 |
| anti-HIV-1_HeavyChain | 2900 | 10542, 18184, 25826, 33468, 41110, 48752, 56394 |
| anti-HIV-1_HeavyChain | 2901 | 10543, 18185, 25827, 33469, 41111, 48753, 56395 |
| anti-HIV-1_HeavyChain | 2902 | 10544, 18186, 25828, 33470, 41112, 48754, 56396 |
| anti-HIV-1_HeavyChain | 2903 | 10545, 18187, 25829, 33471, 41113, 48755, 56397 |
| anti-HIV-1_HeavyChain | 2904 | 10546, 18188, 25830, 33472, 41114, 48756, 56398 |
| anti-HIV-1_HeavyChain | 2905 | 10547, 18189, 25831, 33473, 41115, 48757, 56399 |
| anti-HIV-1_HeavyChain | 2906 | 10548, 18190, 25832, 33474, 41116, 48758, 56400 |
| anti-HIV-1_HeavyChain | 2907 | 10549, 18191, 25833, 33475, 41117, 48759, 56401 |
| anti-HIV-1_HeavyChain | 2908 | 10550, 18192, 25834, 33476, 41118, 48760, 56402 |
| anti-HIV-1_HeavyChain | 2909 | 10551, 18193, 25835, 33477, 41119, 48761, 56403 |
| anti-HIV-1_HeavyChain | 2910 | 10552, 18194, 25836, 33478, 41120, 48762, 56404 |
| anti-HIV-1_HeavyChain | 2911 | 10553, 18195, 25837, 33479, 41121, 48763, 56405 |
| anti-HIV-1_HeavyChain | 2912 | 10554, 18196, 25838, 33480, 41122, 48764, 56406 |
| anti-HIV-1_HeavyChain | 2913 | 10555, 18197, 25839, 33481, 41123, 48765, 56407 |
| anti-HIV-1_HeavyChain | 2914 | 10556, 18198, 25840, 33482, 41124, 48766, 56408 |
| anti-HIV-1_HeavyChain | 2915 | 10557, 18199, 25841, 33483, 41125, 48767, 56409 |
| anti-HIV-1_HeavyChain | 2916 | 10558, 18200, 25842, 33484, 41126, 48768, 56410 |
| anti-HIV-1_HeavyChain | 2917 | 10559, 18201, 25843, 33485, 41127, 48769, 56411 |
| anti-HIV-1_HeavyChain | 2918 | 10560, 18202, 25844, 33486, 41128, 48770, 56412 |
| anti-HIV-1_HeavyChain | 2919 | 10561, 18203, 25845, 33487, 41129, 48771, 56413 |
| anti-HIV-1_HeavyChain | 2920 | 10562, 18204, 25846, 33488, 41130, 48772, 56414 |
| anti-HIV-1_HeavyChain | 2921 | 10563, 18205, 25847, 33489, 41131, 48773, 56415 |
| anti-HIV-1_HeavyChain | 2922 | 10564, 18206, 25848, 33490, 41132, 48774, 56416 |
| anti-HIV-1_HeavyChain | 2923 | 10565, 18207, 25849, 33491, 41133, 48775, 56417 |
| anti-HIV-1_HeavyChain | 2924 | 10566, 18208, 25850, 33492, 41134, 48776, 56418 |
| anti-HIV-1_HeavyChain | 2925 | 10567, 18209, 25851, 33493, 41135, 48777, 56419 |
| anti-HIV-1_HeavyChain | 2926 | 10568, 18210, 25852, 33494, 41136, 48778, 56420 |
| anti-HIV-1_HeavyChain | 2927 | 10569, 18211, 25853, 33495, 41137, 48779, 56421 |
| anti-HIV-1_HeavyChain | 2928 | 10570, 18212, 25854, 33496, 41138, 48780, 56422 |
| anti-HIV-1_HeavyChain | 2929 | 10571, 18213, 25855, 33497, 41139, 48781, 56423 |
| anti-HIV-1_HeavyChain | 2930 | 10572, 18214, 25856, 33498, 41140, 48782, 56424 |
| anti-HIV-1_HeavyChain | 2931 | 10573, 18215, 25857, 33499, 41141, 48783, 56425 |
| anti-HIV-1_HeavyChain | 2932 | 10574, 18216, 25858, 33500, 41142, 48784, 56426 |
| anti-HIV-1_HeavyChain | 2933 | 10575, 18217, 25859, 33501, 41143, 48785, 56427 |
| anti-HIV-1_HeavyChain | 2934 | 10576, 18218, 25860, 33502, 41144, 48786, 56428 |
| anti-HIV-1_HeavyChain | 2935 | 10577, 18219, 25861, 33503, 41145, 48787, 56429 |
| anti-HIV-1_HeavyChain | 2936 | 10578, 18220, 25862, 33504, 41146, 48788, 56430 |
| anti-HIV-1_HeavyChain | 2937 | 10579, 18221, 25863, 33505, 41147, 48789, 56431 |
| anti-HIV-1_HeavyChain | 2938 | 10580, 18222, 25864, 33506, 41148, 48790, 56432 |
| anti-HIV-1_HeavyChain | 2939 | 10581, 18223, 25865, 33507, 41149, 48791, 56433 |
| anti-HIV-1_HeavyChain | 2940 | 10582, 18224, 25866, 33508, 41150, 48792, 56434 |
| anti-HIV-1_HeavyChain | 2941 | 10583, 18225, 25867, 33509, 41151, 48793, 56435 |
| anti-HIV-1_HeavyChain | 2942 | 10584, 18226, 25868, 33510, 41152, 48794, 56436 |
| anti-HIV-1_HeavyChain | 2943 | 10585, 18227, 25869, 33511, 41153, 48795, 56437 |
| anti-HIV-1_HeavyChain | 2944 | 10586, 18228, 25870, 33512, 41154, 48796, 56438 |
| anti-HIV-1_HeavyChain | 2945 | 10587, 18229, 25871, 33513, 41155, 48797, 56439 |
| anti-HIV-1_HeavyChain | 2946 | 10588, 18230, 25872, 33514, 41156, 48798, 56440 |
| anti-HIV-1_HeavyChain | 2947 | 10589, 18231, 25873, 33515, 41157, 48799, 56441 |
| anti-HIV-1_HeavyChain | 2948 | 10590, 18232, 25874, 33516, 41158, 48800, 56442 |
| anti-HIV-1_HeavyChain | 2949 | 10591, 18233, 25875, 33517, 41159, 48801, 56443 |
| anti-HIV-1_HeavyChain | 2950 | 10592, 18234, 25876, 33518, 41160, 48802, 56444 |
| anti-HIV-1_HeavyChain | 2951 | 10593, 18235, 25877, 33519, 41161, 48803, 56445 |
| anti-HIV-1_HeavyChain | 2952 | 10594, 18236, 25878, 33520, 41162, 48804, 56446 |
| anti-HIV-1_HeavyChain | 2953 | 10595, 18237, 25879, 33521, 41163, 48805, 56447 |
| anti-HIV-1_HeavyChain | 2954 | 10596, 18238, 25880, 33522, 41164, 48806, 56448 |
| anti-HIV-1_HeavyChain | 2955 | 10597, 18239, 25881, 33523, 41165, 48807, 56449 |
| anti-HIV-1_HeavyChain | 2956 | 10598, 18240, 25882, 33524, 41166, 48808, 56450 |
| anti-HIV-1_HeavyChain | 2957 | 10599, 18241, 25883, 33525, 41167, 48809, 56451 |
| anti-HIV-1_HeavyChain | 2958 | 10600, 18242, 25884, 33526, 41168, 48810, 56452 |
| anti-HIV-1_HeavyChain | 2959 | 10601, 18243, 25885, 33527, 41169, 48811, 56453 |
| anti-HIV-1_HeavyChain | 2960 | 10602, 18244, 25886, 33528, 41170, 48812, 56454 |

TABLE 3-continued

RNA and amino acid sequences of exemplified antibodies

| Name | Protein SEQ ID NO | RNA SEQ ID NO |
|---|---|---|
| anti-HIV-1_HeavyChain | 2961 | 10603, 18245, 25887, 33529, 41171, 48813, 56455 |
| anti-HIV-1_HeavyChain | 2962 | 10604, 18246, 25888, 33530, 41172, 48814, 56456 |
| anti-HIV-1_HeavyChain | 2963 | 10605, 18247, 25889, 33531, 41173, 48815, 56457 |
| anti-HIV-1_HeavyChain | 2964 | 10606, 18248, 25890, 33532, 41174, 48816, 56458 |
| anti-HIV-1_HeavyChain | 2965 | 10607, 18249, 25891, 33533, 41175, 48817, 56459 |
| anti-HIV-1_HeavyChain | 2966 | 10608, 18250, 25892, 33534, 41176, 48818, 56460 |
| anti-HIV-1_HeavyChain | 2967 | 10609, 18251, 25893, 33535, 41177, 48819, 56461 |
| anti-HIV-1_HeavyChain | 2968 | 10610, 18252, 25894, 33536, 41178, 48820, 56462 |
| anti-HIV-1_HeavyChain | 2969 | 10611, 18253, 25895, 33537, 41179, 48821, 56463 |
| anti-HIV-1_HeavyChain | 2970 | 10612, 18254, 25896, 33538, 41180, 48822, 56464 |
| anti-HIV-1_HeavyChain | 2971 | 10613, 18255, 25897, 33539, 41181, 48823, 56465 |
| anti-HIV-1_HeavyChain | 2972 | 10614, 18256, 25898, 33540, 41182, 48824, 56466 |
| anti-HIV-1_HeavyChain | 2973 | 10615, 18257, 25899, 33541, 41183, 48825, 56467 |
| anti-HIV-1_HeavyChain | 2974 | 10616, 18258, 25900, 33542, 41184, 48826, 56468 |
| anti-HIV-1_HeavyChain | 2975 | 10617, 18259, 25901, 33543, 41185, 48827, 56469 |
| anti-HIV-1_HeavyChain | 2976 | 10618, 18260, 25902, 33544, 41186, 48828, 56470 |
| anti-HIV-1_HeavyChain | 2977 | 10619, 18261, 25903, 33545, 41187, 48829, 56471 |
| anti-HIV-1_HeavyChain | 2978 | 10620, 18262, 25904, 33546, 41188, 48830, 56472 |
| anti-HIV-1_HeavyChain | 2979 | 10621, 18263, 25905, 33547, 41189, 48831, 56473 |
| anti-HIV-1_HeavyChain | 2980 | 10622, 18264, 25906, 33548, 41190, 48832, 56474 |
| anti-HIV-1_HeavyChain | 2981 | 10623, 18265, 25907, 33549, 41191, 48833, 56475 |
| anti-HIV-1_HeavyChain | 2982 | 10624, 18266, 25908, 33550, 41192, 48834, 56476 |
| anti-HIV-1_HeavyChain | 2983 | 10625, 18267, 25909, 33551, 41193, 48835, 56477 |
| anti-HIV-1_HeavyChain | 2984 | 10626, 18268, 25910, 33552, 41194, 48836, 56478 |
| anti-HIV-1_HeavyChain | 2985 | 10627, 18269, 25911, 33553, 41195, 48837, 56479 |
| anti-HIV-1_HeavyChain | 2986 | 10628, 18270, 25912, 33554, 41196, 48838, 56480 |
| anti-HIV-1_HeavyChain | 2987 | 10629, 18271, 25913, 33555, 41197, 48839, 56481 |
| anti-HIV-1_HeavyChain | 2988 | 10630, 18272, 25914, 33556, 41198, 48840, 56482 |
| anti-HIV-1_HeavyChain | 2989 | 10631, 18273, 25915, 33557, 41199, 48841, 56483 |
| anti-HIV-1_HeavyChain | 2990 | 10632, 18274, 25916, 33558, 41200, 48842, 56484 |
| anti-HIV-1_HeavyChain | 2991 | 10633, 18275, 25917, 33559, 41201, 48843, 56485 |
| anti-HIV-1_HeavyChain | 2992 | 10634, 18276, 25918, 33560, 41202, 48844, 56486 |
| anti-HIV-1_HeavyChain | 2993 | 10635, 18277, 25919, 33561, 41203, 48845, 56487 |
| anti-HIV-1_HeavyChain | 2994 | 10636, 18278, 25920, 33562, 41204, 48846, 56488 |
| anti-HIV-1_HeavyChain | 2995 | 10637, 18279, 25921, 33563, 41205, 48847, 56489 |
| anti-HIV-1_HeavyChain | 2996 | 10638, 18280, 25922, 33564, 41206, 48848, 56490 |
| anti-HIV-1_HeavyChain | 2997 | 10639, 18281, 25923, 33565, 41207, 48849, 56491 |
| anti-HIV-1_HeavyChain | 2998 | 10640, 18282, 25924, 33566, 41208, 48850, 56492 |
| anti-HIV-1_HeavyChain | 2999 | 10641, 18283, 25925, 33567, 41209, 48851, 56493 |
| anti-HIV-1_HeavyChain | 3000 | 10642, 18284, 25926, 33568, 41210, 48852, 56494 |
| anti-HIV-1_HeavyChain | 3001 | 10643, 18285, 25927, 33569, 41211, 48853, 56495 |
| anti-HIV-1_HeavyChain | 3002 | 10644, 18286, 25928, 33570, 41212, 48854, 56496 |
| anti-HIV-1_HeavyChain | 3003 | 10645, 18287, 25929, 33571, 41213, 48855, 56497 |
| anti-HIV-1_HeavyChain | 3004 | 10646, 18288, 25930, 33572, 41214, 48856, 56498 |
| anti-HIV-1_HeavyChain | 3005 | 10647, 18289, 25931, 33573, 41215, 48857, 56499 |
| anti-HIV-1_HeavyChain | 3006 | 10648, 18290, 25932, 33574, 41216, 48858, 56500 |
| anti-HIV-1_HeavyChain | 3007 | 10649, 18291, 25933, 33575, 41217, 48859, 56501 |
| anti-HIV-1_HeavyChain | 3008 | 10650, 18292, 25934, 33576, 41218, 48860, 56502 |
| anti-HIV-1_HeavyChain | 3009 | 10651, 18293, 25935, 33577, 41219, 48861, 56503 |
| anti-HIV-1_HeavyChain | 3010 | 10652, 18294, 25936, 33578, 41220, 48862, 56504 |
| anti-HIV-1_HeavyChain | 3011 | 10653, 18295, 25937, 33579, 41221, 48863, 56505 |
| anti-HIV-1_HeavyChain | 3012 | 10654, 18296, 25938, 33580, 41222, 48864, 56506 |
| anti-HIV-1_HeavyChain | 3013 | 10655, 18297, 25939, 33581, 41223, 48865, 56507 |
| anti-HIV-1_HeavyChain | 3014 | 10656, 18298, 25940, 33582, 41224, 48866, 56508 |
| anti-HIV-1_HeavyChain | 3015 | 10657, 18299, 25941, 33583, 41225, 48867, 56509 |
| anti-HIV-1_HeavyChain | 3016 | 10658, 18300, 25942, 33584, 41226, 48868, 56510 |
| anti-HIV-1_HeavyChain | 3017 | 10659, 18301, 25943, 33585, 41227, 48869, 56511 |
| anti-HIV-1_HeavyChain | 3018 | 10660, 18302, 25944, 33586, 41228, 48870, 56512 |
| anti-HIV-1_HeavyChain | 3019 | 10661, 18303, 25945, 33587, 41229, 48871, 56513 |
| anti-HIV-1_HeavyChain | 3020 | 10662, 18304, 25946, 33588, 41230, 48872, 56514 |
| anti-HIV-1_HeavyChain | 3021 | 10663, 18305, 25947, 33589, 41231, 48873, 56515 |
| anti-HIV-1_HeavyChain | 3022 | 10664, 18306, 25948, 33590, 41232, 48874, 56516 |
| anti-HIV-1_HeavyChain | 3023 | 10665, 18307, 25949, 33591, 41233, 48875, 56517 |
| anti-HIV-1_HeavyChain | 3024 | 10666, 18308, 25950, 33592, 41234, 48876, 56518 |
| anti-HIV-1_HeavyChain | 3025 | 10667, 18309, 25951, 33593, 41235, 48877, 56519 |
| anti-HIV-1_HeavyChain | 3026 | 10668, 18310, 25952, 33594, 41236, 48878, 56520 |
| anti-HIV-1_HeavyChain | 3027 | 10669, 18311, 25953, 33595, 41237, 48879, 56521 |
| anti-HIV-1_HeavyChain | 3028 | 10670, 18312, 25954, 33596, 41238, 48880, 56522 |
| anti-HIV-1_HeavyChain | 3029 | 10671, 18313, 25955, 33597, 41239, 48881, 56523 |
| anti-HIV-1_HeavyChain | 3030 | 10672, 18314, 25956, 33598, 41240, 48882, 56524 |
| anti-HIV-1_HeavyChain | 3031 | 10673, 18315, 25957, 33599, 41241, 48883, 56525 |
| anti-HIV-1_HeavyChain | 3032 | 10674, 18316, 25958, 33600, 41242, 48884, 56526 |
| anti-HIV-1_HeavyChain | 3033 | 10675, 18317, 25959, 33601, 41243, 48885, 56527 |
| anti-HIV-1_HeavyChain | 3034 | 10676, 18318, 25960, 33602, 41244, 48886, 56528 |
| anti-HIV-1_HeavyChain | 3035 | 10677, 18319, 25961, 33603, 41245, 48887, 56529 |
| anti-HIV-1_HeavyChain | 3036 | 10678, 18320, 25962, 33604, 41246, 48888, 56530 |

TABLE 3-continued

RNA and amino acid sequences of exemplified antibodies

| Name | Protein SEQ ID NO | RNA SEQ ID NO |
| --- | --- | --- |
| anti-HIV-1_HeavyChain | 3037 | 10679, 18321, 25963, 33605, 41247, 48889, 56531 |
| anti-HIV-1_HeavyChain | 3038 | 10680, 18322, 25964, 33606, 41248, 48890, 56532 |
| anti-HIV-1_HeavyChain | 3039 | 10681, 18323, 25965, 33607, 41249, 48891, 56533 |
| anti-HIV-1_HeavyChain | 3040 | 10682, 18324, 25966, 33608, 41250, 48892, 56534 |
| anti-HIV-1_HeavyChain | 3041 | 10683, 18325, 25967, 33609, 41251, 48893, 56535 |
| anti-HIV-1_HeavyChain | 3042 | 10684, 18326, 25968, 33610, 41252, 48894, 56536 |
| anti-HIV-1_HeavyChain | 3043 | 10685, 18327, 25969, 33611, 41253, 48895, 56537 |
| anti-HIV-1_HeavyChain | 3044 | 10686, 18328, 25970, 33612, 41254, 48896, 56538 |
| anti-HIV-1_HeavyChain | 3045 | 10687, 18329, 25971, 33613, 41255, 48897, 56539 |
| anti-HIV-1_HeavyChain | 3046 | 10688, 18330, 25972, 33614, 41256, 48898, 56540 |
| anti-HIV-1_HeavyChain | 3047 | 10689, 18331, 25973, 33615, 41257, 48899, 56541 |
| anti-HIV-1_HeavyChain | 3048 | 10690, 18332, 25974, 33616, 41258, 48900, 56542 |
| anti-HIV-1_HeavyChain | 3049 | 10691, 18333, 25975, 33617, 41259, 48901, 56543 |
| anti-HIV-1_HeavyChain | 3050 | 10692, 18334, 25976, 33618, 41260, 48902, 56544 |
| anti-HIV-1_HeavyChain | 3051 | 10693, 18335, 25977, 33619, 41261, 48903, 56545 |
| anti-HIV-1_HeavyChain | 3052 | 10694, 18336, 25978, 33620, 41262, 48904, 56546 |
| anti-HIV-1_HeavyChain | 3053 | 10695, 18337, 25979, 33621, 41263, 48905, 56547 |
| anti-HIV-1_HeavyChain | 3054 | 10696, 18338, 25980, 33622, 41264, 48906, 56548 |
| anti-HIV-1_HeavyChain | 3055 | 10697, 18339, 25981, 33623, 41265, 48907, 56549 |
| anti-HIV-1_HeavyChain | 3056 | 10698, 18340, 25982, 33624, 41266, 48908, 56550 |
| anti-HIV-1_HeavyChain | 3057 | 10699, 18341, 25983, 33625, 41267, 48909, 56551 |
| anti-HIV-1_HeavyChain | 3058 | 10700, 18342, 25984, 33626, 41268, 48910, 56552 |
| anti-HIV-1_HeavyChain | 3059 | 10701, 18343, 25985, 33627, 41269, 48911, 56553 |
| anti-HIV-1_HeavyChain | 3060 | 10702, 18344, 25986, 33628, 41270, 48912, 56554 |
| anti-HIV-1_HeavyChain | 3061 | 10703, 18345, 25987, 33629, 41271, 48913, 56555 |
| anti-HIV-1_HeavyChain | 3062 | 10704, 18346, 25988, 33630, 41272, 48914, 56556 |
| anti-HIV-1_HeavyChain | 3063 | 10705, 18347, 25989, 33631, 41273, 48915, 56557 |
| anti-HIV-1_HeavyChain | 3064 | 10706, 18348, 25990, 33632, 41274, 48916, 56558 |
| anti-HIV-1_HeavyChain | 3065 | 10707, 18349, 25991, 33633, 41275, 48917, 56559 |
| anti-HIV-1_HeavyChain | 3066 | 10708, 18350, 25992, 33634, 41276, 48918, 56560 |
| anti-HIV-1_HeavyChain | 3067 | 10709, 18351, 25993, 33635, 41277, 48919, 56561 |
| anti-HIV-1_HeavyChain | 3068 | 10710, 18352, 25994, 33636, 41278, 48920, 56562 |
| anti-HIV-1_HeavyChain | 3069 | 10711, 18353, 25995, 33637, 41279, 48921, 56563 |
| anti-HIV-1_HeavyChain | 3070 | 10712, 18354, 25996, 33638, 41280, 48922, 56564 |
| anti-HIV-1_HeavyChain | 3071 | 10713, 18355, 25997, 33639, 41281, 48923, 56565 |
| anti-HIV-1_HeavyChain | 3072 | 10714, 18356, 25998, 33640, 41282, 48924, 56566 |
| anti-HIV-1_HeavyChain | 3073 | 10715, 18357, 25999, 33641, 41283, 48925, 56567 |
| anti-HIV-1_HeavyChain | 3074 | 10716, 18358, 26000, 33642, 41284, 48926, 56568 |
| anti-HIV-1_HeavyChain | 3075 | 10717, 18359, 26001, 33643, 41285, 48927, 56569 |
| anti-HIV-1_HeavyChain | 3076 | 10718, 18360, 26002, 33644, 41286, 48928, 56570 |
| anti-HIV-1_HeavyChain | 3077 | 10719, 18361, 26003, 33645, 41287, 48929, 56571 |
| anti-HIV-1_HeavyChain | 3078 | 10720, 18362, 26004, 33646, 41288, 48930, 56572 |
| anti-HIV-1_HeavyChain | 3079 | 10721, 18363, 26005, 33647, 41289, 48931, 56573 |
| anti-HIV-1_HeavyChain | 3080 | 10722, 18364, 26006, 33648, 41290, 48932, 56574 |
| anti-HIV-1_HeavyChain | 3081 | 10723, 18365, 26007, 33649, 41291, 48933, 56575 |
| anti-HIV-1_HeavyChain | 3082 | 10724, 18366, 26008, 33650, 41292, 48934, 56576 |
| anti-HIV-1_HeavyChain | 3083 | 10725, 18367, 26009, 33651, 41293, 48935, 56577 |
| anti-HIV-1_HeavyChain | 3084 | 10726, 18368, 26010, 33652, 41294, 48936, 56578 |
| anti-HIV-1_HeavyChain | 3085 | 10727, 18369, 26011, 33653, 41295, 48937, 56579 |
| anti-HIV-1_HeavyChain | 3086 | 10728, 18370, 26012, 33654, 41296, 48938, 56580 |
| anti-HIV-1_HeavyChain | 3087 | 10729, 18371, 26013, 33655, 41297, 48939, 56581 |
| anti-HIV-1_HeavyChain | 3088 | 10730, 18372, 26014, 33656, 41298, 48940, 56582 |
| anti-HIV-1_HeavyChain | 3089 | 10731, 18373, 26015, 33657, 41299, 48941, 56583 |
| anti-HIV-1_HeavyChain | 3090 | 10732, 18374, 26016, 33658, 41300, 48942, 56584 |
| anti-HIV-1_HeavyChain | 3091 | 10733, 18375, 26017, 33659, 41301, 48943, 56585 |
| anti-HIV-1_HeavyChain | 3092 | 10734, 18376, 26018, 33660, 41302, 48944, 56586 |
| anti-HIV-1_HeavyChain | 3093 | 10735, 18377, 26019, 33661, 41303, 48945, 56587 |
| anti-HIV-1_HeavyChain | 3094 | 10736, 18378, 26020, 33662, 41304, 48946, 56588 |
| anti-HIV-1_HeavyChain | 3095 | 10737, 18379, 26021, 33663, 41305, 48947, 56589 |
| anti-HIV-1_HeavyChain | 3096 | 10738, 18380, 26022, 33664, 41306, 48948, 56590 |
| anti-HIV-1_HeavyChain | 3097 | 10739, 18381, 26023, 33665, 41307, 48949, 56591 |
| anti-HIV-1_HeavyChain | 3098 | 10740, 18382, 26024, 33666, 41308, 48950, 56592 |
| anti-HIV-1_HeavyChain | 3099 | 10741, 18383, 26025, 33667, 41309, 48951, 56593 |
| anti-HIV-1_HeavyChain | 3100 | 10742, 18384, 26026, 33668, 41310, 48952, 56594 |
| anti-HIV-1_HeavyChain | 3101 | 10743, 18385, 26027, 33669, 41311, 48953, 56595 |
| anti-HIV-1_HeavyChain | 3102 | 10744, 18386, 26028, 33670, 41312, 48954, 56596 |
| anti-HIV-1_HeavyChain | 3103 | 10745, 18387, 26029, 33671, 41313, 48955, 56597 |
| anti-HIV-1_HeavyChain | 3104 | 10746, 18388, 26030, 33672, 41314, 48956, 56598 |
| anti-HIV-1_HeavyChain | 3105 | 10747, 18389, 26031, 33673, 41315, 48957, 56599 |
| anti-HIV-1_HeavyChain | 3106 | 10748, 18390, 26032, 33674, 41316, 48958, 56600 |
| anti-HIV-1_HeavyChain | 3107 | 10749, 18391, 26033, 33675, 41317, 48959, 56601 |
| anti-HIV-1_HeavyChain | 3108 | 10750, 18392, 26034, 33676, 41318, 48960, 56602 |
| anti-HIV-1_HeavyChain | 3109 | 10751, 18393, 26035, 33677, 41319, 48961, 56603 |
| anti-HIV-1_HeavyChain | 3110 | 10752, 18394, 26036, 33678, 41320, 48962, 56604 |
| anti-HIV-1_HeavyChain | 3111 | 10753, 18395, 26037, 33679, 41321, 48963, 56605 |
| anti-HIV-1_HeavyChain | 3112 | 10754, 18396, 26038, 33680, 41322, 48964, 56606 |

TABLE 3-continued

RNA and amino acid sequences of exemplified antibodies

| Name | Protein SEQ ID NO | RNA SEQ ID NO |
|---|---|---|
| anti-HIV-1_HeavyChain | 3113 | 10755, 18397, 26039, 33681, 41323, 48965, 56607 |
| anti-HIV-1_HeavyChain | 3114 | 10756, 18398, 26040, 33682, 41324, 48966, 56608 |
| anti-HIV-1_HeavyChain | 3115 | 10757, 18399, 26041, 33683, 41325, 48967, 56609 |
| anti-HIV-1_HeavyChain | 3116 | 10758, 18400, 26042, 33684, 41326, 48968, 56610 |
| anti-HIV-1_HeavyChain | 3117 | 10759, 18401, 26043, 33685, 41327, 48969, 56611 |
| anti-HIV-1_HeavyChain | 3118 | 10760, 18402, 26044, 33686, 41328, 48970, 56612 |
| anti-HIV-1_HeavyChain | 3119 | 10761, 18403, 26045, 33687, 41329, 48971, 56613 |
| anti-HIV-1_HeavyChain | 3120 | 10762, 18404, 26046, 33688, 41330, 48972, 56614 |
| anti-HIV-1_HeavyChain | 3121 | 10763, 18405, 26047, 33689, 41331, 48973, 56615 |
| anti-HIV-1_HeavyChain | 3122 | 10764, 18406, 26048, 33690, 41332, 48974, 56616 |
| anti-HIV-1_HeavyChain | 3123 | 10765, 18407, 26049, 33691, 41333, 48975, 56617 |
| anti-HIV-1_HeavyChain | 3124 | 10766, 18408, 26050, 33692, 41334, 48976, 56618 |
| anti-HIV-1_HeavyChain | 3125 | 10767, 18409, 26051, 33693, 41335, 48977, 56619 |
| anti-HIV-1_HeavyChain | 3126 | 10768, 18410, 26052, 33694, 41336, 48978, 56620 |
| anti-HIV-1_HeavyChain | 3127 | 10769, 18411, 26053, 33695, 41337, 48979, 56621 |
| anti-HIV-1_HeavyChain | 3128 | 10770, 18412, 26054, 33696, 41338, 48980, 56622 |
| anti-HIV-1_HeavyChain | 3129 | 10771, 18413, 26055, 33697, 41339, 48981, 56623 |
| anti-HIV-1_HeavyChain | 3130 | 10772, 18414, 26056, 33698, 41340, 48982, 56624 |
| anti-HIV-1_HeavyChain | 3131 | 10773, 18415, 26057, 33699, 41341, 48983, 56625 |
| anti-HIV-1_HeavyChain | 3132 | 10774, 18416, 26058, 33700, 41342, 48984, 56626 |
| anti-HIV-1_HeavyChain | 3133 | 10775, 18417, 26059, 33701, 41343, 48985, 56627 |
| anti-HIV-1_HeavyChain | 3134 | 10776, 18418, 26060, 33702, 41344, 48986, 56628 |
| anti-HIV-1_HeavyChain | 3135 | 10777, 18419, 26061, 33703, 41345, 48987, 56629 |
| anti-HIV-1_HeavyChain | 3136 | 10778, 18420, 26062, 33704, 41346, 48988, 56630 |
| anti-HIV-1_HeavyChain | 3137 | 10779, 18421, 26063, 33705, 41347, 48989, 56631 |
| anti-HIV-1_HeavyChain | 3138 | 10780, 18422, 26064, 33706, 41348, 48990, 56632 |
| anti-HIV-1_HeavyChain | 3139 | 10781, 18423, 26065, 33707, 41349, 48991, 56633 |
| anti-HIV-1_HeavyChain | 3140 | 10782, 18424, 26066, 33708, 41350, 48992, 56634 |
| anti-HIV-1_HeavyChain | 3141 | 10783, 18425, 26067, 33709, 41351, 48993, 56635 |
| anti-HIV-1_HeavyChain | 3142 | 10784, 18426, 26068, 33710, 41352, 48994, 56636 |
| anti-HIV-1_HeavyChain | 3143 | 10785, 18427, 26069, 33711, 41353, 48995, 56637 |
| anti-HIV-1_HeavyChain | 3144 | 10786, 18428, 26070, 33712, 41354, 48996, 56638 |
| anti-HIV-1_HeavyChain | 3145 | 10787, 18429, 26071, 33713, 41355, 48997, 56639 |
| anti-HIV-1_HeavyChain | 3146 | 10788, 18430, 26072, 33714, 41356, 48998, 56640 |
| anti-HIV-1_HeavyChain | 3147 | 10789, 18431, 26073, 33715, 41357, 48999, 56641 |
| anti-HIV-1_HeavyChain | 3148 | 10790, 18432, 26074, 33716, 41358, 49000, 56642 |
| anti-HIV-1_HeavyChain | 3149 | 10791, 18433, 26075, 33717, 41359, 49001, 56643 |
| anti-HIV-1_HeavyChain | 3150 | 10792, 18434, 26076, 33718, 41360, 49002, 56644 |
| anti-HIV-1_HeavyChain | 3151 | 10793, 18435, 26077, 33719, 41361, 49003, 56645 |
| anti-HIV-1_HeavyChain | 3152 | 10794, 18436, 26078, 33720, 41362, 49004, 56646 |
| anti-HIV-1_HeavyChain | 3153 | 10795, 18437, 26079, 33721, 41363, 49005, 56647 |
| anti-HIV-1_HeavyChain | 3154 | 10796, 18438, 26080, 33722, 41364, 49006, 56648 |
| anti-HIV-1_HeavyChain | 3155 | 10797, 18439, 26081, 33723, 41365, 49007, 56649 |
| anti-HIV-1_HeavyChain | 3156 | 10798, 18440, 26082, 33724, 41366, 49008, 56650 |
| anti-HIV-1_HeavyChain | 3157 | 10799, 18441, 26083, 33725, 41367, 49009, 56651 |
| anti-HIV-1_HeavyChain | 3158 | 10800, 18442, 26084, 33726, 41368, 49010, 56652 |
| anti-HIV-1_HeavyChain | 3159 | 10801, 18443, 26085, 33727, 41369, 49011, 56653 |
| anti-HIV-1_HeavyChain | 3160 | 10802, 18444, 26086, 33728, 41370, 49012, 56654 |
| anti-HIV-1_HeavyChain | 3161 | 10803, 18445, 26087, 33729, 41371, 49013, 56655 |
| anti-HIV-1_HeavyChain | 3162 | 10804, 18446, 26088, 33730, 41372, 49014, 56656 |
| anti-HIV-1_HeavyChain | 3163 | 10805, 18447, 26089, 33731, 41373, 49015, 56657 |
| anti-HIV-1_HeavyChain | 3164 | 10806, 18448, 26090, 33732, 41374, 49016, 56658 |
| anti-HIV-1_HeavyChain | 3165 | 10807, 18449, 26091, 33733, 41375, 49017, 56659 |
| anti-HIV-1_HeavyChain | 3166 | 10808, 18450, 26092, 33734, 41376, 49018, 56660 |
| anti-HIV-1_HeavyChain | 3167 | 10809, 18451, 26093, 33735, 41377, 49019, 56661 |
| anti-HIV-1_HeavyChain | 3168 | 10810, 18452, 26094, 33736, 41378, 49020, 56662 |
| anti-HIV-1_HeavyChain | 3169 | 10811, 18453, 26095, 33737, 41379, 49021, 56663 |
| anti-HIV-1_HeavyChain | 3170 | 10812, 18454, 26096, 33738, 41380, 49022, 56664 |
| anti-HIV-1_HeavyChain | 3171 | 10813, 18455, 26097, 33739, 41381, 49023, 56665 |
| anti-HIV-1_HeavyChain | 3172 | 10814, 18456, 26098, 33740, 41382, 49024, 56666 |
| anti-HIV-1_HeavyChain | 3173 | 10815, 18457, 26099, 33741, 41383, 49025, 56667 |
| anti-HIV-1_HeavyChain | 3174 | 10816, 18458, 26100, 33742, 41384, 49026, 56668 |
| anti-HIV-1_HeavyChain | 3175 | 10817, 18459, 26101, 33743, 41385, 49027, 56669 |
| anti-HIV-1_HeavyChain | 3176 | 10818, 18460, 26102, 33744, 41386, 49028, 56670 |
| anti-HIV-1_HeavyChain | 3177 | 10819, 18461, 26103, 33745, 41387, 49029, 56671 |
| anti-HIV-1_HeavyChain | 3178 | 10820, 18462, 26104, 33746, 41388, 49030, 56672 |
| anti-HIV-1_HeavyChain | 3179 | 10821, 18463, 26105, 33747, 41389, 49031, 56673 |
| anti-HIV-1_HeavyChain | 3180 | 10822, 18464, 26106, 33748, 41390, 49032, 56674 |
| anti-HIV-1_HeavyChain | 3181 | 10823, 18465, 26107, 33749, 41391, 49033, 56675 |
| anti-HIV-1_HeavyChain | 3182 | 10824, 18466, 26108, 33750, 41392, 49034, 56676 |
| anti-HIV-1_HeavyChain | 3183 | 10825, 18467, 26109, 33751, 41393, 49035, 56677 |
| anti-HIV-1_HeavyChain | 3184 | 10826, 18468, 26110, 33752, 41394, 49036, 56678 |
| anti-HIV-1_HeavyChain | 3185 | 10827, 18469, 26111, 33753, 41395, 49037, 56679 |
| anti-HIV-1_HeavyChain | 3186 | 10828, 18470, 26112, 33754, 41396, 49038, 56680 |
| anti-HIV-1_HeavyChain | 3187 | 10829, 18471, 26113, 33755, 41397, 49039, 56681 |
| anti-HIV-1_HeavyChain | 3188 | 10830, 18472, 26114, 33756, 41398, 49040, 56682 |

TABLE 3-continued

RNA and amino acid sequences of exemplified antibodies

| Name | Protein SEQ ID NO | RNA SEQ ID NO |
|---|---|---|
| anti-HIV-1_HeavyChain | 3189 | 10831, 18473, 26115, 33757, 41399, 49041, 56683 |
| anti-HIV-1_HeavyChain | 3190 | 10832, 18474, 26116, 33758, 41400, 49042, 56684 |
| anti-HIV-1_HeavyChain | 3191 | 10833, 18475, 26117, 33759, 41401, 49043, 56685 |
| anti-HIV-1_HeavyChain | 3192 | 10834, 18476, 26118, 33760, 41402, 49044, 56686 |
| anti-HIV-1_HeavyChain | 3193 | 10835, 18477, 26119, 33761, 41403, 49045, 56687 |
| anti-HIV-1_HeavyChain | 3194 | 10836, 18478, 26120, 33762, 41404, 49046, 56688 |
| anti-HIV-1_HeavyChain | 3195 | 10837, 18479, 26121, 33763, 41405, 49047, 56689 |
| anti-HIV-1_HeavyChain | 3196 | 10838, 18480, 26122, 33764, 41406, 49048, 56690 |
| anti-HIV-1_HeavyChain | 3197 | 10839, 18481, 26123, 33765, 41407, 49049, 56691 |
| anti-HIV-1_HeavyChain | 3198 | 10840, 18482, 26124, 33766, 41408, 49050, 56692 |
| anti-HIV-1_HeavyChain | 3199 | 10841, 18483, 26125, 33767, 41409, 49051, 56693 |
| anti-HIV-1_HeavyChain | 3200 | 10842, 18484, 26126, 33768, 41410, 49052, 56694 |
| anti-HIV-1_HeavyChain | 3201 | 10843, 18485, 26127, 33769, 41411, 49053, 56695 |
| anti-HIV-1_HeavyChain | 3202 | 10844, 18486, 26128, 33770, 41412, 49054, 56696 |
| anti-HIV-1_HeavyChain | 3203 | 10845, 18487, 26129, 33771, 41413, 49055, 56697 |
| anti-HIV-1_HeavyChain | 3204 | 10846, 18488, 26130, 33772, 41414, 49056, 56698 |
| anti-HIV-1_HeavyChain | 3205 | 10847, 18489, 26131, 33773, 41415, 49057, 56699 |
| anti-HIV-1_HeavyChain | 3206 | 10848, 18490, 26132, 33774, 41416, 49058, 56700 |
| anti-HIV-1_HeavyChain | 3207 | 10849, 18491, 26133, 33775, 41417, 49059, 56701 |
| anti-HIV-1_HeavyChain | 3208 | 10850, 18492, 26134, 33776, 41418, 49060, 56702 |
| anti-HIV-1_HeavyChain | 3209 | 10851, 18493, 26135, 33777, 41419, 49061, 56703 |
| anti-HIV-1_HeavyChain | 3210 | 10852, 18494, 26136, 33778, 41420, 49062, 56704 |
| anti-HIV-1_HeavyChain | 3211 | 10853, 18495, 26137, 33779, 41421, 49063, 56705 |
| anti-HIV-1_HeavyChain | 3212 | 10854, 18496, 26138, 33780, 41422, 49064, 56706 |
| anti-HIV-1_HeavyChain | 3213 | 10855, 18497, 26139, 33781, 41423, 49065, 56707 |
| anti-HIV-1_HeavyChain | 3214 | 10856, 18498, 26140, 33782, 41424, 49066, 56708 |
| anti-HIV-1_HeavyChain | 3215 | 10857, 18499, 26141, 33783, 41425, 49067, 56709 |
| anti-HIV-1_HeavyChain | 3216 | 10858, 18500, 26142, 33784, 41426, 49068, 56710 |
| anti-HIV-1_HeavyChain | 3217 | 10859, 18501, 26143, 33785, 41427, 49069, 56711 |
| anti-HIV-1_HeavyChain | 3218 | 10860, 18502, 26144, 33786, 41428, 49070, 56712 |
| anti-HIV-1_HeavyChain | 3219 | 10861, 18503, 26145, 33787, 41429, 49071, 56713 |
| anti-HIV-1_HeavyChain | 3220 | 10862, 18504, 26146, 33788, 41430, 49072, 56714 |
| anti-HIV-1_HeavyChain | 3221 | 10863, 18505, 26147, 33789, 41431, 49073, 56715 |
| anti-HIV-1_HeavyChain | 3222 | 10864, 18506, 26148, 33790, 41432, 49074, 56716 |
| anti-HIV-1_HeavyChain | 3223 | 10865, 18507, 26149, 33791, 41433, 49075, 56717 |
| anti-HIV-1_HeavyChain | 3224 | 10866, 18508, 26150, 33792, 41434, 49076, 56718 |
| anti-HIV-1_HeavyChain | 3225 | 10867, 18509, 26151, 33793, 41435, 49077, 56719 |
| anti-HIV-1_HeavyChain | 3226 | 10868, 18510, 26152, 33794, 41436, 49078, 56720 |
| anti-HIV-1_HeavyChain | 3227 | 10869, 18511, 26153, 33795, 41437, 49079, 56721 |
| anti-HIV-1_HeavyChain | 3228 | 10870, 18512, 26154, 33796, 41438, 49080, 56722 |
| anti-HIV-1_HeavyChain | 3229 | 10871, 18513, 26155, 33797, 41439, 49081, 56723 |
| anti-HIV-1_HeavyChain | 3230 | 10872, 18514, 26156, 33798, 41440, 49082, 56724 |
| anti-HIV-1_HeavyChain | 3231 | 10873, 18515, 26157, 33799, 41441, 49083, 56725 |
| anti-HIV-1_HeavyChain | 3232 | 10874, 18516, 26158, 33800, 41442, 49084, 56726 |
| anti-HIV-1_HeavyChain | 3233 | 10875, 18517, 26159, 33801, 41443, 49085, 56727 |
| anti-HIV-1_HeavyChain | 3234 | 10876, 18518, 26160, 33802, 41444, 49086, 56728 |
| anti-HIV-1_HeavyChain | 3235 | 10877, 18519, 26161, 33803, 41445, 49087, 56729 |
| anti-HIV-1_HeavyChain | 3236 | 10878, 18520, 26162, 33804, 41446, 49088, 56730 |
| anti-HIV-1_HeavyChain | 3237 | 10879, 18521, 26163, 33805, 41447, 49089, 56731 |
| anti-HIV-1_HeavyChain | 3238 | 10880, 18522, 26164, 33806, 41448, 49090, 56732 |
| anti-HIV-1_HeavyChain | 3239 | 10881, 18523, 26165, 33807, 41449, 49091, 56733 |
| anti-HIV-1_HeavyChain | 3240 | 10882, 18524, 26166, 33808, 41450, 49092, 56734 |
| anti-HIV-1_HeavyChain | 3241 | 10883, 18525, 26167, 33809, 41451, 49093, 56735 |
| anti-HIV-1_HeavyChain | 3242 | 10884, 18526, 26168, 33810, 41452, 49094, 56736 |
| anti-HIV-1_HeavyChain | 3243 | 10885, 18527, 26169, 33811, 41453, 49095, 56737 |
| anti-HIV-1_HeavyChain | 3244 | 10886, 18528, 26170, 33812, 41454, 49096, 56738 |
| anti-HIV-1_HeavyChain | 3245 | 10887, 18529, 26171, 33813, 41455, 49097, 56739 |
| anti-HIV-1_HeavyChain | 3246 | 10888, 18530, 26172, 33814, 41456, 49098, 56740 |
| anti-HIV-1_HeavyChain | 3247 | 10889, 18531, 26173, 33815, 41457, 49099, 56741 |
| anti-HIV-1_HeavyChain | 3248 | 10890, 18532, 26174, 33816, 41458, 49100, 56742 |
| anti-HIV-1_HeavyChain | 3249 | 10891, 18533, 26175, 33817, 41459, 49101, 56743 |
| anti-HIV-1_HeavyChain | 3250 | 10892, 18534, 26176, 33818, 41460, 49102, 56744 |
| anti-HIV-1_HeavyChain | 3251 | 10893, 18535, 26177, 33819, 41461, 49103, 56745 |
| anti-HIV-1_HeavyChain | 3252 | 10894, 18536, 26178, 33820, 41462, 49104, 56746 |
| anti-HIV-1_HeavyChain | 3253 | 10895, 18537, 26179, 33821, 41463, 49105, 56747 |
| anti-HIV-1_HeavyChain | 3254 | 10896, 18538, 26180, 33822, 41464, 49106, 56748 |
| anti-HIV-1_HeavyChain | 3255 | 10897, 18539, 26181, 33823, 41465, 49107, 56749 |
| anti-HIV-1_HeavyChain | 3256 | 10898, 18540, 26182, 33824, 41466, 49108, 56750 |
| anti-HIV-1_HeavyChain | 3257 | 10899, 18541, 26183, 33825, 41467, 49109, 56751 |
| anti-HIV-1_HeavyChain | 3258 | 10900, 18542, 26184, 33826, 41468, 49110, 56752 |
| anti-HIV-1_HeavyChain | 3259 | 10901, 18543, 26185, 33827, 41469, 49111, 56753 |
| anti-HIV-1_HeavyChain | 3260 | 10902, 18544, 26186, 33828, 41470, 49112, 56754 |
| anti-HIV-1_HeavyChain | 3261 | 10903, 18545, 26187, 33829, 41471, 49113, 56755 |
| anti-HIV-1_HeavyChain | 3262 | 10904, 18546, 26188, 33830, 41472, 49114, 56756 |
| anti-HIV-1_HeavyChain | 3263 | 10905, 18547, 26189, 33831, 41473, 49115, 56757 |
| anti-HIV-1_HeavyChain | 3264 | 10906, 18548, 26190, 33832, 41474, 49116, 56758 |

TABLE 3-continued

RNA and amino acid sequences of exemplified antibodies

| Name | Protein SEQ ID NO | RNA SEQ ID NO |
| --- | --- | --- |
| anti-HIV-1_HeavyChain | 3265 | 10907, 18549, 26191, 33833, 41475, 49117, 56759 |
| anti-HIV-1_HeavyChain | 3266 | 10908, 18550, 26192, 33834, 41476, 49118, 56760 |
| anti-HIV-1_HeavyChain | 3267 | 10909, 18551, 26193, 33835, 41477, 49119, 56761 |
| anti-HIV-1_HeavyChain | 3268 | 10910, 18552, 26194, 33836, 41478, 49120, 56762 |
| anti-HIV-1_HeavyChain | 3269 | 10911, 18553, 26195, 33837, 41479, 49121, 56763 |
| anti-HIV-1_HeavyChain | 3270 | 10912, 18554, 26196, 33838, 41480, 49122, 56764 |
| anti-HIV-1_HeavyChain | 3271 | 10913, 18555, 26197, 33839, 41481, 49123, 56765 |
| anti-HIV-1_HeavyChain | 3272 | 10914, 18556, 26198, 33840, 41482, 49124, 56766 |
| anti-HIV-1_HeavyChain | 3273 | 10915, 18557, 26199, 33841, 41483, 49125, 56767 |
| anti-HIV-1_HeavyChain | 3274 | 10916, 18558, 26200, 33842, 41484, 49126, 56768 |
| anti-HIV-1_HeavyChain | 3275 | 10917, 18559, 26201, 33843, 41485, 49127, 56769 |
| anti-HIV-1_HeavyChain | 3276 | 10918, 18560, 26202, 33844, 41486, 49128, 56770 |
| anti-HIV-1_HeavyChain | 3277 | 10919, 18561, 26203, 33845, 41487, 49129, 56771 |
| anti-HIV-1_HeavyChain | 3278 | 10920, 18562, 26204, 33846, 41488, 49130, 56772 |
| anti-HIV-1_HeavyChain | 3279 | 10921, 18563, 26205, 33847, 41489, 49131, 56773 |
| anti-HIV-1_HeavyChain | 3280 | 10922, 18564, 26206, 33848, 41490, 49132, 56774 |
| anti-HIV-1_HeavyChain | 3281 | 10923, 18565, 26207, 33849, 41491, 49133, 56775 |
| anti-HIV-1_HeavyChain | 3282 | 10924, 18566, 26208, 33850, 41492, 49134, 56776 |
| anti-HIV-1_HeavyChain | 3283 | 10925, 18567, 26209, 33851, 41493, 49135, 56777 |
| anti-HIV-1_HeavyChain | 3284 | 10926, 18568, 26210, 33852, 41494, 49136, 56778 |
| anti-HIV-1_HeavyChain | 3285 | 10927, 18569, 26211, 33853, 41495, 49137, 56779 |
| anti-HIV-1_HeavyChain | 3286 | 10928, 18570, 26212, 33854, 41496, 49138, 56780 |
| anti-HIV-1_HeavyChain | 3287 | 10929, 18571, 26213, 33855, 41497, 49139, 56781 |
| anti-HIV-1_HeavyChain | 3288 | 10930, 18572, 26214, 33856, 41498, 49140, 56782 |
| anti-HIV-1_HeavyChain | 3289 | 10931, 18573, 26215, 33857, 41499, 49141, 56783 |
| anti-HIV-1_HeavyChain | 3290 | 10932, 18574, 26216, 33858, 41500, 49142, 56784 |
| anti-HIV-1_HeavyChain | 3291 | 10933, 18575, 26217, 33859, 41501, 49143, 56785 |
| anti-HIV-1_HeavyChain | 3292 | 10934, 18576, 26218, 33860, 41502, 49144, 56786 |
| anti-HIV-1_HeavyChain | 3293 | 10935, 18577, 26219, 33861, 41503, 49145, 56787 |
| anti-HIV-1_HeavyChain | 3294 | 10936, 18578, 26220, 33862, 41504, 49146, 56788 |
| anti-HIV-1_HeavyChain | 3295 | 10937, 18579, 26221, 33863, 41505, 49147, 56789 |
| anti-HIV-1_HeavyChain | 3296 | 10938, 18580, 26222, 33864, 41506, 49148, 56790 |
| anti-HIV-1_HeavyChain | 3297 | 10939, 18581, 26223, 33865, 41507, 49149, 56791 |
| anti-HIV-1_HeavyChain | 3298 | 10940, 18582, 26224, 33866, 41508, 49150, 56792 |
| anti-HIV-1_HeavyChain | 3299 | 10941, 18583, 26225, 33867, 41509, 49151, 56793 |
| anti-HIV-1_HeavyChain | 3300 | 10942, 18584, 26226, 33868, 41510, 49152, 56794 |
| anti-HIV-1_HeavyChain | 3301 | 10943, 18585, 26227, 33869, 41511, 49153, 56795 |
| anti-HIV-1_HeavyChain | 3302 | 10944, 18586, 26228, 33870, 41512, 49154, 56796 |
| anti-HIV-1_HeavyChain | 3303 | 10945, 18587, 26229, 33871, 41513, 49155, 56797 |
| anti-HIV-1_HeavyChain | 3304 | 10946, 18588, 26230, 33872, 41514, 49156, 56798 |
| anti-HIV-1_HeavyChain | 3305 | 10947, 18589, 26231, 33873, 41515, 49157, 56799 |
| anti-HIV-1_HeavyChain | 3306 | 10948, 18590, 26232, 33874, 41516, 49158, 56800 |
| anti-HIV-1_HeavyChain | 3307 | 10949, 18591, 26233, 33875, 41517, 49159, 56801 |
| anti-HIV-1_HeavyChain | 3308 | 10950, 18592, 26234, 33876, 41518, 49160, 56802 |
| anti-HIV-1_HeavyChain | 3309 | 10951, 18593, 26235, 33877, 41519, 49161, 56803 |
| anti-HIV-1_HeavyChain | 3310 | 10952, 18594, 26236, 33878, 41520, 49162, 56804 |
| anti-HIV-1_HeavyChain | 3311 | 10953, 18595, 26237, 33879, 41521, 49163, 56805 |
| anti-HIV-1_HeavyChain | 3312 | 10954, 18596, 26238, 33880, 41522, 49164, 56806 |
| anti-HIV-1_HeavyChain | 3313 | 10955, 18597, 26239, 33881, 41523, 49165, 56807 |
| anti-HIV-1_HeavyChain | 3314 | 10956, 18598, 26240, 33882, 41524, 49166, 56808 |
| anti-HIV-1_HeavyChain | 3315 | 10957, 18599, 26241, 33883, 41525, 49167, 56809 |
| anti-HIV-1_HeavyChain | 3316 | 10958, 18600, 26242, 33884, 41526, 49168, 56810 |
| anti-HIV-1_HeavyChain | 3317 | 10959, 18601, 26243, 33885, 41527, 49169, 56811 |
| anti-HIV-1_HeavyChain | 3318 | 10960, 18602, 26244, 33886, 41528, 49170, 56812 |
| anti-HIV-1_HeavyChain | 3319 | 10961, 18603, 26245, 33887, 41529, 49171, 56813 |
| anti-HIV-1_HeavyChain | 3320 | 10962, 18604, 26246, 33888, 41530, 49172, 56814 |
| anti-HIV-1_HeavyChain | 3321 | 10963, 18605, 26247, 33889, 41531, 49173, 56815 |
| anti-HIV-1_HeavyChain | 3322 | 10964, 18606, 26248, 33890, 41532, 49174, 56816 |
| anti-HIV-1_HeavyChain | 3323 | 10965, 18607, 26249, 33891, 41533, 49175, 56817 |
| anti-HIV-1_HeavyChain | 3324 | 10966, 18608, 26250, 33892, 41534, 49176, 56818 |
| anti-HIV-1_HeavyChain | 3325 | 10967, 18609, 26251, 33893, 41535, 49177, 56819 |
| anti-HIV-1_HeavyChain | 3326 | 10968, 18610, 26252, 33894, 41536, 49178, 56820 |
| anti-HIV-1_HeavyChain | 3327 | 10969, 18611, 26253, 33895, 41537, 49179, 56821 |
| anti-HIV-1_HeavyChain | 3328 | 10970, 18612, 26254, 33896, 41538, 49180, 56822 |
| anti-HIV-1_HeavyChain | 3329 | 10971, 18613, 26255, 33897, 41539, 49181, 56823 |
| anti-HIV-1_HeavyChain | 3330 | 10972, 18614, 26256, 33898, 41540, 49182, 56824 |
| anti-HIV-1_HeavyChain | 3331 | 10973, 18615, 26257, 33899, 41541, 49183, 56825 |
| anti-HIV-1_HeavyChain | 3332 | 10974, 18616, 26258, 33900, 41542, 49184, 56826 |
| anti-HIV-1_HeavyChain | 3333 | 10975, 18617, 26259, 33901, 41543, 49185, 56827 |
| anti-HIV-1_HeavyChain | 3334 | 10976, 18618, 26260, 33902, 41544, 49186, 56828 |
| anti-HIV-1_HeavyChain | 3335 | 10977, 18619, 26261, 33903, 41545, 49187, 56829 |
| anti-HIV-1_HeavyChain | 3336 | 10978, 18620, 26262, 33904, 41546, 49188, 56830 |
| anti-HIV-1_HeavyChain | 3337 | 10979, 18621, 26263, 33905, 41547, 49189, 56831 |
| anti-HIV-1_HeavyChain | 3338 | 10980, 18622, 26264, 33906, 41548, 49190, 56832 |
| anti-HIV-1_HeavyChain | 3339 | 10981, 18623, 26265, 33907, 41549, 49191, 56833 |
| anti-HIV-1_HeavyChain | 3340 | 10982, 18624, 26266, 33908, 41550, 49192, 56834 |

TABLE 3-continued

RNA and amino acid sequences of exemplified antibodies

| Name | Protein SEQ ID NO | RNA SEQ ID NO |
|---|---|---|
| anti-HIV-1_HeavyChain | 3341 | 10983, 18625, 26267, 33909, 41551, 49193, 56835 |
| anti-HIV-1_HeavyChain | 3342 | 10984, 18626, 26268, 33910, 41552, 49194, 56836 |
| anti-HIV-1_HeavyChain | 3343 | 10985, 18627, 26269, 33911, 41553, 49195, 56837 |
| anti-HIV-1_HeavyChain | 3344 | 10986, 18628, 26270, 33912, 41554, 49196, 56838 |
| anti-HIV-1_HeavyChain | 3345 | 10987, 18629, 26271, 33913, 41555, 49197, 56839 |
| anti-HIV-1_HeavyChain | 3346 | 10988, 18630, 26272, 33914, 41556, 49198, 56840 |
| anti-HIV-1_HeavyChain | 3347 | 10989, 18631, 26273, 33915, 41557, 49199, 56841 |
| anti-HIV-1_HeavyChain | 3348 | 10990, 18632, 26274, 33916, 41558, 49200, 56842 |
| anti-HIV-1_HeavyChain | 3349 | 10991, 18633, 26275, 33917, 41559, 49201, 56843 |
| anti-HIV-1_HeavyChain | 3350 | 10992, 18634, 26276, 33918, 41560, 49202, 56844 |
| anti-HIV-1_HeavyChain | 3351 | 10993, 18635, 26277, 33919, 41561, 49203, 56845 |
| anti-HIV-1_HeavyChain | 3352 | 10994, 18636, 26278, 33920, 41562, 49204, 56846 |
| anti-HIV-1_HeavyChain | 3353 | 10995, 18637, 26279, 33921, 41563, 49205, 56847 |
| anti-HIV-1_HeavyChain | 3354 | 10996, 18638, 26280, 33922, 41564, 49206, 56848 |
| anti-HIV-1_HeavyChain | 3355 | 10997, 18639, 26281, 33923, 41565, 49207, 56849 |
| anti-HIV-1_HeavyChain | 3356 | 10998, 18640, 26282, 33924, 41566, 49208, 56850 |
| anti-HIV-1_HeavyChain | 3357 | 10999, 18641, 26283, 33925, 41567, 49209, 56851 |
| anti-HIV-1_HeavyChain | 3358 | 11000, 18642, 26284, 33926, 41568, 49210, 56852 |
| anti-HIV-1_HeavyChain | 3359 | 11001, 18643, 26285, 33927, 41569, 49211, 56853 |
| anti-HIV-1_HeavyChain | 3360 | 11002, 18644, 26286, 33928, 41570, 49212, 56854 |
| anti-HIV-1_HeavyChain | 3361 | 11003, 18645, 26287, 33929, 41571, 49213, 56855 |
| anti-HIV-1_HeavyChain | 3362 | 11004, 18646, 26288, 33930, 41572, 49214, 56856 |
| anti-HIV-1_HeavyChain | 3363 | 11005, 18647, 26289, 33931, 41573, 49215, 56857 |
| anti-HIV-1_HeavyChain | 3364 | 11006, 18648, 26290, 33932, 41574, 49216, 56858 |
| anti-HIV-1_HeavyChain | 3365 | 11007, 18649, 26291, 33933, 41575, 49217, 56859 |
| anti-HIV-1_HeavyChain | 3366 | 11008, 18650, 26292, 33934, 41576, 49218, 56860 |
| anti-HIV-1_HeavyChain | 3367 | 11009, 18651, 26293, 33935, 41577, 49219, 56861 |
| anti-HIV-1_HeavyChain | 3368 | 11010, 18652, 26294, 33936, 41578, 49220, 56862 |
| anti-HIV-1_HeavyChain | 3369 | 11011, 18653, 26295, 33937, 41579, 49221, 56863 |
| anti-HIV-1_HeavyChain | 3370 | 11012, 18654, 26296, 33938, 41580, 49222, 56864 |
| anti-HIV-1_HeavyChain | 3371 | 11013, 18655, 26297, 33939, 41581, 49223, 56865 |
| anti-HIV-1_HeavyChain | 3372 | 11014, 18656, 26298, 33940, 41582, 49224, 56866 |
| anti-HIV-1_HeavyChain | 3373 | 11015, 18657, 26299, 33941, 41583, 49225, 56867 |
| anti-HIV-1_HeavyChain | 3374 | 11016, 18658, 26300, 33942, 41584, 49226, 56868 |
| anti-HIV-1_HeavyChain | 3375 | 11017, 18659, 26301, 33943, 41585, 49227, 56869 |
| anti-HIV-1_HeavyChain | 3376 | 11018, 18660, 26302, 33944, 41586, 49228, 56870 |
| anti-HIV-1_HeavyChain | 3377 | 11019, 18661, 26303, 33945, 41587, 49229, 56871 |
| anti-HIV-1_HeavyChain | 3378 | 11020, 18662, 26304, 33946, 41588, 49230, 56872 |
| anti-HIV-1_HeavyChain | 3379 | 11021, 18663, 26305, 33947, 41589, 49231, 56873 |
| anti-HIV-1_HeavyChain | 3380 | 11022, 18664, 26306, 33948, 41590, 49232, 56874 |
| anti-HIV-1_HeavyChain | 3381 | 11023, 18665, 26307, 33949, 41591, 49233, 56875 |
| anti-HIV-1_HeavyChain | 3382 | 11024, 18666, 26308, 33950, 41592, 49234, 56876 |
| anti-HIV-1_HeavyChain | 3383 | 11025, 18667, 26309, 33951, 41593, 49235, 56877 |
| anti-HIV-1_HeavyChain | 3384 | 11026, 18668, 26310, 33952, 41594, 49236, 56878 |
| anti-HIV-1_HeavyChain | 3385 | 11027, 18669, 26311, 33953, 41595, 49237, 56879 |
| anti-HIV-1_HeavyChain | 3386 | 11028, 18670, 26312, 33954, 41596, 49238, 56880 |
| anti-HIV-1_HeavyChain | 3387 | 11029, 18671, 26313, 33955, 41597, 49239, 56881 |
| anti-HIV-1_HeavyChain | 3388 | 11030, 18672, 26314, 33956, 41598, 49240, 56882 |
| anti-HIV-1_HeavyChain | 3389 | 11031, 18673, 26315, 33957, 41599, 49241, 56883 |
| anti-HIV-1_HeavyChain | 3390 | 11032, 18674, 26316, 33958, 41600, 49242, 56884 |
| anti-HIV-1_HeavyChain | 3391 | 11033, 18675, 26317, 33959, 41601, 49243, 56885 |
| anti-HIV-1_HeavyChain | 3392 | 11034, 18676, 26318, 33960, 41602, 49244, 56886 |
| anti-HIV-1_HeavyChain | 3393 | 11035, 18677, 26319, 33961, 41603, 49245, 56887 |
| anti-HIV-1_HeavyChain | 3394 | 11036, 18678, 26320, 33962, 41604, 49246, 56888 |
| anti-HIV-1_HeavyChain | 3395 | 11037, 18679, 26321, 33963, 41605, 49247, 56889 |
| anti-HIV-1_HeavyChain | 3396 | 11038, 18680, 26322, 33964, 41606, 49248, 56890 |
| anti-HIV-1_HeavyChain | 3397 | 11039, 18681, 26323, 33965, 41607, 49249, 56891 |
| anti-HIV-1_HeavyChain | 3398 | 11040, 18682, 26324, 33966, 41608, 49250, 56892 |
| anti-HIV-1_HeavyChain | 3399 | 11041, 18683, 26325, 33967, 41609, 49251, 56893 |
| anti-HIV-1_HeavyChain | 3400 | 11042, 18684, 26326, 33968, 41610, 49252, 56894 |
| anti-HIV-1_HeavyChain | 3401 | 11043, 18685, 26327, 33969, 41611, 49253, 56895 |
| anti-HIV-1_HeavyChain | 3402 | 11044, 18686, 26328, 33970, 41612, 49254, 56896 |
| anti-HIV-1_HeavyChain | 3403 | 11045, 18687, 26329, 33971, 41613, 49255, 56897 |
| anti-HIV-1_HeavyChain | 3404 | 11046, 18688, 26330, 33972, 41614, 49256, 56898 |
| anti-HIV-1_HeavyChain | 3405 | 11047, 18689, 26331, 33973, 41615, 49257, 56899 |
| anti-HIV-1_HeavyChain | 3406 | 11048, 18690, 26332, 33974, 41616, 49258, 56900 |
| anti-HIV-1_HeavyChain | 3407 | 11049, 18691, 26333, 33975, 41617, 49259, 56901 |
| anti-HIV-1_HeavyChain | 3408 | 11050, 18692, 26334, 33976, 41618, 49260, 56902 |
| anti-HIV-1_HeavyChain | 3409 | 11051, 18693, 26335, 33977, 41619, 49261, 56903 |
| anti-HIV-1_HeavyChain | 3410 | 11052, 18694, 26336, 33978, 41620, 49262, 56904 |
| anti-HIV-1_HeavyChain | 3411 | 11053, 18695, 26337, 33979, 41621, 49263, 56905 |
| anti-HIV-1_HeavyChain | 3412 | 11054, 18696, 26338, 33980, 41622, 49264, 56906 |
| anti-HIV-1_HeavyChain | 3413 | 11055, 18697, 26339, 33981, 41623, 49265, 56907 |
| anti-HIV-1_HeavyChain | 3414 | 11056, 18698, 26340, 33982, 41624, 49266, 56908 |
| anti-HIV-1_HeavyChain | 3415 | 11057, 18699, 26341, 33983, 41625, 49267, 56909 |
| anti-HIV-1_HeavyChain | 3416 | 11058, 18700, 26342, 33984, 41626, 49268, 56910 |

TABLE 3-continued

RNA and amino acid sequences of exemplified antibodies

| Name | Protein SEQ ID NO | RNA SEQ ID NO |
|---|---|---|
| anti-HIV-1_HeavyChain | 3417 | 11059, 18701, 26343, 33985, 41627, 49269, 56911 |
| anti-HIV-1_HeavyChain | 3418 | 11060, 18702, 26344, 33986, 41628, 49270, 56912 |
| anti-HIV-1_HeavyChain | 3419 | 11061, 18703, 26345, 33987, 41629, 49271, 56913 |
| anti-HIV-1_HeavyChain | 3420 | 11062, 18704, 26346, 33988, 41630, 49272, 56914 |
| anti-HIV-1_HeavyChain | 3421 | 11063, 18705, 26347, 33989, 41631, 49273, 56915 |
| anti-HIV-1_HeavyChain | 3422 | 11064, 18706, 26348, 33990, 41632, 49274, 56916 |
| anti-HIV-1_HeavyChain | 3423 | 11065, 18707, 26349, 33991, 41633, 49275, 56917 |
| anti-HIV-1_HeavyChain | 3424 | 11066, 18708, 26350, 33992, 41634, 49276, 56918 |
| anti-HIV-1_HeavyChain | 3425 | 11067, 18709, 26351, 33993, 41635, 49277, 56919 |
| anti-HIV-1_HeavyChain | 3426 | 11068, 18710, 26352, 33994, 41636, 49278, 56920 |
| anti-HIV-1_HeavyChain | 3427 | 11069, 18711, 26353, 33995, 41637, 49279, 56921 |
| anti-HIV-1_HeavyChain | 3428 | 11070, 18712, 26354, 33996, 41638, 49280, 56922 |
| anti-HIV-1_HeavyChain | 3429 | 11071, 18713, 26355, 33997, 41639, 49281, 56923 |
| anti-HIV-1_HeavyChain | 3430 | 11072, 18714, 26356, 33998, 41640, 49282, 56924 |
| anti-HIV-1_HeavyChain | 3431 | 11073, 18715, 26357, 33999, 41641, 49283, 56925 |
| anti-HIV-1_HeavyChain | 3432 | 11074, 18716, 26358, 34000, 41642, 49284, 56926 |
| anti-HIV-1_HeavyChain | 3433 | 11075, 18717, 26359, 34001, 41643, 49285, 56927 |
| anti-HIV-1_HeavyChain | 3434 | 11076, 18718, 26360, 34002, 41644, 49286, 56928 |
| anti-HIV-1_HeavyChain | 3435 | 11077, 18719, 26361, 34003, 41645, 49287, 56929 |
| anti-HIV-1_HeavyChain | 3436 | 11078, 18720, 26362, 34004, 41646, 49288, 56930 |
| anti-HIV-1_HeavyChain | 3437 | 11079, 18721, 26363, 34005, 41647, 49289, 56931 |
| anti-HIV-1_HeavyChain | 3438 | 11080, 18722, 26364, 34006, 41648, 49290, 56932 |
| anti-HIV-1_HeavyChain | 3439 | 11081, 18723, 26365, 34007, 41649, 49291, 56933 |
| anti-HIV-1_HeavyChain | 3440 | 11082, 18724, 26366, 34008, 41650, 49292, 56934 |
| anti-HIV-1_HeavyChain | 3441 | 11083, 18725, 26367, 34009, 41651, 49293, 56935 |
| anti-HIV-1_HeavyChain | 3442 | 11084, 18726, 26368, 34010, 41652, 49294, 56936 |
| anti-HIV-1_HeavyChain | 3443 | 11085, 18727, 26369, 34011, 41653, 49295, 56937 |
| anti-HIV-1_HeavyChain | 3444 | 11086, 18728, 26370, 34012, 41654, 49296, 56938 |
| anti-HIV-1_HeavyChain | 3445 | 11087, 18729, 26371, 34013, 41655, 49297, 56939 |
| anti-HIV-1_HeavyChain | 3446 | 11088, 18730, 26372, 34014, 41656, 49298, 56940 |
| anti-HIV-1_HeavyChain | 3447 | 11089, 18731, 26373, 34015, 41657, 49299, 56941 |
| anti-HIV-1_HeavyChain | 3448 | 11090, 18732, 26374, 34016, 41658, 49300, 56942 |
| anti-HIV-1_HeavyChain | 3449 | 11091, 18733, 26375, 34017, 41659, 49301, 56943 |
| anti-HIV-1_HeavyChain | 3450 | 11092, 18734, 26376, 34018, 41660, 49302, 56944 |
| anti-HIV-1_HeavyChain | 3451 | 11093, 18735, 26377, 34019, 41661, 49303, 56945 |
| anti-HIV-1_HeavyChain | 3452 | 11094, 18736, 26378, 34020, 41662, 49304, 56946 |
| anti-HIV-1_HeavyChain | 3453 | 11095, 18737, 26379, 34021, 41663, 49305, 56947 |
| anti-HIV-1_HeavyChain | 3454 | 11096, 18738, 26380, 34022, 41664, 49306, 56948 |
| anti-HIV-1_HeavyChain | 3455 | 11097, 18739, 26381, 34023, 41665, 49307, 56949 |
| anti-HIV-1_HeavyChain | 3456 | 11098, 18740, 26382, 34024, 41666, 49308, 56950 |
| anti-HIV-1_HeavyChain | 3457 | 11099, 18741, 26383, 34025, 41667, 49309, 56951 |
| anti-HIV-1_HeavyChain | 3458 | 11100, 18742, 26384, 34026, 41668, 49310, 56952 |
| anti-HIV-1_HeavyChain | 3459 | 11101, 18743, 26385, 34027, 41669, 49311, 56953 |
| anti-HIV-1_HeavyChain | 3460 | 11102, 18744, 26386, 34028, 41670, 49312, 56954 |
| anti-HIV-1_HeavyChain | 3461 | 11103, 18745, 26387, 34029, 41671, 49313, 56955 |
| anti-HIV-1_HeavyChain | 3462 | 11104, 18746, 26388, 34030, 41672, 49314, 56956 |
| anti-HIV-1_HeavyChain | 3463 | 11105, 18747, 26389, 34031, 41673, 49315, 56957 |
| anti-HIV-1_HeavyChain | 3464 | 11106, 18748, 26390, 34032, 41674, 49316, 56958 |
| anti-HIV-1_HeavyChain | 3465 | 11107, 18749, 26391, 34033, 41675, 49317, 56959 |
| anti-HIV-1_HeavyChain | 3466 | 11108, 18750, 26392, 34034, 41676, 49318, 56960 |
| anti-HIV-1_HeavyChain | 3467 | 11109, 18751, 26393, 34035, 41677, 49319, 56961 |
| anti-HIV-1_HeavyChain | 3468 | 11110, 18752, 26394, 34036, 41678, 49320, 56962 |
| anti-HIV-1_HeavyChain | 3469 | 11111, 18753, 26395, 34037, 41679, 49321, 56963 |
| anti-HIV-1_HeavyChain | 3470 | 11112, 18754, 26396, 34038, 41680, 49322, 56964 |
| anti-HIV-1_HeavyChain | 3471 | 11113, 18755, 26397, 34039, 41681, 49323, 56965 |
| anti-HIV-1_HeavyChain | 3472 | 11114, 18756, 26398, 34040, 41682, 49324, 56966 |
| anti-HIV-1_HeavyChain | 3473 | 11115, 18757, 26399, 34041, 41683, 49325, 56967 |
| anti-HIV-1_HeavyChain | 3474 | 11116, 18758, 26400, 34042, 41684, 49326, 56968 |
| anti-HIV-1_HeavyChain | 3475 | 11117, 18759, 26401, 34043, 41685, 49327, 56969 |
| anti-HIV-1_HeavyChain | 3476 | 11118, 18760, 26402, 34044, 41686, 49328, 56970 |
| anti-HIV-1_HeavyChain | 3477 | 11119, 18761, 26403, 34045, 41687, 49329, 56971 |
| anti-HIV-1_HeavyChain | 3478 | 11120, 18762, 26404, 34046, 41688, 49330, 56972 |
| anti-HIV-1_HeavyChain | 3479 | 11121, 18763, 26405, 34047, 41689, 49331, 56973 |
| anti-HIV-1_HeavyChain | 3480 | 11122, 18764, 26406, 34048, 41690, 49332, 56974 |
| anti-HIV-1_HeavyChain | 3481 | 11123, 18765, 26407, 34049, 41691, 49333, 56975 |
| anti-HIV-1_HeavyChain | 3482 | 11124, 18766, 26408, 34050, 41692, 49334, 56976 |
| anti-HIV-1_HeavyChain | 3483 | 11125, 18767, 26409, 34051, 41693, 49335, 56977 |
| anti-HIV-1_HeavyChain | 3484 | 11126, 18768, 26410, 34052, 41694, 49336, 56978 |
| anti-HIV-1_HeavyChain | 3485 | 11127, 18769, 26411, 34053, 41695, 49337, 56979 |
| anti-HIV-1_HeavyChain | 3486 | 11128, 18770, 26412, 34054, 41696, 49338, 56980 |
| anti-HIV-1_HeavyChain | 3487 | 11129, 18771, 26413, 34055, 41697, 49339, 56981 |
| anti-HIV-1_HeavyChain | 3488 | 11130, 18772, 26414, 34056, 41698, 49340, 56982 |
| anti-HIV-1_HeavyChain | 3489 | 11131, 18773, 26415, 34057, 41699, 49341, 56983 |
| anti-HIV-1_HeavyChain | 3490 | 11132, 18774, 26416, 34058, 41700, 49342, 56984 |
| anti-HIV-1_HeavyChain | 3491 | 11133, 18775, 26417, 34059, 41701, 49343, 56985 |
| anti-HIV-1_HeavyChain | 3492 | 11134, 18776, 26418, 34060, 41702, 49344, 56986 |

TABLE 3-continued

RNA and amino acid sequences of exemplified antibodies

| Name | Protein SEQ ID NO | RNA SEQ ID NO |
| --- | --- | --- |
| anti-HIV-1_HeavyChain | 3493 | 11135, 18777, 26419, 34061, 41703, 49345, 56987 |
| anti-HIV-1_HeavyChain | 3494 | 11136, 18778, 26420, 34062, 41704, 49346, 56988 |
| anti-HIV-1_HeavyChain | 3495 | 11137, 18779, 26421, 34063, 41705, 49347, 56989 |
| anti-HIV-1_HeavyChain | 3496 | 11138, 18780, 26422, 34064, 41706, 49348, 56990 |
| anti-HIV-1_HeavyChain | 3497 | 11139, 18781, 26423, 34065, 41707, 49349, 56991 |
| anti-HIV-1_HeavyChain | 3498 | 11140, 18782, 26424, 34066, 41708, 49350, 56992 |
| anti-HIV-1_HeavyChain | 3499 | 11141, 18783, 26425, 34067, 41709, 49351, 56993 |
| anti-HIV-1_HeavyChain | 3500 | 11142, 18784, 26426, 34068, 41710, 49352, 56994 |
| anti-HIV-1_HeavyChain | 3501 | 11143, 18785, 26427, 34069, 41711, 49353, 56995 |
| anti-HIV-1_HeavyChain | 3502 | 11144, 18786, 26428, 34070, 41712, 49354, 56996 |
| anti-HIV-1_HeavyChain | 3503 | 11145, 18787, 26429, 34071, 41713, 49355, 56997 |
| anti-HIV-1_HeavyChain | 3504 | 11146, 18788, 26430, 34072, 41714, 49356, 56998 |
| anti-HIV-1_HeavyChain | 3505 | 11147, 18789, 26431, 34073, 41715, 49357, 56999 |
| anti-HIV-1_HeavyChain | 3506 | 11148, 18790, 26432, 34074, 41716, 49358, 57000 |
| anti-HIV-1_HeavyChain | 3507 | 11149, 18791, 26433, 34075, 41717, 49359, 57001 |
| anti-HIV-1_HeavyChain | 3508 | 11150, 18792, 26434, 34076, 41718, 49360, 57002 |
| anti-HIV-1_HeavyChain | 3509 | 11151, 18793, 26435, 34077, 41719, 49361, 57003 |
| anti-HIV-1_HeavyChain | 3510 | 11152, 18794, 26436, 34078, 41720, 49362, 57004 |
| anti-HIV-1_HeavyChain | 3511 | 11153, 18795, 26437, 34079, 41721, 49363, 57005 |
| anti-HIV-1_HeavyChain | 3512 | 11154, 18796, 26438, 34080, 41722, 49364, 57006 |
| anti-HIV-1_HeavyChain | 3513 | 11155, 18797, 26439, 34081, 41723, 49365, 57007 |
| anti-HIV-1_HeavyChain | 3514 | 11156, 18798, 26440, 34082, 41724, 49366, 57008 |
| anti-HIV-1_HeavyChain | 3515 | 11157, 18799, 26441, 34083, 41725, 49367, 57009 |
| anti-HIV-1_HeavyChain | 3516 | 11158, 18800, 26442, 34084, 41726, 49368, 57010 |
| anti-HIV-1_HeavyChain | 3517 | 11159, 18801, 26443, 34085, 41727, 49369, 57011 |
| anti-HIV-1_HeavyChain | 3518 | 11160, 18802, 26444, 34086, 41728, 49370, 57012 |
| anti-HIV-1_HeavyChain | 3519 | 11161, 18803, 26445, 34087, 41729, 49371, 57013 |
| anti-HIV-1_HeavyChain | 3520 | 11162, 18804, 26446, 34088, 41730, 49372, 57014 |
| anti-HIV-1_HeavyChain | 3521 | 11163, 18805, 26447, 34089, 41731, 49373, 57015 |
| anti-HIV-1_HeavyChain | 3522 | 11164, 18806, 26448, 34090, 41732, 49374, 57016 |
| anti-HIV-1_HeavyChain | 3523 | 11165, 18807, 26449, 34091, 41733, 49375, 57017 |
| anti-HIV-1_HeavyChain | 3524 | 11166, 18808, 26450, 34092, 41734, 49376, 57018 |
| anti-HIV-1_HeavyChain | 3525 | 11167, 18809, 26451, 34093, 41735, 49377, 57019 |
| anti-HIV-1_HeavyChain | 3526 | 11168, 18810, 26452, 34094, 41736, 49378, 57020 |
| anti-HIV-1_HeavyChain | 3527 | 11169, 18811, 26453, 34095, 41737, 49379, 57021 |
| anti-HIV-1_HeavyChain | 3528 | 11170, 18812, 26454, 34096, 41738, 49380, 57022 |
| anti-HIV-1_HeavyChain | 3529 | 11171, 18813, 26455, 34097, 41739, 49381, 57023 |
| anti-HIV-1_HeavyChain | 3530 | 11172, 18814, 26456, 34098, 41740, 49382, 57024 |
| anti-HIV-1_HeavyChain | 3531 | 11173, 18815, 26457, 34099, 41741, 49383, 57025 |
| anti-HIV-1_HeavyChain | 3532 | 11174, 18816, 26458, 34100, 41742, 49384, 57026 |
| anti-HIV-1_HeavyChain | 3533 | 11175, 18817, 26459, 34101, 41743, 49385, 57027 |
| anti-HIV-1_HeavyChain | 3534 | 11176, 18818, 26460, 34102, 41744, 49386, 57028 |
| anti-HIV-1_HeavyChain | 3535 | 11177, 18819, 26461, 34103, 41745, 49387, 57029 |
| anti-HIV-1_HeavyChain | 3536 | 11178, 18820, 26462, 34104, 41746, 49388, 57030 |
| anti-HIV-1_HeavyChain | 3537 | 11179, 18821, 26463, 34105, 41747, 49389, 57031 |
| anti-HIV-1_HeavyChain | 3538 | 11180, 18822, 26464, 34106, 41748, 49390, 57032 |
| anti-HIV-1_HeavyChain | 3539 | 11181, 18823, 26465, 34107, 41749, 49391, 57033 |
| anti-HIV-1_HeavyChain | 3540 | 11182, 18824, 26466, 34108, 41750, 49392, 57034 |
| anti-HIV-1_HeavyChain | 3541 | 11183, 18825, 26467, 34109, 41751, 49393, 57035 |
| anti-HIV-1_HeavyChain | 3542 | 11184, 18826, 26468, 34110, 41752, 49394, 57036 |
| anti-HIV-1_HeavyChain | 3543 | 11185, 18827, 26469, 34111, 41753, 49395, 57037 |
| anti-HIV-1_HeavyChain | 3544 | 11186, 18828, 26470, 34112, 41754, 49396, 57038 |
| anti-HIV-1_HeavyChain | 3545 | 11187, 18829, 26471, 34113, 41755, 49397, 57039 |
| anti-HIV-1_HeavyChain | 3546 | 11188, 18830, 26472, 34114, 41756, 49398, 57040 |
| anti-HIV-1_HeavyChain | 3547 | 11189, 18831, 26473, 34115, 41757, 49399, 57041 |
| anti-HIV-1_HeavyChain | 3548 | 11190, 18832, 26474, 34116, 41758, 49400, 57042 |
| anti-HIV-1_HeavyChain | 3549 | 11191, 18833, 26475, 34117, 41759, 49401, 57043 |
| anti-HIV-1_HeavyChain | 3550 | 11192, 18834, 26476, 34118, 41760, 49402, 57044 |
| anti-HIV-1_HeavyChain | 3551 | 11193, 18835, 26477, 34119, 41761, 49403, 57045 |
| anti-HIV-1_HeavyChain | 3552 | 11194, 18836, 26478, 34120, 41762, 49404, 57046 |
| anti-HIV-1_HeavyChain | 3553 | 11195, 18837, 26479, 34121, 41763, 49405, 57047 |
| anti-HIV-1_HeavyChain | 3554 | 11196, 18838, 26480, 34122, 41764, 49406, 57048 |
| anti-HIV-1_HeavyChain | 3555 | 11197, 18839, 26481, 34123, 41765, 49407, 57049 |
| anti-HIV-1_HeavyChain | 3556 | 11198, 18840, 26482, 34124, 41766, 49408, 57050 |
| anti-HIV-1_HeavyChain | 3557 | 11199, 18841, 26483, 34125, 41767, 49409, 57051 |
| anti-HIV-1_HeavyChain | 3558 | 11200, 18842, 26484, 34126, 41768, 49410, 57052 |
| anti-HIV-1_HeavyChain | 3559 | 11201, 18843, 26485, 34127, 41769, 49411, 57053 |
| anti-HIV-1_HeavyChain | 3560 | 11202, 18844, 26486, 34128, 41770, 49412, 57054 |
| anti-HIV-1_HeavyChain | 3561 | 11203, 18845, 26487, 34129, 41771, 49413, 57055 |
| anti-HIV-1_HeavyChain | 3562 | 11204, 18846, 26488, 34130, 41772, 49414, 57056 |
| anti-HIV-1_HeavyChain | 3563 | 11205, 18847, 26489, 34131, 41773, 49415, 57057 |
| anti-HIV-1_HeavyChain | 3564 | 11206, 18848, 26490, 34132, 41774, 49416, 57058 |
| anti-HIV-1_HeavyChain | 3565 | 11207, 18849, 26491, 34133, 41775, 49417, 57059 |
| anti-HIV-1_HeavyChain | 3566 | 11208, 18850, 26492, 34134, 41776, 49418, 57060 |
| anti-HIV-1_HeavyChain | 3567 | 11209, 18851, 26493, 34135, 41777, 49419, 57061 |
| anti-HIV-1_HeavyChain | 3568 | 11210, 18852, 26494, 34136, 41778, 49420, 57062 |

TABLE 3-continued

RNA and amino acid sequences of exemplified antibodies

| Name | Protein SEQ ID NO | RNA SEQ ID NO |
|---|---|---|
| anti-HIV-1_HeavyChain | 3569 | 11211, 18853, 26495, 34137, 41779, 49421, 57063 |
| anti-HIV-1_HeavyChain | 3570 | 11212, 18854, 26496, 34138, 41780, 49422, 57064 |
| anti-HIV-1_HeavyChain | 3571 | 11213, 18855, 26497, 34139, 41781, 49423, 57065 |
| anti-HIV-1_HeavyChain | 3572 | 11214, 18856, 26498, 34140, 41782, 49424, 57066 |
| anti-HIV-1_HeavyChain | 3573 | 11215, 18857, 26499, 34141, 41783, 49425, 57067 |
| anti-HIV-1_HeavyChain | 3574 | 11216, 18858, 26500, 34142, 41784, 49426, 57068 |
| anti-HIV-1_HeavyChain | 3575 | 11217, 18859, 26501, 34143, 41785, 49427, 57069 |
| anti-HIV-1_HeavyChain | 3576 | 11218, 18860, 26502, 34144, 41786, 49428, 57070 |
| anti-HIV-1_HeavyChain | 3577 | 11219, 18861, 26503, 34145, 41787, 49429, 57071 |
| anti-HIV-1_HeavyChain | 3578 | 11220, 18862, 26504, 34146, 41788, 49430, 57072 |
| anti-HIV-1_HeavyChain | 3579 | 11221, 18863, 26505, 34147, 41789, 49431, 57073 |
| anti-HIV-1_HeavyChain | 3580 | 11222, 18864, 26506, 34148, 41790, 49432, 57074 |
| anti-HIV-1_HeavyChain | 3581 | 11223, 18865, 26507, 34149, 41791, 49433, 57075 |
| anti-HIV-1_HeavyChain | 3582 | 11224, 18866, 26508, 34150, 41792, 49434, 57076 |
| anti-HIV-1_HeavyChain | 3583 | 11225, 18867, 26509, 34151, 41793, 49435, 57077 |
| anti-HIV-1_HeavyChain | 3584 | 11226, 18868, 26510, 34152, 41794, 49436, 57078 |
| anti-HIV-1_HeavyChain | 3585 | 11227, 18869, 26511, 34153, 41795, 49437, 57079 |
| anti-HIV-1_HeavyChain | 3586 | 11228, 18870, 26512, 34154, 41796, 49438, 57080 |
| anti-HIV-1_HeavyChain | 3587 | 11229, 18871, 26513, 34155, 41797, 49439, 57081 |
| anti-HIV-1_HeavyChain | 3588 | 11230, 18872, 26514, 34156, 41798, 49440, 57082 |
| anti-HIV-1_HeavyChain | 3589 | 11231, 18873, 26515, 34157, 41799, 49441, 57083 |
| anti-HIV-1_HeavyChain | 3590 | 11232, 18874, 26516, 34158, 41800, 49442, 57084 |
| anti-HIV-1_HeavyChain | 3591 | 11233, 18875, 26517, 34159, 41801, 49443, 57085 |
| anti-HIV-1_HeavyChain | 3592 | 11234, 18876, 26518, 34160, 41802, 49444, 57086 |
| anti-HIV-1_HeavyChain | 3593 | 11235, 18877, 26519, 34161, 41803, 49445, 57087 |
| anti-HIV-1_HeavyChain | 3594 | 11236, 18878, 26520, 34162, 41804, 49446, 57088 |
| anti-HIV-1_HeavyChain | 3595 | 11237, 18879, 26521, 34163, 41805, 49447, 57089 |
| anti-HIV-1_HeavyChain | 3596 | 11238, 18880, 26522, 34164, 41806, 49448, 57090 |
| anti-HIV-1_HeavyChain | 3597 | 11239, 18881, 26523, 34165, 41807, 49449, 57091 |
| anti-HIV-1_HeavyChain | 3598 | 11240, 18882, 26524, 34166, 41808, 49450, 57092 |
| anti-HIV-1_HeavyChain | 3599 | 11241, 18883, 26525, 34167, 41809, 49451, 57093 |
| anti-HIV-1_HeavyChain | 3600 | 11242, 18884, 26526, 34168, 41810, 49452, 57094 |
| anti-HIV-1_HeavyChain | 3601 | 11243, 18885, 26527, 34169, 41811, 49453, 57095 |
| anti-HIV-1_HeavyChain | 3602 | 11244, 18886, 26528, 34170, 41812, 49454, 57096 |
| anti-HIV-1_HeavyChain | 3603 | 11245, 18887, 26529, 34171, 41813, 49455, 57097 |
| anti-HIV-1_HeavyChain | 3604 | 11246, 18888, 26530, 34172, 41814, 49456, 57098 |
| anti-HIV-1_HeavyChain | 3605 | 11247, 18889, 26531, 34173, 41815, 49457, 57099 |
| anti-HIV-1_HeavyChain | 3606 | 11248, 18890, 26532, 34174, 41816, 49458, 57100 |
| anti-HIV-1_HeavyChain | 3607 | 11249, 18891, 26533, 34175, 41817, 49459, 57101 |
| anti-HIV-1_HeavyChain | 3608 | 11250, 18892, 26534, 34176, 41818, 49460, 57102 |
| anti-HIV-1_HeavyChain | 3609 | 11251, 18893, 26535, 34177, 41819, 49461, 57103 |
| anti-HIV-1_HeavyChain | 3610 | 11252, 18894, 26536, 34178, 41820, 49462, 57104 |
| anti-HIV-1_HeavyChain | 3611 | 11253, 18895, 26537, 34179, 41821, 49463, 57105 |
| anti-HIV-1_HeavyChain | 3612 | 11254, 18896, 26538, 34180, 41822, 49464, 57106 |
| anti-HIV-1_HeavyChain | 3613 | 11255, 18897, 26539, 34181, 41823, 49465, 57107 |
| anti-HIV-1_HeavyChain | 3614 | 11256, 18898, 26540, 34182, 41824, 49466, 57108 |
| anti-HIV-1_HeavyChain | 3615 | 11257, 18899, 26541, 34183, 41825, 49467, 57109 |
| anti-HIV-1_HeavyChain | 3616 | 11258, 18900, 26542, 34184, 41826, 49468, 57110 |
| anti-HIV-1_HeavyChain | 3617 | 11259, 18901, 26543, 34185, 41827, 49469, 57111 |
| anti-HIV-1_HeavyChain | 3618 | 11260, 18902, 26544, 34186, 41828, 49470, 57112 |
| anti-HIV-1_HeavyChain | 3619 | 11261, 18903, 26545, 34187, 41829, 49471, 57113 |
| anti-HIV-1_HeavyChain | 3620 | 11262, 18904, 26546, 34188, 41830, 49472, 57114 |
| anti-HIV-1_HeavyChain | 3621 | 11263, 18905, 26547, 34189, 41831, 49473, 57115 |
| anti-HIV-1_HeavyChain | 3622 | 11264, 18906, 26548, 34190, 41832, 49474, 57116 |
| anti-HIV-1_HeavyChain | 3623 | 11265, 18907, 26549, 34191, 41833, 49475, 57117 |
| anti-HIV-1_HeavyChain | 3624 | 11266, 18908, 26550, 34192, 41834, 49476, 57118 |
| anti-HIV-1_HeavyChain | 3625 | 11267, 18909, 26551, 34193, 41835, 49477, 57119 |
| anti-HIV-1_HeavyChain | 3626 | 11268, 18910, 26552, 34194, 41836, 49478, 57120 |
| anti-HIV-1_HeavyChain | 3627 | 11269, 18911, 26553, 34195, 41837, 49479, 57121 |
| anti-HIV-1_HeavyChain | 3628 | 11270, 18912, 26554, 34196, 41838, 49480, 57122 |
| anti-HIV-1_HeavyChain | 3629 | 11271, 18913, 26555, 34197, 41839, 49481, 57123 |
| anti-HIV-1_HeavyChain | 3630 | 11272, 18914, 26556, 34198, 41840, 49482, 57124 |
| anti-HIV-1_HeavyChain | 3631 | 11273, 18915, 26557, 34199, 41841, 49483, 57125 |
| anti-HIV-1_HeavyChain | 3632 | 11274, 18916, 26558, 34200, 41842, 49484, 57126 |
| anti-HIV-1_HeavyChain | 3633 | 11275, 18917, 26559, 34201, 41843, 49485, 57127 |
| anti-HIV-1_HeavyChain | 3634 | 11276, 18918, 26560, 34202, 41844, 49486, 57128 |
| anti-HIV-1_HeavyChain | 3635 | 11277, 18919, 26561, 34203, 41845, 49487, 57129 |
| anti-HIV-1_HeavyChain | 3636 | 11278, 18920, 26562, 34204, 41846, 49488, 57130 |
| anti-HIV-1_HeavyChain | 3637 | 11279, 18921, 26563, 34205, 41847, 49489, 57131 |
| anti-HIV-1_HeavyChain | 3638 | 11280, 18922, 26564, 34206, 41848, 49490, 57132 |
| anti-HIV-1_HeavyChain | 3639 | 11281, 18923, 26565, 34207, 41849, 49491, 57133 |
| anti-HIV-1_HeavyChain | 3640 | 11282, 18924, 26566, 34208, 41850, 49492, 57134 |
| anti-HIV-1_HeavyChain | 3641 | 11283, 18925, 26567, 34209, 41851, 49493, 57135 |
| anti-HIV-1_HeavyChain | 3642 | 11284, 18926, 26568, 34210, 41852, 49494, 57136 |
| anti-HIV-1_HeavyChain | 3643 | 11285, 18927, 26569, 34211, 41853, 49495, 57137 |
| anti-HIV-1_HeavyChain | 3644 | 11286, 18928, 26570, 34212, 41854, 49496, 57138 |

TABLE 3-continued

RNA and amino acid sequences of exemplified antibodies

| Name | Protein SEQ ID NO | RNA SEQ ID NO |
|---|---|---|
| anti-HIV-1_HeavyChain | 3645 | 11287, 18929, 26571, 34213, 41855, 49497, 57139 |
| anti-HIV-1_HeavyChain | 3646 | 11288, 18930, 26572, 34214, 41856, 49498, 57140 |
| anti-HIV-1_HeavyChain | 3647 | 11289, 18931, 26573, 34215, 41857, 49499, 57141 |
| anti-HIV-1_HeavyChain | 3648 | 11290, 18932, 26574, 34216, 41858, 49500, 57142 |
| anti-HIV-1_HeavyChain | 3649 | 11291, 18933, 26575, 34217, 41859, 49501, 57143 |
| anti-HIV-1_HeavyChain | 3650 | 11292, 18934, 26576, 34218, 41860, 49502, 57144 |
| anti-HIV-1_HeavyChain | 3651 | 11293, 18935, 26577, 34219, 41861, 49503, 57145 |
| anti-HIV-1_HeavyChain | 3652 | 11294, 18936, 26578, 34220, 41862, 49504, 57146 |
| anti-HIV-1_HeavyChain | 3653 | 11295, 18937, 26579, 34221, 41863, 49505, 57147 |
| anti-HIV-1_HeavyChain | 3654 | 11296, 18938, 26580, 34222, 41864, 49506, 57148 |
| anti-HIV-1_HeavyChain | 3655 | 11297, 18939, 26581, 34223, 41865, 49507, 57149 |
| anti-HIV-1_HeavyChain | 3656 | 11298, 18940, 26582, 34224, 41866, 49508, 57150 |
| anti-HIV-1_HeavyChain | 3657 | 11299, 18941, 26583, 34225, 41867, 49509, 57151 |
| anti-HIV-1_HeavyChain | 3658 | 11300, 18942, 26584, 34226, 41868, 49510, 57152 |
| anti-HIV-1_HeavyChain | 3659 | 11301, 18943, 26585, 34227, 41869, 49511, 57153 |
| anti-HIV-1_HeavyChain | 3660 | 11302, 18944, 26586, 34228, 41870, 49512, 57154 |
| anti-HIV-1_HeavyChain | 3661 | 11303, 18945, 26587, 34229, 41871, 49513, 57155 |
| anti-HIV-1_HeavyChain | 3662 | 11304, 18946, 26588, 34230, 41872, 49514, 57156 |
| anti-HIV-1_HeavyChain | 3663 | 11305, 18947, 26589, 34231, 41873, 49515, 57157 |
| anti-HIV-1_HeavyChain | 3664 | 11306, 18948, 26590, 34232, 41874, 49516, 57158 |
| anti-HIV-1_HeavyChain | 3665 | 11307, 18949, 26591, 34233, 41875, 49517, 57159 |
| anti-HIV-1_HeavyChain | 3666 | 11308, 18950, 26592, 34234, 41876, 49518, 57160 |
| anti-HIV-1_HeavyChain | 3667 | 11309, 18951, 26593, 34235, 41877, 49519, 57161 |
| anti-HIV-1_HeavyChain | 3668 | 11310, 18952, 26594, 34236, 41878, 49520, 57162 |
| anti-HIV-1_HeavyChain | 3669 | 11311, 18953, 26595, 34237, 41879, 49521, 57163 |
| anti-HIV-1_HeavyChain | 3670 | 11312, 18954, 26596, 34238, 41880, 49522, 57164 |
| anti-HIV-1_HeavyChain | 3671 | 11313, 18955, 26597, 34239, 41881, 49523, 57165 |
| anti-HIV-1_HeavyChain | 3672 | 11314, 18956, 26598, 34240, 41882, 49524, 57166 |
| anti-HIV-1_HeavyChain | 3673 | 11315, 18957, 26599, 34241, 41883, 49525, 57167 |
| anti-HIV-1_HeavyChain | 3674 | 11316, 18958, 26600, 34242, 41884, 49526, 57168 |
| anti-HIV-1_HeavyChain | 3675 | 11317, 18959, 26601, 34243, 41885, 49527, 57169 |
| anti-HIV-1_HeavyChain | 3676 | 11318, 18960, 26602, 34244, 41886, 49528, 57170 |
| anti-HIV-1_HeavyChain | 3677 | 11319, 18961, 26603, 34245, 41887, 49529, 57171 |
| anti-HIV-1_HeavyChain | 3678 | 11320, 18962, 26604, 34246, 41888, 49530, 57172 |
| anti-HIV-1_HeavyChain | 3679 | 11321, 18963, 26605, 34247, 41889, 49531, 57173 |
| anti-HIV-1_HeavyChain | 3680 | 11322, 18964, 26606, 34248, 41890, 49532, 57174 |
| anti-HIV-1_HeavyChain | 3681 | 11323, 18965, 26607, 34249, 41891, 49533, 57175 |
| anti-HIV-1_HeavyChain | 3682 | 11324, 18966, 26608, 34250, 41892, 49534, 57176 |
| anti-HIV-1_HeavyChain | 3683 | 11325, 18967, 26609, 34251, 41893, 49535, 57177 |
| anti-HIV-1_HeavyChain | 3684 | 11326, 18968, 26610, 34252, 41894, 49536, 57178 |
| anti-HIV-1_HeavyChain | 3685 | 11327, 18969, 26611, 34253, 41895, 49537, 57179 |
| anti-HIV-1_HeavyChain | 3686 | 11328, 18970, 26612, 34254, 41896, 49538, 57180 |
| anti-HIV-1_HeavyChain | 3687 | 11329, 18971, 26613, 34255, 41897, 49539, 57181 |
| anti-HIV-1_HeavyChain | 3688 | 11330, 18972, 26614, 34256, 41898, 49540, 57182 |
| anti-HIV-1_HeavyChain | 3689 | 11331, 18973, 26615, 34257, 41899, 49541, 57183 |
| anti-HIV-1_HeavyChain | 3690 | 11332, 18974, 26616, 34258, 41900, 49542, 57184 |
| anti-HIV-1_HeavyChain | 3691 | 11333, 18975, 26617, 34259, 41901, 49543, 57185 |
| anti-HIV-1_HeavyChain | 3692 | 11334, 18976, 26618, 34260, 41902, 49544, 57186 |
| anti-HIV-1_HeavyChain | 3693 | 11335, 18977, 26619, 34261, 41903, 49545, 57187 |
| anti-HIV-1_HeavyChain | 3694 | 11336, 18978, 26620, 34262, 41904, 49546, 57188 |
| anti-HIV-1_HeavyChain | 3695 | 11337, 18979, 26621, 34263, 41905, 49547, 57189 |
| anti-HIV-1_HeavyChain | 3696 | 11338, 18980, 26622, 34264, 41906, 49548, 57190 |
| anti-HIV-1_HeavyChain | 3697 | 11339, 18981, 26623, 34265, 41907, 49549, 57191 |
| anti-HIV-1_HeavyChain | 3698 | 11340, 18982, 26624, 34266, 41908, 49550, 57192 |
| anti-HIV-1_HeavyChain | 3699 | 11341, 18983, 26625, 34267, 41909, 49551, 57193 |
| anti-HIV-1_HeavyChain | 3700 | 11342, 18984, 26626, 34268, 41910, 49552, 57194 |
| anti-HIV-1_HeavyChain | 3701 | 11343, 18985, 26627, 34269, 41911, 49553, 57195 |
| anti-HIV-1_HeavyChain | 3702 | 11344, 18986, 26628, 34270, 41912, 49554, 57196 |
| anti-HIV-1_HeavyChain | 3703 | 11345, 18987, 26629, 34271, 41913, 49555, 57197 |
| anti-HIV-1_HeavyChain | 3704 | 11346, 18988, 26630, 34272, 41914, 49556, 57198 |
| anti-HIV-1_HeavyChain | 3705 | 11347, 18989, 26631, 34273, 41915, 49557, 57199 |
| anti-HIV-1_HeavyChain | 3706 | 11348, 18990, 26632, 34274, 41916, 49558, 57200 |
| anti-HIV-1_HeavyChain | 3707 | 11349, 18991, 26633, 34275, 41917, 49559, 57201 |
| anti-HIV-1_HeavyChain | 3708 | 11350, 18992, 26634, 34276, 41918, 49560, 57202 |
| anti-HIV-1_HeavyChain | 3709 | 11351, 18993, 26635, 34277, 41919, 49561, 57203 |
| anti-HIV-1_HeavyChain | 3710 | 11352, 18994, 26636, 34278, 41920, 49562, 57204 |
| anti-HIV-1_HeavyChain | 3711 | 11353, 18995, 26637, 34279, 41921, 49563, 57205 |
| anti-HIV-1_HeavyChain | 3712 | 11354, 18996, 26638, 34280, 41922, 49564, 57206 |
| anti-HIV-1_HeavyChain | 3713 | 11355, 18997, 26639, 34281, 41923, 49565, 57207 |
| anti-HIV-1_HeavyChain | 3714 | 11356, 18998, 26640, 34282, 41924, 49566, 57208 |
| anti-HIV-1_HeavyChain | 3715 | 11357, 18999, 26641, 34283, 41925, 49567, 57209 |
| anti-HIV-1_HeavyChain | 3716 | 11358, 19000, 26642, 34284, 41926, 49568, 57210 |
| anti-HIV-1_HeavyChain | 3717 | 11359, 19001, 26643, 34285, 41927, 49569, 57211 |
| anti-HIV-1_HeavyChain | 3718 | 11360, 19002, 26644, 34286, 41928, 49570, 57212 |
| anti-HIV-1_HeavyChain | 3719 | 11361, 19003, 26645, 34287, 41929, 49571, 57213 |
| anti-HIV-1_HeavyChain | 3720 | 11362, 19004, 26646, 34288, 41930, 49572, 57214 |

TABLE 3-continued

RNA and amino acid sequences of exemplified antibodies

| Name | Protein SEQ ID NO | RNA SEQ ID NO |
|---|---|---|
| anti-HIV-1_HeavyChain | 3721 | 11363, 19005, 26647, 34289, 41931, 49573, 57215 |
| anti-HIV-1_HeavyChain | 3722 | 11364, 19006, 26648, 34290, 41932, 49574, 57216 |
| anti-HIV-1_HeavyChain | 3723 | 11365, 19007, 26649, 34291, 41933, 49575, 57217 |
| anti-HIV-1_HeavyChain | 3724 | 11366, 19008, 26650, 34292, 41934, 49576, 57218 |
| anti-HIV-1_HeavyChain | 3725 | 11367, 19009, 26651, 34293, 41935, 49577, 57219 |
| anti-HIV-1_HeavyChain | 3726 | 11368, 19010, 26652, 34294, 41936, 49578, 57220 |
| anti-HIV-1_HeavyChain | 3727 | 11369, 19011, 26653, 34295, 41937, 49579, 57221 |
| anti-HIV-1_HeavyChain | 3728 | 11370, 19012, 26654, 34296, 41938, 49580, 57222 |
| anti-HIV-1_HeavyChain | 3729 | 11371, 19013, 26655, 34297, 41939, 49581, 57223 |
| anti-HIV-1_HeavyChain | 3730 | 11372, 19014, 26656, 34298, 41940, 49582, 57224 |
| anti-HIV-1_HeavyChain | 3731 | 11373, 19015, 26657, 34299, 41941, 49583, 57225 |
| anti-HIV-1_HeavyChain | 3732 | 11374, 19016, 26658, 34300, 41942, 49584, 57226 |
| anti-HIV-1_HeavyChain | 3733 | 11375, 19017, 26659, 34301, 41943, 49585, 57227 |
| anti-HIV-1_HeavyChain | 3734 | 11376, 19018, 26660, 34302, 41944, 49586, 57228 |
| anti-HIV-1_HeavyChain | 3735 | 11377, 19019, 26661, 34303, 41945, 49587, 57229 |
| anti-HIV-1_HeavyChain | 3736 | 11378, 19020, 26662, 34304, 41946, 49588, 57230 |
| anti-HIV-1_HeavyChain | 3737 | 11379, 19021, 26663, 34305, 41947, 49589, 57231 |
| anti-HIV-1_HeavyChain | 3738 | 11380, 19022, 26664, 34306, 41948, 49590, 57232 |
| anti-HIV-1_HeavyChain | 3739 | 11381, 19023, 26665, 34307, 41949, 49591, 57233 |
| anti-HIV-1_HeavyChain | 3740 | 11382, 19024, 26666, 34308, 41950, 49592, 57234 |
| anti-HIV-1_HeavyChain | 3741 | 11383, 19025, 26667, 34309, 41951, 49593, 57235 |
| anti-HIV-1_HeavyChain | 3742 | 11384, 19026, 26668, 34310, 41952, 49594, 57236 |
| anti-HIV-1_HeavyChain | 3743 | 11385, 19027, 26669, 34311, 41953, 49595, 57237 |
| anti-HIV-1_HeavyChain | 3744 | 11386, 19028, 26670, 34312, 41954, 49596, 57238 |
| anti-HIV-1_HeavyChain | 3745 | 11387, 19029, 26671, 34313, 41955, 49597, 57239 |
| anti-HIV-1_HeavyChain | 3746 | 11388, 19030, 26672, 34314, 41956, 49598, 57240 |
| anti-HIV-1_HeavyChain | 3747 | 11389, 19031, 26673, 34315, 41957, 49599, 57241 |
| anti-HIV-1_HeavyChain | 3748 | 11390, 19032, 26674, 34316, 41958, 49600, 57242 |
| anti-HIV-1_HeavyChain | 3749 | 11391, 19033, 26675, 34317, 41959, 49601, 57243 |
| anti-HIV-1_HeavyChain | 3750 | 11392, 19034, 26676, 34318, 41960, 49602, 57244 |
| anti-HIV-1_HeavyChain | 3751 | 11393, 19035, 26677, 34319, 41961, 49603, 57245 |
| anti-HIV-1_HeavyChain | 3752 | 11394, 19036, 26678, 34320, 41962, 49604, 57246 |
| anti-HIV-1_HeavyChain | 3753 | 11395, 19037, 26679, 34321, 41963, 49605, 57247 |
| anti-HIV-1_HeavyChain | 3754 | 11396, 19038, 26680, 34322, 41964, 49606, 57248 |
| anti-HIV-1_HeavyChain | 3755 | 11397, 19039, 26681, 34323, 41965, 49607, 57249 |
| anti-HIV-1_HeavyChain | 3756 | 11398, 19040, 26682, 34324, 41966, 49608, 57250 |
| anti-HIV-1_HeavyChain | 3757 | 11399, 19041, 26683, 34325, 41967, 49609, 57251 |
| anti-HIV-1_HeavyChain | 3758 | 11400, 19042, 26684, 34326, 41968, 49610, 57252 |
| anti-HIV-1_HeavyChain | 3759 | 11401, 19043, 26685, 34327, 41969, 49611, 57253 |
| anti-HIV-1_HeavyChain | 3760 | 11402, 19044, 26686, 34328, 41970, 49612, 57254 |
| anti-HIV-1_HeavyChain | 3761 | 11403, 19045, 26687, 34329, 41971, 49613, 57255 |
| anti-HIV-1_HeavyChain | 3762 | 11404, 19046, 26688, 34330, 41972, 49614, 57256 |
| anti-HIV-1_HeavyChain | 3763 | 11405, 19047, 26689, 34331, 41973, 49615, 57257 |
| anti-HIV-1_HeavyChain | 3764 | 11406, 19048, 26690, 34332, 41974, 49616, 57258 |
| anti-HIV-1_HeavyChain | 3765 | 11407, 19049, 26691, 34333, 41975, 49617, 57259 |
| anti-HIV-1_HeavyChain | 3766 | 11408, 19050, 26692, 34334, 41976, 49618, 57260 |
| anti-HIV-1_HeavyChain | 3767 | 11409, 19051, 26693, 34335, 41977, 49619, 57261 |
| anti-HIV-1_HeavyChain | 3768 | 11410, 19052, 26694, 34336, 41978, 49620, 57262 |
| anti-HIV-1_HeavyChain | 3769 | 11411, 19053, 26695, 34337, 41979, 49621, 57263 |
| anti-HIV-1_HeavyChain | 3770 | 11412, 19054, 26696, 34338, 41980, 49622, 57264 |
| anti-HIV-1_HeavyChain | 3771 | 11413, 19055, 26697, 34339, 41981, 49623, 57265 |
| anti-HIV-1_HeavyChain | 3772 | 11414, 19056, 26698, 34340, 41982, 49624, 57266 |
| anti-HIV-1_HeavyChain | 3773 | 11415, 19057, 26699, 34341, 41983, 49625, 57267 |
| anti-HIV-1_HeavyChain | 3774 | 11416, 19058, 26700, 34342, 41984, 49626, 57268 |
| anti-HIV-1_HeavyChain | 3775 | 11417, 19059, 26701, 34343, 41985, 49627, 57269 |
| anti-HIV-1_HeavyChain | 3776 | 11418, 19060, 26702, 34344, 41986, 49628, 57270 |
| anti-HIV-1_HeavyChain | 3777 | 11419, 19061, 26703, 34345, 41987, 49629, 57271 |
| anti-HIV-1_HeavyChain | 3778 | 11420, 19062, 26704, 34346, 41988, 49630, 57272 |
| anti-HIV-1_HeavyChain | 3779 | 11421, 19063, 26705, 34347, 41989, 49631, 57273 |
| anti-HIV-1_HeavyChain | 3780 | 11422, 19064, 26706, 34348, 41990, 49632, 57274 |
| anti-HIV-1_HeavyChain | 3781 | 11423, 19065, 26707, 34349, 41991, 49633, 57275 |
| anti-HIV-1_HeavyChain | 3782 | 11424, 19066, 26708, 34350, 41992, 49634, 57276 |
| anti-HIV-1_HeavyChain | 3783 | 11425, 19067, 26709, 34351, 41993, 49635, 57277 |
| anti-HIV-1_HeavyChain | 3784 | 11426, 19068, 26710, 34352, 41994, 49636, 57278 |
| anti-HIV-1_HeavyChain | 3785 | 11427, 19069, 26711, 34353, 41995, 49637, 57279 |
| anti-HIV-1_HeavyChain | 3786 | 11428, 19070, 26712, 34354, 41996, 49638, 57280 |
| anti-HIV-1_HeavyChain | 3787 | 11429, 19071, 26713, 34355, 41997, 49639, 57281 |
| anti-HIV-1_HeavyChain | 3788 | 11430, 19072, 26714, 34356, 41998, 49640, 57282 |
| anti-HIV-1_HeavyChain | 3789 | 11431, 19073, 26715, 34357, 41999, 49641, 57283 |
| anti-HIV-1_HeavyChain | 3790 | 11432, 19074, 26716, 34358, 42000, 49642, 57284 |
| anti-HIV-1_HeavyChain | 3791 | 11433, 19075, 26717, 34359, 42001, 49643, 57285 |
| anti-HIV-1_HeavyChain | 3792 | 11434, 19076, 26718, 34360, 42002, 49644, 57286 |
| anti-HIV-1_HeavyChain | 3793 | 11435, 19077, 26719, 34361, 42003, 49645, 57287 |
| anti-HIV-1_HeavyChain | 3794 | 11436, 19078, 26720, 34362, 42004, 49646, 57288 |
| anti-HIV-1_HeavyChain | 3795 | 11437, 19079, 26721, 34363, 42005, 49647, 57289 |
| anti-HIV-1_HeavyChain | 3796 | 11438, 19080, 26722, 34364, 42006, 49648, 57290 |

TABLE 3-continued

RNA and amino acid sequences of exemplified antibodies

| Name | Protein SEQ ID NO | RNA SEQ ID NO |
| --- | --- | --- |
| anti-HIV-1_HeavyChain | 3797 | 11439, 19081, 26723, 34365, 42007, 49649, 57291 |
| anti-HIV-1_HeavyChain | 3798 | 11440, 19082, 26724, 34366, 42008, 49650, 57292 |
| anti-HIV-1_HeavyChain | 3799 | 11441, 19083, 26725, 34367, 42009, 49651, 57293 |
| anti-HIV-1_HeavyChain | 3800 | 11442, 19084, 26726, 34368, 42010, 49652, 57294 |
| anti-HIV-1_HeavyChain | 3801 | 11443, 19085, 26727, 34369, 42011, 49653, 57295 |
| anti-HIV-1_HeavyChain | 3802 | 11444, 19086, 26728, 34370, 42012, 49654, 57296 |
| anti-HIV-1_HeavyChain | 3803 | 11445, 19087, 26729, 34371, 42013, 49655, 57297 |
| anti-HIV-1_HeavyChain | 3804 | 11446, 19088, 26730, 34372, 42014, 49656, 57298 |
| anti-HIV-1_HeavyChain | 3805 | 11447, 19089, 26731, 34373, 42015, 49657, 57299 |
| anti-HIV-1_HeavyChain | 3806 | 11448, 19090, 26732, 34374, 42016, 49658, 57300 |
| anti-HIV-1_HeavyChain | 3807 | 11449, 19091, 26733, 34375, 42017, 49659, 57301 |
| anti-HIV-1_HeavyChain | 3808 | 11450, 19092, 26734, 34376, 42018, 49660, 57302 |
| anti-HIV-1_HeavyChain | 3809 | 11451, 19093, 26735, 34377, 42019, 49661, 57303 |
| anti-HIV-1_HeavyChain | 3810 | 11452, 19094, 26736, 34378, 42020, 49662, 57304 |
| anti-HIV-1_HeavyChain | 3811 | 11453, 19095, 26737, 34379, 42021, 49663, 57305 |
| anti-HIV-1_HeavyChain | 3812 | 11454, 19096, 26738, 34380, 42022, 49664, 57306 |
| anti-HIV-1_HeavyChain | 3813 | 11455, 19097, 26739, 34381, 42023, 49665, 57307 |
| anti-HIV-1_HeavyChain | 3814 | 11456, 19098, 26740, 34382, 42024, 49666, 57308 |
| anti-HIV-1_HeavyChain | 3815 | 11457, 19099, 26741, 34383, 42025, 49667, 57309 |
| anti-HIV-1_HeavyChain | 3816 | 11458, 19100, 26742, 34384, 42026, 49668, 57310 |
| anti-HIV-1_HeavyChain | 3817 | 11459, 19101, 26743, 34385, 42027, 49669, 57311 |
| anti-HIV-1_HeavyChain | 3818 | 11460, 19102, 26744, 34386, 42028, 49670, 57312 |
| anti-HIV-1_HeavyChain | 3819 | 11461, 19103, 26745, 34387, 42029, 49671, 57313 |
| anti-HIV-1_HeavyChain | 3820 | 11462, 19104, 26746, 34388, 42030, 49672, 57314 |
| anti-HIV-1_HeavyChain | 3821 | 11463, 19105, 26747, 34389, 42031, 49673, 57315 |
| anti-HIV-1_HeavyChain | 3822 | 11464, 19106, 26748, 34390, 42032, 49674, 57316 |
| anti-HIV-1_HeavyChain | 3823 | 11465, 19107, 26749, 34391, 42033, 49675, 57317 |
| anti-HIV-1_HeavyChain | 3824 | 11466, 19108, 26750, 34392, 42034, 49676, 57318 |
| anti-HIV-1_HeavyChain | 3825 | 11467, 19109, 26751, 34393, 42035, 49677, 57319 |
| anti-HIV-1_HeavyChain | 3826 | 11468, 19110, 26752, 34394, 42036, 49678, 57320 |
| anti-HIV-1_HeavyChain | 3827 | 11469, 19111, 26753, 34395, 42037, 49679, 57321 |
| anti-HIV-1_HeavyChain | 3828 | 11470, 19112, 26754, 34396, 42038, 49680, 57322 |
| anti-HIV-1_HeavyChain | 3829 | 11471, 19113, 26755, 34397, 42039, 49681, 57323 |
| anti-HIV-1_HeavyChain | 3830 | 11472, 19114, 26756, 34398, 42040, 49682, 57324 |
| anti-HIV-1_HeavyChain | 3831 | 11473, 19115, 26757, 34399, 42041, 49683, 57325 |
| anti-HIV-1_HeavyChain | 3832 | 11474, 19116, 26758, 34400, 42042, 49684, 57326 |
| anti-HIV-1_HeavyChain | 3833 | 11475, 19117, 26759, 34401, 42043, 49685, 57327 |
| anti-HIV-1_HeavyChain | 3834 | 11476, 19118, 26760, 34402, 42044, 49686, 57328 |
| anti-HIV-1_HeavyChain | 3835 | 11477, 19119, 26761, 34403, 42045, 49687, 57329 |
| anti-HIV-1_HeavyChain | 3836 | 11478, 19120, 26762, 34404, 42046, 49688, 57330 |
| anti-HIV-1_HeavyChain | 3837 | 11479, 19121, 26763, 34405, 42047, 49689, 57331 |
| anti-HIV-1_HeavyChain | 3838 | 11480, 19122, 26764, 34406, 42048, 49690, 57332 |
| anti-HIV-1_HeavyChain | 3839 | 11481, 19123, 26765, 34407, 42049, 49691, 57333 |
| anti-HIV-1_HeavyChain | 3840 | 11482, 19124, 26766, 34408, 42050, 49692, 57334 |
| anti-HIV-1_HeavyChain | 3841 | 11483, 19125, 26767, 34409, 42051, 49693, 57335 |
| anti-HIV-1_HeavyChain | 3842 | 11484, 19126, 26768, 34410, 42052, 49694, 57336 |
| anti-HIV-1_HeavyChain | 3843 | 11485, 19127, 26769, 34411, 42053, 49695, 57337 |
| anti-HIV-1_HeavyChain | 3844 | 11486, 19128, 26770, 34412, 42054, 49696, 57338 |
| anti-HIV-1_HeavyChain | 3845 | 11487, 19129, 26771, 34413, 42055, 49697, 57339 |
| anti-HIV-1_HeavyChain | 3846 | 11488, 19130, 26772, 34414, 42056, 49698, 57340 |
| anti-HIV-1_HeavyChain | 3847 | 11489, 19131, 26773, 34415, 42057, 49699, 57341 |
| anti-HIV-1_HeavyChain | 3848 | 11490, 19132, 26774, 34416, 42058, 49700, 57342 |
| anti-HIV-1_HeavyChain | 3849 | 11491, 19133, 26775, 34417, 42059, 49701, 57343 |
| anti-HIV-1_HeavyChain | 3850 | 11492, 19134, 26776, 34418, 42060, 49702, 57344 |
| anti-HIV-1_HeavyChain | 3851 | 11493, 19135, 26777, 34419, 42061, 49703, 57345 |
| anti-HIV-1_HeavyChain | 3852 | 11494, 19136, 26778, 34420, 42062, 49704, 57346 |
| anti-HIV-1_HeavyChain | 3853 | 11495, 19137, 26779, 34421, 42063, 49705, 57347 |
| anti-HIV-1_HeavyChain | 3854 | 11496, 19138, 26780, 34422, 42064, 49706, 57348 |
| anti-HIV-1_HeavyChain | 3855 | 11497, 19139, 26781, 34423, 42065, 49707, 57349 |
| anti-HIV-1_HeavyChain | 3856 | 11498, 19140, 26782, 34424, 42066, 49708, 57350 |
| anti-HIV-1_HeavyChain | 3857 | 11499, 19141, 26783, 34425, 42067, 49709, 57351 |
| anti-HIV-1_HeavyChain | 3858 | 11500, 19142, 26784, 34426, 42068, 49710, 57352 |
| anti-HIV-1_HeavyChain | 3859 | 11501, 19143, 26785, 34427, 42069, 49711, 57353 |
| anti-HIV-1_HeavyChain | 3860 | 11502, 19144, 26786, 34428, 42070, 49712, 57354 |
| anti-HIV-1_HeavyChain | 3861 | 11503, 19145, 26787, 34429, 42071, 49713, 57355 |
| anti-HIV-1_HeavyChain | 3862 | 11504, 19146, 26788, 34430, 42072, 49714, 57356 |
| anti-HIV-1_HeavyChain | 3863 | 11505, 19147, 26789, 34431, 42073, 49715, 57357 |
| anti-HIV-1_HeavyChain | 3864 | 11506, 19148, 26790, 34432, 42074, 49716, 57358 |
| anti-HIV-1_HeavyChain | 3865 | 11507, 19149, 26791, 34433, 42075, 49717, 57359 |
| anti-HIV-1_HeavyChain | 3866 | 11508, 19150, 26792, 34434, 42076, 49718, 57360 |
| anti-HIV-1_HeavyChain | 3867 | 11509, 19151, 26793, 34435, 42077, 49719, 57361 |
| anti-HIV-1_HeavyChain | 3868 | 11510, 19152, 26794, 34436, 42078, 49720, 57362 |
| anti-HIV-1_HeavyChain | 3869 | 11511, 19153, 26795, 34437, 42079, 49721, 57363 |
| anti-HIV-1_HeavyChain | 3870 | 11512, 19154, 26796, 34438, 42080, 49722, 57364 |
| anti-HIV-1_HeavyChain | 3871 | 11513, 19155, 26797, 34439, 42081, 49723, 57365 |
| anti-HIV-1_HeavyChain | 3872 | 11514, 19156, 26798, 34440, 42082, 49724, 57366 |

TABLE 3-continued

RNA and amino acid sequences of exemplified antibodies

| Name | Protein SEQ ID NO | RNA SEQ ID NO |
|---|---|---|
| anti-HIV-1_HeavyChain | 3873 | 11515, 19157, 26799, 34441, 42083, 49725, 57367 |
| anti-HIV-1_HeavyChain | 3874 | 11516, 19158, 26800, 34442, 42084, 49726, 57368 |
| anti-HIV-1_HeavyChain | 3875 | 11517, 19159, 26801, 34443, 42085, 49727, 57369 |
| anti-HIV-1_HeavyChain | 3876 | 11518, 19160, 26802, 34444, 42086, 49728, 57370 |
| anti-HIV-1_HeavyChain | 3877 | 11519, 19161, 26803, 34445, 42087, 49729, 57371 |
| anti-HIV-1_HeavyChain | 3878 | 11520, 19162, 26804, 34446, 42088, 49730, 57372 |
| anti-HIV-1_HeavyChain | 3879 | 11521, 19163, 26805, 34447, 42089, 49731, 57373 |
| anti-HIV-1_HeavyChain | 3880 | 11522, 19164, 26806, 34448, 42090, 49732, 57374 |
| anti-HIV-1_HeavyChain | 3881 | 11523, 19165, 26807, 34449, 42091, 49733, 57375 |
| anti-HIV-1_HeavyChain | 3882 | 11524, 19166, 26808, 34450, 42092, 49734, 57376 |
| anti-HIV-1_HeavyChain | 3883 | 11525, 19167, 26809, 34451, 42093, 49735, 57377 |
| anti-HIV-1_HeavyChain | 3884 | 11526, 19168, 26810, 34452, 42094, 49736, 57378 |
| anti-HIV-1_HeavyChain | 3885 | 11527, 19169, 26811, 34453, 42095, 49737, 57379 |
| anti-HIV-1_HeavyChain | 3886 | 11528, 19170, 26812, 34454, 42096, 49738, 57380 |
| anti-HIV-1_HeavyChain | 3887 | 11529, 19171, 26813, 34455, 42097, 49739, 57381 |
| anti-HIV-1_HeavyChain | 3888 | 11530, 19172, 26814, 34456, 42098, 49740, 57382 |
| anti-HIV-1_HeavyChain | 3889 | 11531, 19173, 26815, 34457, 42099, 49741, 57383 |
| anti-HIV-1_HeavyChain | 3890 | 11532, 19174, 26816, 34458, 42100, 49742, 57384 |
| anti-HIV-1_HeavyChain | 3891 | 11533, 19175, 26817, 34459, 42101, 49743, 57385 |
| anti-HIV-1_HeavyChain | 3892 | 11534, 19176, 26818, 34460, 42102, 49744, 57386 |
| anti-HIV-1_HeavyChain | 3893 | 11535, 19177, 26819, 34461, 42103, 49745, 57387 |
| anti-HIV-1_HeavyChain | 3894 | 11536, 19178, 26820, 34462, 42104, 49746, 57388 |
| anti-HIV-1_HeavyChain | 3895 | 11537, 19179, 26821, 34463, 42105, 49747, 57389 |
| anti-HIV-1_HeavyChain | 3896 | 11538, 19180, 26822, 34464, 42106, 49748, 57390 |
| anti-HIV-1_HeavyChain | 3897 | 11539, 19181, 26823, 34465, 42107, 49749, 57391 |
| anti-HIV-1_HeavyChain | 3898 | 11540, 19182, 26824, 34466, 42108, 49750, 57392 |
| anti-HIV-1_HeavyChain | 3899 | 11541, 19183, 26825, 34467, 42109, 49751, 57393 |
| anti-HIV-1_HeavyChain | 3900 | 11542, 19184, 26826, 34468, 42110, 49752, 57394 |
| anti-HIV-1_HeavyChain | 3901 | 11543, 19185, 26827, 34469, 42111, 49753, 57395 |
| anti-HIV-1_HeavyChain | 3902 | 11544, 19186, 26828, 34470, 42112, 49754, 57396 |
| anti-HIV-1_HeavyChain | 3903 | 11545, 19187, 26829, 34471, 42113, 49755, 57397 |
| anti-HIV-1_HeavyChain | 3904 | 11546, 19188, 26830, 34472, 42114, 49756, 57398 |
| anti-HIV-1_HeavyChain | 3905 | 11547, 19189, 26831, 34473, 42115, 49757, 57399 |
| anti-HIV-1_HeavyChain | 3906 | 11548, 19190, 26832, 34474, 42116, 49758, 57400 |
| anti-HIV-1_HeavyChain | 3907 | 11549, 19191, 26833, 34475, 42117, 49759, 57401 |
| anti-HIV-1_HeavyChain | 3908 | 11550, 19192, 26834, 34476, 42118, 49760, 57402 |
| anti-HIV-1_HeavyChain | 3909 | 11551, 19193, 26835, 34477, 42119, 49761, 57403 |
| anti-HIV-1_HeavyChain | 3910 | 11552, 19194, 26836, 34478, 42120, 49762, 57404 |
| anti-HIV-1_HeavyChain | 3911 | 11553, 19195, 26837, 34479, 42121, 49763, 57405 |
| anti-HIV-1_HeavyChain | 3912 | 11554, 19196, 26838, 34480, 42122, 49764, 57406 |
| anti-HIV-1_HeavyChain | 3913 | 11555, 19197, 26839, 34481, 42123, 49765, 57407 |
| anti-HIV-1_HeavyChain | 3914 | 11556, 19198, 26840, 34482, 42124, 49766, 57408 |
| anti-HIV-1_HeavyChain | 3915 | 11557, 19199, 26841, 34483, 42125, 49767, 57409 |
| anti-HIV-1_HeavyChain | 3916 | 11558, 19200, 26842, 34484, 42126, 49768, 57410 |
| anti-HIV-1_HeavyChain | 3917 | 11559, 19201, 26843, 34485, 42127, 49769, 57411 |
| anti-HIV-1_HeavyChain | 3918 | 11560, 19202, 26844, 34486, 42128, 49770, 57412 |
| anti-HIV-1_HeavyChain | 3919 | 11561, 19203, 26845, 34487, 42129, 49771, 57413 |
| anti-HIV-1_HeavyChain | 3920 | 11562, 19204, 26846, 34488, 42130, 49772, 57414 |
| anti-HIV-1_HeavyChain | 3921 | 11563, 19205, 26847, 34489, 42131, 49773, 57415 |
| anti-HIV-1_HeavyChain | 3922 | 11564, 19206, 26848, 34490, 42132, 49774, 57416 |
| anti-HIV-1_HeavyChain | 3923 | 11565, 19207, 26849, 34491, 42133, 49775, 57417 |
| anti-HIV-1_HeavyChain | 3924 | 11566, 19208, 26850, 34492, 42134, 49776, 57418 |
| anti-HIV-1_HeavyChain | 3925 | 11567, 19209, 26851, 34493, 42135, 49777, 57419 |
| anti-HIV-1_HeavyChain | 3926 | 11568, 19210, 26852, 34494, 42136, 49778, 57420 |
| anti-HIV-1_HeavyChain | 3927 | 11569, 19211, 26853, 34495, 42137, 49779, 57421 |
| anti-HIV-1_HeavyChain | 3928 | 11570, 19212, 26854, 34496, 42138, 49780, 57422 |
| anti-HIV-1_HeavyChain | 3929 | 11571, 19213, 26855, 34497, 42139, 49781, 57423 |
| anti-HIV-1_HeavyChain | 3930 | 11572, 19214, 26856, 34498, 42140, 49782, 57424 |
| anti-HIV-1_HeavyChain | 3931 | 11573, 19215, 26857, 34499, 42141, 49783, 57425 |
| anti-HIV-1_HeavyChain | 3932 | 11574, 19216, 26858, 34500, 42142, 49784, 57426 |
| anti-HIV-1_HeavyChain | 3933 | 11575, 19217, 26859, 34501, 42143, 49785, 57427 |
| anti-HIV-1_HeavyChain | 3934 | 11576, 19218, 26860, 34502, 42144, 49786, 57428 |
| anti-HIV-1_HeavyChain | 3935 | 11577, 19219, 26861, 34503, 42145, 49787, 57429 |
| anti-HIV-1_HeavyChain | 3936 | 11578, 19220, 26862, 34504, 42146, 49788, 57430 |
| anti-HIV-1_HeavyChain | 3937 | 11579, 19221, 26863, 34505, 42147, 49789, 57431 |
| anti-HIV-1_HeavyChain | 3938 | 11580, 19222, 26864, 34506, 42148, 49790, 57432 |
| anti-HIV-1_HeavyChain | 3939 | 11581, 19223, 26865, 34507, 42149, 49791, 57433 |
| anti-HIV-1_HeavyChain | 3940 | 11582, 19224, 26866, 34508, 42150, 49792, 57434 |
| anti-HIV-1_HeavyChain | 3941 | 11583, 19225, 26867, 34509, 42151, 49793, 57435 |
| anti-HIV-1_HeavyChain | 3942 | 11584, 19226, 26868, 34510, 42152, 49794, 57436 |
| anti-HIV-1_HeavyChain | 3943 | 11585, 19227, 26869, 34511, 42153, 49795, 57437 |
| anti-HIV-1_HeavyChain | 3944 | 11586, 19228, 26870, 34512, 42154, 49796, 57438 |
| anti-HIV-1_HeavyChain | 3945 | 11587, 19229, 26871, 34513, 42155, 49797, 57439 |
| anti-HIV-1_HeavyChain | 3946 | 11588, 19230, 26872, 34514, 42156, 49798, 57440 |
| anti-HIV-1_HeavyChain | 3947 | 11589, 19231, 26873, 34515, 42157, 49799, 57441 |
| anti-HIV-1_HeavyChain | 3948 | 11590, 19232, 26874, 34516, 42158, 49800, 57442 |

TABLE 3-continued

RNA and amino acid sequences of exemplified antibodies

| Name | Protein SEQ ID NO | RNA SEQ ID NO |
| --- | --- | --- |
| anti-HIV-1_HeavyChain | 3949 | 11591, 19233, 26875, 34517, 42159, 49801, 57443 |
| anti-HIV-1_HeavyChain | 3950 | 11592, 19234, 26876, 34518, 42160, 49802, 57444 |
| anti-HIV-1_HeavyChain | 3951 | 11593, 19235, 26877, 34519, 42161, 49803, 57445 |
| anti-HIV-1_HeavyChain | 3952 | 11594, 19236, 26878, 34520, 42162, 49804, 57446 |
| anti-HIV-1_HeavyChain | 3953 | 11595, 19237, 26879, 34521, 42163, 49805, 57447 |
| anti-HIV-1_HeavyChain | 3954 | 11596, 19238, 26880, 34522, 42164, 49806, 57448 |
| anti-HIV-1_HeavyChain | 3955 | 11597, 19239, 26881, 34523, 42165, 49807, 57449 |
| anti-HIV-1_HeavyChain | 3956 | 11598, 19240, 26882, 34524, 42166, 49808, 57450 |
| anti-HIV-1_HeavyChain | 3957 | 11599, 19241, 26883, 34525, 42167, 49809, 57451 |
| anti-HIV-1_HeavyChain | 3958 | 11600, 19242, 26884, 34526, 42168, 49810, 57452 |
| anti-HIV-1_HeavyChain | 3959 | 11601, 19243, 26885, 34527, 42169, 49811, 57453 |
| anti-HIV-1_HeavyChain | 3960 | 11602, 19244, 26886, 34528, 42170, 49812, 57454 |
| anti-HIV-1_HeavyChain | 3961 | 11603, 19245, 26887, 34529, 42171, 49813, 57455 |
| anti-HIV-1_HeavyChain | 3962 | 11604, 19246, 26888, 34530, 42172, 49814, 57456 |
| anti-HIV-1_HeavyChain | 3963 | 11605, 19247, 26889, 34531, 42173, 49815, 57457 |
| anti-HIV-1_HeavyChain | 3964 | 11606, 19248, 26890, 34532, 42174, 49816, 57458 |
| anti-HIV-1_HeavyChain | 3965 | 11607, 19249, 26891, 34533, 42175, 49817, 57459 |
| anti-HIV-1_HeavyChain | 3966 | 11608, 19250, 26892, 34534, 42176, 49818, 57460 |
| anti-HIV-1_HeavyChain | 3967 | 11609, 19251, 26893, 34535, 42177, 49819, 57461 |
| anti-HIV-1_HeavyChain | 3968 | 11610, 19252, 26894, 34536, 42178, 49820, 57462 |
| anti-HIV-1_HeavyChain | 3969 | 11611, 19253, 26895, 34537, 42179, 49821, 57463 |
| anti-HIV-1_HeavyChain | 3970 | 11612, 19254, 26896, 34538, 42180, 49822, 57464 |
| anti-HIV-1_HeavyChain | 3971 | 11613, 19255, 26897, 34539, 42181, 49823, 57465 |
| anti-HIV-1_HeavyChain | 3972 | 11614, 19256, 26898, 34540, 42182, 49824, 57466 |
| anti-HIV-1_HeavyChain | 3973 | 11615, 19257, 26899, 34541, 42183, 49825, 57467 |
| anti-HIV-1_HeavyChain | 3974 | 11616, 19258, 26900, 34542, 42184, 49826, 57468 |
| anti-HIV-1_HeavyChain | 3975 | 11617, 19259, 26901, 34543, 42185, 49827, 57469 |
| anti-HIV-1_HeavyChain | 3976 | 11618, 19260, 26902, 34544, 42186, 49828, 57470 |
| anti-HIV-1_HeavyChain | 3977 | 11619, 19261, 26903, 34545, 42187, 49829, 57471 |
| anti-HIV-1_HeavyChain | 3978 | 11620, 19262, 26904, 34546, 42188, 49830, 57472 |
| anti-HIV-1_HeavyChain | 3979 | 11621, 19263, 26905, 34547, 42189, 49831, 57473 |
| anti-HIV-1_HeavyChain | 3980 | 11622, 19264, 26906, 34548, 42190, 49832, 57474 |
| anti-HIV-1_HeavyChain | 3981 | 11623, 19265, 26907, 34549, 42191, 49833, 57475 |
| anti-HIV-1_HeavyChain | 3982 | 11624, 19266, 26908, 34550, 42192, 49834, 57476 |
| anti-HIV-1_HeavyChain | 3983 | 11625, 19267, 26909, 34551, 42193, 49835, 57477 |
| anti-HIV-1_HeavyChain | 3984 | 11626, 19268, 26910, 34552, 42194, 49836, 57478 |
| anti-HIV-1_HeavyChain | 3985 | 11627, 19269, 26911, 34553, 42195, 49837, 57479 |
| anti-HIV-1_HeavyChain | 3986 | 11628, 19270, 26912, 34554, 42196, 49838, 57480 |
| anti-HIV-1_HeavyChain | 3987 | 11629, 19271, 26913, 34555, 42197, 49839, 57481 |
| anti-HIV-1_HeavyChain | 3988 | 11630, 19272, 26914, 34556, 42198, 49840, 57482 |
| anti-HIV-1_HeavyChain | 3989 | 11631, 19273, 26915, 34557, 42199, 49841, 57483 |
| anti-HIV-1_HeavyChain | 3990 | 11632, 19274, 26916, 34558, 42200, 49842, 57484 |
| anti-HIV-1_HeavyChain | 3991 | 11633, 19275, 26917, 34559, 42201, 49843, 57485 |
| anti-HIV-1_HeavyChain | 3992 | 11634, 19276, 26918, 34560, 42202, 49844, 57486 |
| anti-HIV-1_HeavyChain | 3993 | 11635, 19277, 26919, 34561, 42203, 49845, 57487 |
| anti-HIV-1_HeavyChain | 3994 | 11636, 19278, 26920, 34562, 42204, 49846, 57488 |
| anti-HIV-1_HeavyChain | 3995 | 11637, 19279, 26921, 34563, 42205, 49847, 57489 |
| anti-HIV-1_HeavyChain | 3996 | 11638, 19280, 26922, 34564, 42206, 49848, 57490 |
| anti-HIV-1_HeavyChain | 3997 | 11639, 19281, 26923, 34565, 42207, 49849, 57491 |
| anti-HIV-1_HeavyChain | 3998 | 11640, 19282, 26924, 34566, 42208, 49850, 57492 |
| anti-HIV-1_HeavyChain | 3999 | 11641, 19283, 26925, 34567, 42209, 49851, 57493 |
| anti-HIV-1_HeavyChain | 4000 | 11642, 19284, 26926, 34568, 42210, 49852, 57494 |
| anti-HIV_5CIN_LightChain | 4001 | 11643, 19285, 26927, 34569, 42211, 49853, 57495 |
| anti-HIV_5CIN_HeavyChain | 4002 | 11644, 19286, 26928, 34570, 42212, 49854, 57496 |
| anti-HIV_5CIL_HeavyChain | 4003 | 11645, 19287, 26929, 34571, 42213, 49855, 57497 |
| anti-HIV_5CIP_A-Chain | 4004 | 11646, 19288, 26930, 34572, 42214, 49856, 57498 |
| anti-HIV_5CIP_HeavyChain | 4005 | 11647, 19289, 26931, 34573, 42215, 49857, 57499 |
| anti-HIV_4JKP_LightChain | 4006 | 11648, 19290, 26932, 34574, 42216, 49858, 57500 |
| anti-HIV_3TNN_E-Chain | 4007 | 11649, 19291, 26933, 34575, 42217, 49859, 57501 |
| anti-HIV_3BQU_B-Chain | 4008 | 11650, 19292, 26934, 34576, 42218, 49860, 57502 |
| anti-HIV_3BQU_A-Chain | 4009 | 11651, 19293, 26935, 34577, 42219, 49861, 57503 |
| anti-HIV_IgG_VR-Chain | 4010 | 11652, 19294, 26936, 34578, 42220, 49862, 57504 |
| anti-HIV_IgG_HeavyChain | 4011 | 11653, 19295, 26937, 34579, 42221, 49863, 57505 |
| anti-HIV_4P9M_HeavyChain | 4012 | 11654, 19296, 26938, 34580, 42222, 49864, 57506 |
| anti-HIV_4P9M_LightChain | 4013 | 11655, 19297, 26939, 34581, 42223, 49865, 57507 |
| anti-HIV_4P9H_C-Chain | 4014 | 11656, 19298, 26940, 34582, 42224, 49866, 57508 |
| anti-HIV_4YBL_A-Chain | 4015 | 11657, 19299, 26941, 34583, 42225, 49867, 57509 |
| anti-HIV_4R4N_V-Chain | 4016 | 11658, 19300, 26942, 34584, 42226, 49868, 57510 |
| anti-HIV_4JKP_G-Chain | 4017 | 11659, 19301, 26943, 34585, 42227, 49869, 57511 |
| anti-HIV_3BQU_D-Chain | 4018 | 11660, 19302, 26944, 34586, 42228, 49870, 57512 |
| anti-HIV_3BQU_C-Chain | 4019 | 11661, 19303, 26945, 34587, 42229, 49871, 57513 |
| anti-HIV_Ig_LightChain | 4020 | 11662, 19304, 26946, 34588, 42230, 49872, 57514 |
| anti-HIV_Ig_HeavyChain | 4021 | 11663, 19305, 26947, 34589, 42231, 49873, 57515 |
| anti-HIV_4P9H_G-Chain | 4022 | 11664, 19306, 26948, 34590, 42232, 49874, 57516 |
| anti-HIV_Chain | 4023 | 11665, 19307, 26949, 34591, 42233, 49875, 57517 |
| anti-HIV_Chain | 4024 | 11666, 19308, 26950, 34592, 42234, 49876, 57518 |

TABLE 3-continued

RNA and amino acid sequences of exemplified antibodies

| Name | Protein SEQ ID NO | RNA SEQ ID NO |
|---|---|---|
| anti-HIV_Chain | 4025 | 11667, 19309, 26951, 34593, 42235, 49877, 57519 |
| anti-HIV_Chain | 4026 | 11668, 19310, 26952, 34594, 42236, 49878, 57520 |
| anti-HIV_Chain | 4027 | 11669, 19311, 26953, 34595, 42237, 49879, 57521 |
| anti-HIV_Chain | 4028 | 11670, 19312, 26954, 34596, 42238, 49880, 57522 |
| anti-HIV_Chain | 4029 | 11671, 19313, 26955, 34597, 42239, 49881, 57523 |
| anti-HIV_Chain | 4030 | 11672, 19314, 26956, 34598, 42240, 49882, 57524 |
| anti-HIV_Chain | 4031 | 11673, 19315, 26957, 34599, 42241, 49883, 57525 |
| anti-HIV_Chain | 4032 | 11674, 19316, 26958, 34600, 42242, 49884, 57526 |
| anti-HIV_Chain | 4033 | 11675, 19317, 26959, 34601, 42243, 49885, 57527 |
| anti-HIV_Chain | 4034 | 11676, 19318, 26960, 34602, 42244, 49886, 57528 |
| anti-HIV_Chain | 4035 | 11677, 19319, 26961, 34603, 42245, 49887, 57529 |
| anti-HIV_Chain | 4036 | 11678, 19320, 26962, 34604, 42246, 49888, 57530 |
| anti-HIV_Chain | 4037 | 11679, 19321, 26963, 34605, 42247, 49889, 57531 |
| anti-HIV_Chain | 4038 | 11680, 19322, 26964, 34606, 42248, 49890, 57532 |
| anti-HIV_Chain | 4039 | 11681, 19323, 26965, 34607, 42249, 49891, 57533 |
| anti-HIV_Chain | 4040 | 11682, 19324, 26966, 34608, 42250, 49892, 57534 |
| anti-HIV_Chain | 4041 | 11683, 19325, 26967, 34609, 42251, 49893, 57535 |
| anti-HIV_Chain | 4042 | 11684, 19326, 26968, 34610, 42252, 49894, 57536 |
| anti-HIV_Chain | 4043 | 11685, 19327, 26969, 34611, 42253, 49895, 57537 |
| anti-HIV_Chain | 4044 | 11686, 19328, 26970, 34612, 42254, 49896, 57538 |
| anti-HIV_Chain | 4045 | 11687, 19329, 26971, 34613, 42255, 49897, 57539 |
| anti-HIV_Chain | 4046 | 11688, 19330, 26972, 34614, 42256, 49898, 57540 |
| anti-HIV_Chain | 4047 | 11689, 19331, 26973, 34615, 42257, 49899, 57541 |
| anti-HIV_Chain | 4048 | 11690, 19332, 26974, 34616, 42258, 49900, 57542 |
| anti-HIV_Chain | 4049 | 11691, 19333, 26975, 34617, 42259, 49901, 57543 |
| anti-HIV_Chain | 4050 | 11692, 19334, 26976, 34618, 42260, 49902, 57544 |
| anti-HIV_Chain | 4051 | 11693, 19335, 26977, 34619, 42261, 49903, 57545 |
| anti-HIV_Chain | 4052 | 11694, 19336, 26978, 34620, 42262, 49904, 57546 |
| anti-HIV_Chain | 4053 | 11695, 19337, 26979, 34621, 42263, 49905, 57547 |
| anti-HIV_Chain | 4054 | 11696, 19338, 26980, 34622, 42264, 49906, 57548 |
| anti-HIV_Chain | 4055 | 11697, 19339, 26981, 34623, 42265, 49907, 57549 |
| anti-HIV_Chain | 4056 | 11698, 19340, 26982, 34624, 42266, 49908, 57550 |
| anti-HIV_Chain | 4057 | 11699, 19341, 26983, 34625, 42267, 49909, 57551 |
| anti-HIV_Chain | 4058 | 11700, 19342, 26984, 34626, 42268, 49910, 57552 |
| anti-HIV_Chain | 4059 | 11701, 19343, 26985, 34627, 42269, 49911, 57553 |
| anti-HIV_Chain | 4060 | 11702, 19344, 26986, 34628, 42270, 49912, 57554 |
| anti-HIV_Chain | 4061 | 11703, 19345, 26987, 34629, 42271, 49913, 57555 |
| anti-HIV_Chain | 4062 | 11704, 19346, 26988, 34630, 42272, 49914, 57556 |
| anti-HIV_Chain | 4063 | 11705, 19347, 26989, 34631, 42273, 49915, 57557 |
| anti-HIV_Chain | 4064 | 11706, 19348, 26990, 34632, 42274, 49916, 57558 |
| anti-HIV_Chain | 4065 | 11707, 19349, 26991, 34633, 42275, 49917, 57559 |
| anti-HIV_Chain | 4066 | 11708, 19350, 26992, 34634, 42276, 49918, 57560 |
| anti-HIV_Chain | 4067 | 11709, 19351, 26993, 34635, 42277, 49919, 57561 |
| anti-HIV_Chain | 4068 | 11710, 19352, 26994, 34636, 42278, 49920, 57562 |
| anti-HIV_Chain | 4069 | 11711, 19353, 26995, 34637, 42279, 49921, 57563 |
| anti-HIV_Chain | 4070 | 11712, 19354, 26996, 34638, 42280, 49922, 57564 |
| anti-HIV_LightChain | 4071 | 11713, 19355, 26997, 34639, 42281, 49923, 57565 |
| anti-HIV_LightChain | 4072 | 11714, 19356, 26998, 34640, 42282, 49924, 57566 |
| anti-HIV_Chain | 4073 | 11715, 19357, 26999, 34641, 42283, 49925, 57567 |
| anti-HIV_Chain | 4074 | 11716, 19358, 27000, 34642, 42284, 49926, 57568 |
| anti-HIV_Chain | 4075 | 11717, 19359, 27001, 34643, 42285, 49927, 57569 |
| anti-HIV_HeavyChain | 4076 | 11718, 19360, 27002, 34644, 42286, 49928, 57570 |
| anti-HIV_Chain | 4077 | 11719, 19361, 27003, 34645, 42287, 49929, 57571 |
| anti-HIV_Chain | 4078 | 11720, 19362, 27004, 34646, 42288, 49930, 57572 |
| anti-HIV_LightChain | 4079 | 11721, 19363, 27005, 34647, 42289, 49931, 57573 |
| anti-HIV_LightChain | 4080 | 11722, 19364, 27006, 34648, 42290, 49932, 57574 |
| anti-HIV_Chain | 4081 | 11723, 19365, 27007, 34649, 42291, 49933, 57575 |
| anti-HIV_Chain | 4082 | 11724, 19366, 27008, 34650, 42292, 49934, 57576 |
| anti-HIV_Chain | 4083 | 11725, 19367, 27009, 34651, 42293, 49935, 57577 |
| anti-HIV_Chain | 4084 | 11726, 19368, 27010, 34652, 42294, 49936, 57578 |
| anti-HIV_Chain | 4085 | 11727, 19369, 27011, 34653, 42295, 49937, 57579 |
| anti-HIV_Chain | 4086 | 11728, 19370, 27012, 34654, 42296, 49938, 57580 |
| anti-HIV_Chain | 4087 | 11729, 19371, 27013, 34655, 42297, 49939, 57581 |
| anti-HIV_Chain | 4088 | 11730, 19372, 27014, 34656, 42298, 49940, 57582 |
| anti-HIV_Chain | 4089 | 11731, 19373, 27015, 34657, 42299, 49941, 57583 |
| anti-HIV_Chain | 4090 | 11732, 19374, 27016, 34658, 42300, 49942, 57584 |
| anti-HIV_Chain | 4091 | 11733, 19375, 27017, 34659, 42301, 49943, 57585 |
| anti-HIV_Chain | 4092 | 11734, 19376, 27018, 34660, 42302, 49944, 57586 |
| anti-HIV_Chain | 4093 | 11735, 19377, 27019, 34661, 42303, 49945, 57587 |
| anti-HIV_Chain | 4094 | 11736, 19378, 27020, 34662, 42304, 49946, 57588 |
| anti-HIV_Chain | 4095 | 11737, 19379, 27021, 34663, 42305, 49947, 57589 |
| anti-HIV_Chain | 4096 | 11738, 19380, 27022, 34664, 42306, 49948, 57590 |
| anti-HIV_Chain | 4097 | 11739, 19381, 27023, 34665, 42307, 49949, 57591 |
| anti-HIV_Chain | 4098 | 11740, 19382, 27024, 34666, 42308, 49950, 57592 |
| anti-HIV_Chain | 4099 | 11741, 19383, 27025, 34667, 42309, 49951, 57593 |
| anti-HIV_Chain | 4100 | 11742, 19384, 27026, 34668, 42310, 49952, 57594 |

TABLE 3-continued

RNA and amino acid sequences of exemplified antibodies

| Name | Protein SEQ ID NO | RNA SEQ ID NO |
| --- | --- | --- |
| anti-HIV_Chain | 4101 | 11743, 19385, 27027, 34669, 42311, 49953, 57595 |
| anti-HIV_Chain | 4102 | 11744, 19386, 27028, 34670, 42312, 49954, 57596 |
| anti-HIV_Chain | 4103 | 11745, 19387, 27029, 34671, 42313, 49955, 57597 |
| anti-HIV_Chain | 4104 | 11746, 19388, 27030, 34672, 42314, 49956, 57598 |
| anti-HIV_Chain | 4105 | 11747, 19389, 27031, 34673, 42315, 49957, 57599 |
| anti-HIV_Chain | 4106 | 11748, 19390, 27032, 34674, 42316, 49958, 57600 |
| anti-HIV_Chain | 4107 | 11749, 19391, 27033, 34675, 42317, 49959, 57601 |
| anti-HIV_Chain | 4108 | 11750, 19392, 27034, 34676, 42318, 49960, 57602 |
| anti-HIV_Chain | 4109 | 11751, 19393, 27035, 34677, 42319, 49961, 57603 |
| anti-HIV_Chain | 4110 | 11752, 19394, 27036, 34678, 42320, 49962, 57604 |
| anti-HIV_Chain | 4111 | 11753, 19395, 27037, 34679, 42321, 49963, 57605 |
| anti-HIV_Chain | 4112 | 11754, 19396, 27038, 34680, 42322, 49964, 57606 |
| anti-HIV_LightChain | 4113 | 11755, 19397, 27039, 34681, 42323, 49965, 57607 |
| anti-HIV_LightChain | 4114 | 11756, 19398, 27040, 34682, 42324, 49966, 57608 |
| anti-HIV_LightChain | 4115 | 11757, 19399, 27041, 34683, 42325, 49967, 57609 |
| anti-HIV_LightChain | 4116 | 11758, 19400, 27042, 34684, 42326, 49968, 57610 |
| anti-HIV_LightChain | 4117 | 11759, 19401, 27043, 34685, 42327, 49969, 57611 |
| anti-HIV_LightChain | 4118 | 11760, 19402, 27044, 34686, 42328, 49970, 57612 |
| anti-HIV_LightChain | 4119 | 11761, 19403, 27045, 34687, 42329, 49971, 57613 |
| anti-HIV_LightChain | 4120 | 11762, 19404, 27046, 34688, 42330, 49972, 57614 |
| anti-HIV_LightChain | 4121 | 11763, 19405, 27047, 34689, 42331, 49973, 57615 |
| anti-HIV_LightChain | 4122 | 11764, 19406, 27048, 34690, 42332, 49974, 57616 |
| anti-HIV_LightChain | 4123 | 11765, 19407, 27049, 34691, 42333, 49975, 57617 |
| anti-HIV_LightChain | 4124 | 11766, 19408, 27050, 34692, 42334, 49976, 57618 |
| anti-HIV_LightChain | 4125 | 11767, 19409, 27051, 34693, 42335, 49977, 57619 |
| anti-HIV_LightChain | 4126 | 11768, 19410, 27052, 34694, 42336, 49978, 57620 |
| anti-HIV_LightChain | 4127 | 11769, 19411, 27053, 34695, 42337, 49979, 57621 |
| anti-HIV_Chain | 4128 | 11770, 19412, 27054, 34696, 42338, 49980, 57622 |
| anti-HIV_Chain | 4129 | 11771, 19413, 27055, 34697, 42339, 49981, 57623 |
| anti-HIV_Chain | 4130 | 11772, 19414, 27056, 34698, 42340, 49982, 57624 |
| anti-HIV_Chain | 4131 | 11773, 19415, 27057, 34699, 42341, 49983, 57625 |
| anti-HIV_Chain | 4132 | 11774, 19416, 27058, 34700, 42342, 49984, 57626 |
| anti-HIV_Chain | 4133 | 11775, 19417, 27059, 34701, 42343, 49985, 57627 |
| anti-HIV_Chain | 4134 | 11776, 19418, 27060, 34702, 42344, 49986, 57628 |
| anti-HIV_Chain | 4135 | 11777, 19419, 27061, 34703, 42345, 49987, 57629 |
| anti-HIV_Chain | 4136 | 11778, 19420, 27062, 34704, 42346, 49988, 57630 |
| anti-HIV_HeavyChain | 4137 | 11779, 19421, 27063, 34705, 42347, 49989, 57631 |
| anti-HIV_Chain | 4138 | 11780, 19422, 27064, 34706, 42348, 49990, 57632 |
| anti-HIV_Chain | 4139 | 11781, 19423, 27065, 34707, 42349, 49991, 57633 |
| anti-HIV_Chain | 4140 | 11782, 19424, 27066, 34708, 42350, 49992, 57634 |
| anti-HIV_Chain | 4141 | 11783, 19425, 27067, 34709, 42351, 49993, 57635 |
| anti-HIV_Chain | 4142 | 11784, 19426, 27068, 34710, 42352, 49994, 57636 |
| anti-HIV_Chain | 4143 | 11785, 19427, 27069, 34711, 42353, 49995, 57637 |
| anti-HIV_Chain | 4144 | 11786, 19428, 27070, 34712, 42354, 49996, 57638 |
| anti-HIV_Chain | 4145 | 11787, 19429, 27071, 34713, 42355, 49997, 57639 |
| anti-HIV_Chain | 4146 | 11788, 19430, 27072, 34714, 42356, 49998, 57640 |
| anti-HIV_Chain | 4147 | 11789, 19431, 27073, 34715, 42357, 49999, 57641 |
| anti-HIV_Chain | 4148 | 11790, 19432, 27074, 34716, 42358, 50000, 57642 |
| anti-HIV_Chain | 4149 | 11791, 19433, 27075, 34717, 42359, 50001, 57643 |
| anti-HIV_Chain | 4150 | 11792, 19434, 27076, 34718, 42360, 50002, 57644 |
| anti-HIV_Chain | 4151 | 11793, 19435, 27077, 34719, 42361, 50003, 57645 |
| anti-HIV_Chain | 4152 | 11794, 19436, 27078, 34720, 42362, 50004, 57646 |
| anti-HIV_Chain | 4153 | 11795, 19437, 27079, 34721, 42363, 50005, 57647 |
| anti-HIV_Chain | 4154 | 11796, 19438, 27080, 34722, 42364, 50006, 57648 |
| anti-HIV_Chain | 4155 | 11797, 19439, 27081, 34723, 42365, 50007, 57649 |
| anti-HIV_Chain | 4156 | 11798, 19440, 27082, 34724, 42366, 50008, 57650 |
| anti-HIV_Chain | 4157 | 11799, 19441, 27083, 34725, 42367, 50009, 57651 |
| anti-HIV_HeavyChain | 4158 | 11800, 19442, 27084, 34726, 42368, 50010, 57652 |
| anti-HIV_HeavyChain | 4159 | 11801, 19443, 27085, 34727, 42369, 50011, 57653 |
| anti-HIV_Chain | 4160 | 11802, 19444, 27086, 34728, 42370, 50012, 57654 |
| anti-HIV_Chain | 4161 | 11803, 19445, 27087, 34729, 42371, 50013, 57655 |
| anti-HIV_Chain | 4162 | 11804, 19446, 27088, 34730, 42372, 50014, 57656 |
| anti-HIV_Chain | 4163 | 11805, 19447, 27089, 34731, 42373, 50015, 57657 |
| anti-HIV_Chain | 4164 | 11806, 19448, 27090, 34732, 42374, 50016, 57658 |
| anti-HIV_Chain | 4165 | 11807, 19449, 27091, 34733, 42375, 50017, 57659 |
| anti-HIV_Chain | 4166 | 11808, 19450, 27092, 34734, 42376, 50018, 57660 |
| anti-HIV_Chain | 4167 | 11809, 19451, 27093, 34735, 42377, 50019, 57661 |
| anti-HIV_Chain | 4168 | 11810, 19452, 27094, 34736, 42378, 50020, 57662 |
| anti-HIV_Chain | 4169 | 11811, 19453, 27095, 34737, 42379, 50021, 57663 |
| anti-HIV_Chain | 4170 | 11812, 19454, 27096, 34738, 42380, 50022, 57664 |
| anti-HIV_Chain | 4171 | 11813, 19455, 27097, 34739, 42381, 50023, 57665 |
| anti-HIV_Chain | 4172 | 11814, 19456, 27098, 34740, 42382, 50024, 57666 |
| anti-HIV_Chain | 4173 | 11815, 19457, 27099, 34741, 42383, 50025, 57667 |
| anti-HIV_Chain | 4174 | 11816, 19458, 27100, 34742, 42384, 50026, 57668 |
| anti-HIV_Chain | 4175 | 11817, 19459, 27101, 34743, 42385, 50027, 57669 |
| anti-HIV_Chain | 4176 | 11818, 19460, 27102, 34744, 42386, 50028, 57670 |

TABLE 3-continued

RNA and amino acid sequences of exemplified antibodies

| Name | Protein SEQ ID NO | RNA SEQ ID NO |
|---|---|---|
| anti-HIV_Chain | 4177 | 11819, 19461, 27103, 34745, 42387, 50029, 57671 |
| anti-HIV_Chain | 4178 | 11820, 19462, 27104, 34746, 42388, 50030, 57672 |
| anti-HIV_Chain | 4179 | 11821, 19463, 27105, 34747, 42389, 50031, 57673 |
| anti-HIV_Chain | 4180 | 11822, 19464, 27106, 34748, 42390, 50032, 57674 |
| anti-HIV_Chain | 4181 | 11823, 19465, 27107, 34749, 42391, 50033, 57675 |
| anti-HIV_Chain | 4182 | 11824, 19466, 27108, 34750, 42392, 50034, 57676 |
| anti-HIV_Chain | 4183 | 11825, 19467, 27109, 34751, 42393, 50035, 57677 |
| anti-HIV_Chain | 4184 | 11826, 19468, 27110, 34752, 42394, 50036, 57678 |
| anti-HIV_Chain | 4185 | 11827, 19469, 27111, 34753, 42395, 50037, 57679 |
| anti-HIV_Chain | 4186 | 11828, 19470, 27112, 34754, 42396, 50038, 57680 |
| anti-HIV_Chain | 4187 | 11829, 19471, 27113, 34755, 42397, 50039, 57681 |
| anti-HIV_Chain | 4188 | 11830, 19472, 27114, 34756, 42398, 50040, 57682 |
| anti-HIV_Chain | 4189 | 11831, 19473, 27115, 34757, 42399, 50041, 57683 |
| anti-HIV_Chain | 4190 | 11832, 19474, 27116, 34758, 42400, 50042, 57684 |
| anti-HIV_Chain | 4191 | 11833, 19475, 27117, 34759, 42401, 50043, 57685 |
| anti-HIV_Chain | 4192 | 11834, 19476, 27118, 34760, 42402, 50044, 57686 |
| anti-HIV_Chain | 4193 | 11835, 19477, 27119, 34761, 42403, 50045, 57687 |
| anti-HIV_Chain | 4194 | 11836, 19478, 27120, 34762, 42404, 50046, 57688 |
| anti-HIV_Chain | 4195 | 11837, 19479, 27121, 34763, 42405, 50047, 57689 |
| anti-HIV_Chain | 4196 | 11838, 19480, 27122, 34764, 42406, 50048, 57690 |
| anti-HIV_Chain | 4197 | 11839, 19481, 27123, 34765, 42407, 50049, 57691 |
| anti-HIV_Chain | 4198 | 11840, 19482, 27124, 34766, 42408, 50050, 57692 |
| anti-HIV_Chain | 4199 | 11841, 19483, 27125, 34767, 42409, 50051, 57693 |
| anti-HIV_Chain | 4200 | 11842, 19484, 27126, 34768, 42410, 50052, 57694 |
| anti-HIV_Chain | 4201 | 11843, 19485, 27127, 34769, 42411, 50053, 57695 |
| anti-HIV_Chain | 4202 | 11844, 19486, 27128, 34770, 42412, 50054, 57696 |
| anti-HIV_Chain | 4203 | 11845, 19487, 27129, 34771, 42413, 50055, 57697 |
| anti-HIV_Chain | 4204 | 11846, 19488, 27130, 34772, 42414, 50056, 57698 |
| anti-HIV_Chain | 4205 | 11847, 19489, 27131, 34773, 42415, 50057, 57699 |
| anti-HIV_HeavyChain | 4206 | 11848, 19490, 27132, 34774, 42416, 50058, 57700 |
| anti-HIV_Chain | 4207 | 11849, 19491, 27133, 34775, 42417, 50059, 57701 |
| anti-HIV_Chain | 4208 | 11850, 19492, 27134, 34776, 42418, 50060, 57702 |
| anti-HIV_Chain | 4209 | 11851, 19493, 27135, 34777, 42419, 50061, 57703 |
| anti-HIV_Chain | 4210 | 11852, 19494, 27136, 34778, 42420, 50062, 57704 |
| anti-HIV_Chain | 4211 | 11853, 19495, 27137, 34779, 42421, 50063, 57705 |
| anti-HIV_Chain | 4212 | 11854, 19496, 27138, 34780, 42422, 50064, 57706 |
| anti-HIV_Chain | 4213 | 11855, 19497, 27139, 34781, 42423, 50065, 57707 |
| anti-HIV_Chain | 4214 | 11856, 19498, 27140, 34782, 42424, 50066, 57708 |
| anti-HIV_Chain | 4215 | 11857, 19499, 27141, 34783, 42425, 50067, 57709 |
| anti-HIV_Chain | 4216 | 11858, 19500, 27142, 34784, 42426, 50068, 57710 |
| anti-HIV_Chain | 4217 | 11859, 19501, 27143, 34785, 42427, 50069, 57711 |
| anti-HIV_Chain | 4218 | 11860, 19502, 27144, 34786, 42428, 50070, 57712 |
| anti-HIV_Chain | 4219 | 11861, 19503, 27145, 34787, 42429, 50071, 57713 |
| anti-HIV_Chain | 4220 | 11862, 19504, 27146, 34788, 42430, 50072, 57714 |
| anti-HIV_Chain | 4221 | 11863, 19505, 27147, 34789, 42431, 50073, 57715 |
| anti-HIV_Chain | 4222 | 11864, 19506, 27148, 34790, 42432, 50074, 57716 |
| anti-HIV_Chain | 4223 | 11865, 19507, 27149, 34791, 42433, 50075, 57717 |
| anti-HIV_Chain | 4224 | 11866, 19508, 27150, 34792, 42434, 50076, 57718 |
| anti-HIV_Chain | 4225 | 11867, 19509, 27151, 34793, 42435, 50077, 57719 |
| anti-HIV_Chain | 4226 | 11868, 19510, 27152, 34794, 42436, 50078, 57720 |
| anti-HIV_Chain | 4227 | 11869, 19511, 27153, 34795, 42437, 50079, 57721 |
| anti-HIV_Chain | 4228 | 11870, 19512, 27154, 34796, 42438, 50080, 57722 |
| anti-HIV_Chain | 4229 | 11871, 19513, 27155, 34797, 42439, 50081, 57723 |
| anti-HIV_Chain | 4230 | 11872, 19514, 27156, 34798, 42440, 50082, 57724 |
| anti-HIV_Chain | 4231 | 11873, 19515, 27157, 34799, 42441, 50083, 57725 |
| anti-HIV_Chain | 4232 | 11874, 19516, 27158, 34800, 42442, 50084, 57726 |
| anti-HIV_Chain | 4233 | 11875, 19517, 27159, 34801, 42443, 50085, 57727 |
| anti-HIV_Chain | 4234 | 11876, 19518, 27160, 34802, 42444, 50086, 57728 |
| anti-HIV_Chain | 4235 | 11877, 19519, 27161, 34803, 42445, 50087, 57729 |
| anti-HIV_Chain | 4236 | 11878, 19520, 27162, 34804, 42446, 50088, 57730 |
| anti-HIV_Chain | 4237 | 11879, 19521, 27163, 34805, 42447, 50089, 57731 |
| anti-HIV_Chain | 4238 | 11880, 19522, 27164, 34806, 42448, 50090, 57732 |
| anti-HIV_Chain | 4239 | 11881, 19523, 27165, 34807, 42449, 50091, 57733 |
| anti-HIV_Chain | 4240 | 11882, 19524, 27166, 34808, 42450, 50092, 57734 |
| anti-HIV_Chain | 4241 | 11883, 19525, 27167, 34809, 42451, 50093, 57735 |
| anti-HIV_Chain | 4242 | 11884, 19526, 27168, 34810, 42452, 50094, 57736 |
| anti-HIV_Chain | 4243 | 11885, 19527, 27169, 34811, 42453, 50095, 57737 |
| anti-HIV_Chain | 4244 | 11886, 19528, 27170, 34812, 42454, 50096, 57738 |
| anti-HIV_Chain | 4245 | 11887, 19529, 27171, 34813, 42455, 50097, 57739 |
| anti-HIV_Chain | 4246 | 11888, 19530, 27172, 34814, 42456, 50098, 57740 |
| anti-HIV_Chain | 4247 | 11889, 19531, 27173, 34815, 42457, 50099, 57741 |
| anti-HIV_Chain | 4248 | 11890, 19532, 27174, 34816, 42458, 50100, 57742 |
| anti-HIV_Chain | 4249 | 11891, 19533, 27175, 34817, 42459, 50101, 57743 |
| anti-HIV_Chain | 4250 | 11892, 19534, 27176, 34818, 42460, 50102, 57744 |
| anti-HIV_Chain | 4251 | 11893, 19535, 27177, 34819, 42461, 50103, 57745 |
| anti-HIV_Chain | 4252 | 11894, 19536, 27178, 34820, 42462, 50104, 57746 |

TABLE 3-continued

RNA and amino acid sequences of exemplified antibodies

| Name | Protein SEQ ID NO | RNA SEQ ID NO |
|---|---|---|
| anti-HIV_Chain | 4253 | 11895, 19537, 27179, 34821, 42463, 50105, 57747 |
| anti-HIV_Chain | 4254 | 11896, 19538, 27180, 34822, 42464, 50106, 57748 |
| anti-HIV_Chain | 4255 | 11897, 19539, 27181, 34823, 42465, 50107, 57749 |
| anti-HIV_Chain | 4256 | 11898, 19540, 27182, 34824, 42466, 50108, 57750 |
| anti-HIV_Chain | 4257 | 11899, 19541, 27183, 34825, 42467, 50109, 57751 |
| anti-HIV_Chain | 4258 | 11900, 19542, 27184, 34826, 42468, 50110, 57752 |
| anti-HIV_Chain | 4259 | 11901, 19543, 27185, 34827, 42469, 50111, 57753 |
| anti-HIV_Chain | 4260 | 11902, 19544, 27186, 34828, 42470, 50112, 57754 |
| anti-HIV_Chain | 4261 | 11903, 19545, 27187, 34829, 42471, 50113, 57755 |
| anti-HIV_Chain | 4262 | 11904, 19546, 27188, 34830, 42472, 50114, 57756 |
| anti-HIV_Chain | 4263 | 11905, 19547, 27189, 34831, 42473, 50115, 57757 |
| anti-HIV_Chain | 4264 | 11906, 19548, 27190, 34832, 42474, 50116, 57758 |
| anti-HIV_Chain | 4265 | 11907, 19549, 27191, 34833, 42475, 50117, 57759 |
| anti-HIV_Chain | 4266 | 11908, 19550, 27192, 34834, 42476, 50118, 57760 |
| anti-HIV_Chain | 4267 | 11909, 19551, 27193, 34835, 42477, 50119, 57761 |
| anti-HIV_Chain | 4268 | 11910, 19552, 27194, 34836, 42478, 50120, 57762 |
| anti-HIV_Chain | 4269 | 11911, 19553, 27195, 34837, 42479, 50121, 57763 |
| anti-HIV_Chain | 4270 | 11912, 19554, 27196, 34838, 42480, 50122, 57764 |
| anti-HIV_Chain | 4271 | 11913, 19555, 27197, 34839, 42481, 50123, 57765 |
| anti-HIV_Chain | 4272 | 11914, 19556, 27198, 34840, 42482, 50124, 57766 |
| anti-HIV_Chain | 4273 | 11915, 19557, 27199, 34841, 42483, 50125, 57767 |
| anti-HIV_Chain | 4274 | 11916, 19558, 27200, 34842, 42484, 50126, 57768 |
| anti-HIV_Chain | 4275 | 11917, 19559, 27201, 34843, 42485, 50127, 57769 |
| anti-HIV_Chain | 4276 | 11918, 19560, 27202, 34844, 42486, 50128, 57770 |
| anti-HIV_Chain | 4277 | 11919, 19561, 27203, 34845, 42487, 50129, 57771 |
| anti-HIV_Chain | 4278 | 11920, 19562, 27204, 34846, 42488, 50130, 57772 |
| anti-HIV_Chain | 4279 | 11921, 19563, 27205, 34847, 42489, 50131, 57773 |
| anti-HIV_Chain | 4280 | 11922, 19564, 27206, 34848, 42490, 50132, 57774 |
| anti-HIV_Chain | 4281 | 11923, 19565, 27207, 34849, 42491, 50133, 57775 |
| anti-HIV_Chain | 4282 | 11924, 19566, 27208, 34850, 42492, 50134, 57776 |
| anti-HIV_Chain | 4283 | 11925, 19567, 27209, 34851, 42493, 50135, 57777 |
| anti-HIV_Chain | 4284 | 11926, 19568, 27210, 34852, 42494, 50136, 57778 |
| anti-HIV_Chain | 4285 | 11927, 19569, 27211, 34853, 42495, 50137, 57779 |
| anti-HIV_Chain | 4286 | 11928, 19570, 27212, 34854, 42496, 50138, 57780 |
| anti-HIV_Chain | 4287 | 11929, 19571, 27213, 34855, 42497, 50139, 57781 |
| anti-HIV_Chain | 4288 | 11930, 19572, 27214, 34856, 42498, 50140, 57782 |
| anti-HIV_Chain | 4289 | 11931, 19573, 27215, 34857, 42499, 50141, 57783 |
| anti-HIV_Chain | 4290 | 11932, 19574, 27216, 34858, 42500, 50142, 57784 |
| anti-HIV_Chain | 4291 | 11933, 19575, 27217, 34859, 42501, 50143, 57785 |
| anti-HIV_Chain | 4292 | 11934, 19576, 27218, 34860, 42502, 50144, 57786 |
| anti-HIV_Chain | 4293 | 11935, 19577, 27219, 34861, 42503, 50145, 57787 |
| anti-HIV_Chain | 4294 | 11936, 19578, 27220, 34862, 42504, 50146, 57788 |
| anti-HIV_Chain | 4295 | 11937, 19579, 27221, 34863, 42505, 50147, 57789 |
| anti-HIV_Chain | 4296 | 11938, 19580, 27222, 34864, 42506, 50148, 57790 |
| anti-HIV_Chain | 4297 | 11939, 19581, 27223, 34865, 42507, 50149, 57791 |
| anti-HIV_Chain | 4298 | 11940, 19582, 27224, 34866, 42508, 50150, 57792 |
| anti-HIV_Chain | 4299 | 11941, 19583, 27225, 34867, 42509, 50151, 57793 |
| anti-HIV_Chain | 4300 | 11942, 19584, 27226, 34868, 42510, 50152, 57794 |
| anti-HIV_Chain | 4301 | 11943, 19585, 27227, 34869, 42511, 50153, 57795 |
| anti-HIV_Chain | 4302 | 11944, 19586, 27228, 34870, 42512, 50154, 57796 |
| anti-HIV_Chain | 4303 | 11945, 19587, 27229, 34871, 42513, 50155, 57797 |
| anti-HIV_Chain | 4304 | 11946, 19588, 27230, 34872, 42514, 50156, 57798 |
| anti-HIV_Chain | 4305 | 11947, 19589, 27231, 34873, 42515, 50157, 57799 |
| anti-HIV_Chain | 4306 | 11948, 19590, 27232, 34874, 42516, 50158, 57800 |
| anti-HIV_Chain | 4307 | 11949, 19591, 27233, 34875, 42517, 50159, 57801 |
| anti-HIV_Chain | 4308 | 11950, 19592, 27234, 34876, 42518, 50160, 57802 |
| anti-HIV_Chain | 4309 | 11951, 19593, 27235, 34877, 42519, 50161, 57803 |
| anti-HIV_Chain | 4310 | 11952, 19594, 27236, 34878, 42520, 50162, 57804 |
| anti-HIV_Chain | 4311 | 11953, 19595, 27237, 34879, 42521, 50163, 57805 |
| anti-HIV_Chain | 4312 | 11954, 19596, 27238, 34880, 42522, 50164, 57806 |
| anti-HIV_Chain | 4313 | 11955, 19597, 27239, 34881, 42523, 50165, 57807 |
| anti-HIV_Chain | 4314 | 11956, 19598, 27240, 34882, 42524, 50166, 57808 |
| anti-HIV_Chain | 4315 | 11957, 19599, 27241, 34883, 42525, 50167, 57809 |
| anti-HIV_Chain | 4316 | 11958, 19600, 27242, 34884, 42526, 50168, 57810 |
| anti-HIV_Chain | 4317 | 11959, 19601, 27243, 34885, 42527, 50169, 57811 |
| anti-HIV_Chain | 4318 | 11960, 19602, 27244, 34886, 42528, 50170, 57812 |
| anti-HIV_Chain | 4319 | 11961, 19603, 27245, 34887, 42529, 50171, 57813 |
| anti-HIV_Chain | 4320 | 11962, 19604, 27246, 34888, 42530, 50172, 57814 |
| anti-HIV_Chain | 4321 | 11963, 19605, 27247, 34889, 42531, 50173, 57815 |
| anti-HIV_Chain | 4322 | 11964, 19606, 27248, 34890, 42532, 50174, 57816 |
| anti-HIV_Chain | 4323 | 11965, 19607, 27249, 34891, 42533, 50175, 57817 |
| anti-HIV_Chain | 4324 | 11966, 19608, 27250, 34892, 42534, 50176, 57818 |
| anti-HIV_Chain | 4325 | 11967, 19609, 27251, 34893, 42535, 50177, 57819 |
| anti-HIV_Chain | 4326 | 11968, 19610, 27252, 34894, 42536, 50178, 57820 |
| anti-HIV_Chain | 4327 | 11969, 19611, 27253, 34895, 42537, 50179, 57821 |
| anti-HIV_Chain | 4328 | 11970, 19612, 27254, 34896, 42538, 50180, 57822 |

TABLE 3-continued

RNA and amino acid sequences of exemplified antibodies

| Name | Protein SEQ ID NO | RNA SEQ ID NO |
| --- | --- | --- |
| anti-HIV_Chain | 4329 | 11971, 19613, 27255, 34897, 42539, 50181, 57823 |
| anti-HIV_Chain | 4330 | 11972, 19614, 27256, 34898, 42540, 50182, 57824 |
| anti-HIV_Chain | 4331 | 11973, 19615, 27257, 34899, 42541, 50183, 57825 |
| anti-HIV_Chain | 4332 | 11974, 19616, 27258, 34900, 42542, 50184, 57826 |
| anti-HIV_Chain | 4333 | 11975, 19617, 27259, 34901, 42543, 50185, 57827 |
| anti-HIV_Chain | 4334 | 11976, 19618, 27260, 34902, 42544, 50186, 57828 |
| anti-HIV_Chain | 4335 | 11977, 19619, 27261, 34903, 42545, 50187, 57829 |
| anti-HIV_Chain | 4336 | 11978, 19620, 27262, 34904, 42546, 50188, 57830 |
| anti-HIV_Chain | 4337 | 11979, 19621, 27263, 34905, 42547, 50189, 57831 |
| anti-HIV_Chain | 4338 | 11980, 19622, 27264, 34906, 42548, 50190, 57832 |
| anti-HIV_Chain | 4339 | 11981, 19623, 27265, 34907, 42549, 50191, 57833 |
| anti-HIV_Chain | 4340 | 11982, 19624, 27266, 34908, 42550, 50192, 57834 |
| anti-HIV_Chain | 4341 | 11983, 19625, 27267, 34909, 42551, 50193, 57835 |
| anti-HIV_Chain | 4342 | 11984, 19626, 27268, 34910, 42552, 50194, 57836 |
| anti-HIV_Chain | 4343 | 11985, 19627, 27269, 34911, 42553, 50195, 57837 |
| anti-HIV_Chain | 4344 | 11986, 19628, 27270, 34912, 42554, 50196, 57838 |
| anti-HIV_Chain | 4345 | 11987, 19629, 27271, 34913, 42555, 50197, 57839 |
| anti-HIV_Chain | 4346 | 11988, 19630, 27272, 34914, 42556, 50198, 57840 |
| anti-HIV_Chain | 4347 | 11989, 19631, 27273, 34915, 42557, 50199, 57841 |
| anti-HIV_Chain | 4348 | 11990, 19632, 27274, 34916, 42558, 50200, 57842 |
| anti-HIV_Chain | 4349 | 11991, 19633, 27275, 34917, 42559, 50201, 57843 |
| anti-HIV_Chain | 4350 | 11992, 19634, 27276, 34918, 42560, 50202, 57844 |
| anti-HIV_Chain | 4351 | 11993, 19635, 27277, 34919, 42561, 50203, 57845 |
| anti-HIV_Chain | 4352 | 11994, 19636, 27278, 34920, 42562, 50204, 57846 |
| anti-HIV_Chain | 4353 | 11995, 19637, 27279, 34921, 42563, 50205, 57847 |
| anti-HIV_Chain | 4354 | 11996, 19638, 27280, 34922, 42564, 50206, 57848 |
| anti-HIV_Chain | 4355 | 11997, 19639, 27281, 34923, 42565, 50207, 57849 |
| anti-HIV_Chain | 4356 | 11998, 19640, 27282, 34924, 42566, 50208, 57850 |
| anti-HIV_Chain | 4357 | 11999, 19641, 27283, 34925, 42567, 50209, 57851 |
| anti-HIV_Chain | 4358 | 12000, 19642, 27284, 34926, 42568, 50210, 57852 |
| anti-HIV_Chain | 4359 | 12001, 19643, 27285, 34927, 42569, 50211, 57853 |
| anti-HIV_Chain | 4360 | 12002, 19644, 27286, 34928, 42570, 50212, 57854 |
| anti-HIV_Chain | 4361 | 12003, 19645, 27287, 34929, 42571, 50213, 57855 |
| anti-HIV_Chain | 4362 | 12004, 19646, 27288, 34930, 42572, 50214, 57856 |
| anti-HIV_Chain | 4363 | 12005, 19647, 27289, 34931, 42573, 50215, 57857 |
| anti-HIV_Chain | 4364 | 12006, 19648, 27290, 34932, 42574, 50216, 57858 |
| anti-HIV_Chain | 4365 | 12007, 19649, 27291, 34933, 42575, 50217, 57859 |
| anti-HIV_Chain | 4366 | 12008, 19650, 27292, 34934, 42576, 50218, 57860 |
| anti-HIV_Chain | 4367 | 12009, 19651, 27293, 34935, 42577, 50219, 57861 |
| anti-HIV_Chain | 4368 | 12010, 19652, 27294, 34936, 42578, 50220, 57862 |
| anti-HIV_Chain | 4369 | 12011, 19653, 27295, 34937, 42579, 50221, 57863 |
| anti-HIV_Chain | 4370 | 12012, 19654, 27296, 34938, 42580, 50222, 57864 |
| anti-HIV_Chain | 4371 | 12013, 19655, 27297, 34939, 42581, 50223, 57865 |
| anti-HIV_Chain | 4372 | 12014, 19656, 27298, 34940, 42582, 50224, 57866 |
| anti-HIV_Chain | 4373 | 12015, 19657, 27299, 34941, 42583, 50225, 57867 |
| anti-HIV_Chain | 4374 | 12016, 19658, 27300, 34942, 42584, 50226, 57868 |
| anti-HIV_Chain | 4375 | 12017, 19659, 27301, 34943, 42585, 50227, 57869 |
| anti-HIV_Chain | 4376 | 12018, 19660, 27302, 34944, 42586, 50228, 57870 |
| anti-HIV_Chain | 4377 | 12019, 19661, 27303, 34945, 42587, 50229, 57871 |
| anti-HIV_Chain | 4378 | 12020, 19662, 27304, 34946, 42588, 50230, 57872 |
| anti-HIV_Chain | 4379 | 12021, 19663, 27305, 34947, 42589, 50231, 57873 |
| anti-HIV_Chain | 4380 | 12022, 19664, 27306, 34948, 42590, 50232, 57874 |
| anti-HIV_Chain | 4381 | 12023, 19665, 27307, 34949, 42591, 50233, 57875 |
| anti-HIV_Chain | 4382 | 12024, 19666, 27308, 34950, 42592, 50234, 57876 |
| anti-HIV_Chain | 4383 | 12025, 19667, 27309, 34951, 42593, 50235, 57877 |
| anti-HIV_Chain | 4384 | 12026, 19668, 27310, 34952, 42594, 50236, 57878 |
| anti-HIV_Chain | 4385 | 12027, 19669, 27311, 34953, 42595, 50237, 57879 |
| anti-HIV_Chain | 4386 | 12028, 19670, 27312, 34954, 42596, 50238, 57880 |
| anti-HIV_Chain | 4387 | 12029, 19671, 27313, 34955, 42597, 50239, 57881 |
| anti-HIV_Chain | 4388 | 12030, 19672, 27314, 34956, 42598, 50240, 57882 |
| anti-HIV_Chain | 4389 | 12031, 19673, 27315, 34957, 42599, 50241, 57883 |
| anti-HIV_Chain | 4390 | 12032, 19674, 27316, 34958, 42600, 50242, 57884 |
| anti-HIV_Chain | 4391 | 12033, 19675, 27317, 34959, 42601, 50243, 57885 |
| anti-HIV_Chain | 4392 | 12034, 19676, 27318, 34960, 42602, 50244, 57886 |
| anti-HIV_Chain | 4393 | 12035, 19677, 27319, 34961, 42603, 50245, 57887 |
| anti-HIV_Chain | 4394 | 12036, 19678, 27320, 34962, 42604, 50246, 57888 |
| anti-HIV_Chain | 4395 | 12037, 19679, 27321, 34963, 42605, 50247, 57889 |
| anti-HIV_Chain | 4396 | 12038, 19680, 27322, 34964, 42606, 50248, 57890 |
| anti-HIV_Chain | 4397 | 12039, 19681, 27323, 34965, 42607, 50249, 57891 |
| anti-HIV_Chain | 4398 | 12040, 19682, 27324, 34966, 42608, 50250, 57892 |
| anti-HIV_Chain | 4399 | 12041, 19683, 27325, 34967, 42609, 50251, 57893 |
| anti-HIV_Chain | 4400 | 12042, 19684, 27326, 34968, 42610, 50252, 57894 |
| anti-HIV_Chain | 4401 | 12043, 19685, 27327, 34969, 42611, 50253, 57895 |
| anti-HIV_Chain | 4402 | 12044, 19686, 27328, 34970, 42612, 50254, 57896 |
| anti-HIV_Chain | 4403 | 12045, 19687, 27329, 34971, 42613, 50255, 57897 |
| anti-HIV_Chain | 4404 | 12046, 19688, 27330, 34972, 42614, 50256, 57898 |

TABLE 3-continued

RNA and amino acid sequences of exemplified antibodies

| Name | Protein SEQ ID NO | RNA SEQ ID NO |
|---|---|---|
| anti-HIV_Chain | 4405 | 12047, 19689, 27331, 34973, 42615, 50257, 57899 |
| anti-HIV_Chain | 4406 | 12048, 19690, 27332, 34974, 42616, 50258, 57900 |
| anti-HIV_Chain | 4407 | 12049, 19691, 27333, 34975, 42617, 50259, 57901 |
| anti-HIV_Chain | 4408 | 12050, 19692, 27334, 34976, 42618, 50260, 57902 |
| anti-HIV_Chain | 4409 | 12051, 19693, 27335, 34977, 42619, 50261, 57903 |
| anti-HIV_Chain | 4410 | 12052, 19694, 27336, 34978, 42620, 50262, 57904 |
| anti-HIV_Chain | 4411 | 12053, 19695, 27337, 34979, 42621, 50263, 57905 |
| anti-HIV_Chain | 4412 | 12054, 19696, 27338, 34980, 42622, 50264, 57906 |
| anti-HIV_Chain | 4413 | 12055, 19697, 27339, 34981, 42623, 50265, 57907 |
| anti-HIV_Chain | 4414 | 12056, 19698, 27340, 34982, 42624, 50266, 57908 |
| anti-HIV_Chain | 4415 | 12057, 19699, 27341, 34983, 42625, 50267, 57909 |
| anti-HIV_Chain | 4416 | 12058, 19700, 27342, 34984, 42626, 50268, 57910 |
| anti-HIV_Chain | 4417 | 12059, 19701, 27343, 34985, 42627, 50269, 57911 |
| anti-HIV_Chain | 4418 | 12060, 19702, 27344, 34986, 42628, 50270, 57912 |
| anti-HIV_Chain | 4419 | 12061, 19703, 27345, 34987, 42629, 50271, 57913 |
| anti-HIV_Chain | 4420 | 12062, 19704, 27346, 34988, 42630, 50272, 57914 |
| anti-HIV_Chain | 4421 | 12063, 19705, 27347, 34989, 42631, 50273, 57915 |
| anti-HIV_Chain | 4422 | 12064, 19706, 27348, 34990, 42632, 50274, 57916 |
| anti-HIV_Chain | 4423 | 12065, 19707, 27349, 34991, 42633, 50275, 57917 |
| anti-HIV_Chain | 4424 | 12066, 19708, 27350, 34992, 42634, 50276, 57918 |
| anti-HIV_Chain | 4425 | 12067, 19709, 27351, 34993, 42635, 50277, 57919 |
| anti-HIV_Chain | 4426 | 12068, 19710, 27352, 34994, 42636, 50278, 57920 |
| anti-HIV_Chain | 4427 | 12069, 19711, 27353, 34995, 42637, 50279, 57921 |
| anti-HIV_Chain | 4428 | 12070, 19712, 27354, 34996, 42638, 50280, 57922 |
| anti-HIV_Chain | 4429 | 12071, 19713, 27355, 34997, 42639, 50281, 57923 |
| anti-HIV_Chain | 4430 | 12072, 19714, 27356, 34998, 42640, 50282, 57924 |
| anti-HIV_Chain | 4431 | 12073, 19715, 27357, 34999, 42641, 50283, 57925 |
| anti-HIV_Chain | 4432 | 12074, 19716, 27358, 35000, 42642, 50284, 57926 |
| anti-HIV_Chain | 4433 | 12075, 19717, 27359, 35001, 42643, 50285, 57927 |
| anti-HIV_Chain | 4434 | 12076, 19718, 27360, 35002, 42644, 50286, 57928 |
| anti-HIV_Chain | 4435 | 12077, 19719, 27361, 35003, 42645, 50287, 57929 |
| anti-HIV_Chain | 4436 | 12078, 19720, 27362, 35004, 42646, 50288, 57930 |
| anti-HIV_Chain | 4437 | 12079, 19721, 27363, 35005, 42647, 50289, 57931 |
| anti-HIV_Chain | 4438 | 12080, 19722, 27364, 35006, 42648, 50290, 57932 |
| anti-HIV_Chain | 4439 | 12081, 19723, 27365, 35007, 42649, 50291, 57933 |
| anti-HIV_Chain | 4440 | 12082, 19724, 27366, 35008, 42650, 50292, 57934 |
| anti-HIV_Chain | 4441 | 12083, 19725, 27367, 35009, 42651, 50293, 57935 |
| anti-HIV_Chain | 4442 | 12084, 19726, 27368, 35010, 42652, 50294, 57936 |
| anti-HIV_Chain | 4443 | 12085, 19727, 27369, 35011, 42653, 50295, 57937 |
| anti-HIV_Chain | 4444 | 12086, 19728, 27370, 35012, 42654, 50296, 57938 |
| anti-HIV_Chain | 4445 | 12087, 19729, 27371, 35013, 42655, 50297, 57939 |
| anti-HIV_Chain | 4446 | 12088, 19730, 27372, 35014, 42656, 50298, 57940 |
| anti-HIV_Chain | 4447 | 12089, 19731, 27373, 35015, 42657, 50299, 57941 |
| anti-HIV_Chain | 4448 | 12090, 19732, 27374, 35016, 42658, 50300, 57942 |
| anti-HIV_Chain | 4449 | 12091, 19733, 27375, 35017, 42659, 50301, 57943 |
| anti-HIV_Chain | 4450 | 12092, 19734, 27376, 35018, 42660, 50302, 57944 |
| anti-HIV_Chain | 4451 | 12093, 19735, 27377, 35019, 42661, 50303, 57945 |
| anti-HIV_Chain | 4452 | 12094, 19736, 27378, 35020, 42662, 50304, 57946 |
| anti-HIV_Chain | 4453 | 12095, 19737, 27379, 35021, 42663, 50305, 57947 |
| anti-HIV_Chain | 4454 | 12096, 19738, 27380, 35022, 42664, 50306, 57948 |
| anti-HIV_Chain | 4455 | 12097, 19739, 27381, 35023, 42665, 50307, 57949 |
| anti-HIV_Chain | 4456 | 12098, 19740, 27382, 35024, 42666, 50308, 57950 |
| anti-HIV_Chain | 4457 | 12099, 19741, 27383, 35025, 42667, 50309, 57951 |
| anti-HIV_Chain | 4458 | 12100, 19742, 27384, 35026, 42668, 50310, 57952 |
| anti-HIV_Chain | 4459 | 12101, 19743, 27385, 35027, 42669, 50311, 57953 |
| anti-HIV_Chain | 4460 | 12102, 19744, 27386, 35028, 42670, 50312, 57954 |
| anti-HIV_Chain | 4461 | 12103, 19745, 27387, 35029, 42671, 50313, 57955 |
| anti-HIV_Chain | 4462 | 12104, 19746, 27388, 35030, 42672, 50314, 57956 |
| anti-HIV_Chain | 4463 | 12105, 19747, 27389, 35031, 42673, 50315, 57957 |
| anti-HIV_Chain | 4464 | 12106, 19748, 27390, 35032, 42674, 50316, 57958 |
| anti-HIV_Chain | 4465 | 12107, 19749, 27391, 35033, 42675, 50317, 57959 |
| anti-HIV_Chain | 4466 | 12108, 19750, 27392, 35034, 42676, 50318, 57960 |
| anti-HIV_Chain | 4467 | 12109, 19751, 27393, 35035, 42677, 50319, 57961 |
| anti-HIV_Chain | 4468 | 12110, 19752, 27394, 35036, 42678, 50320, 57962 |
| anti-HIV_Chain | 4469 | 12111, 19753, 27395, 35037, 42679, 50321, 57963 |
| anti-HIV_Chain | 4470 | 12112, 19754, 27396, 35038, 42680, 50322, 57964 |
| anti-HIV_Chain | 4471 | 12113, 19755, 27397, 35039, 42681, 50323, 57965 |
| anti-HIV_LightChain | 4472 | 12114, 19756, 27398, 35040, 42682, 50324, 57966 |
| anti-HIV_Chain | 4473 | 12115, 19757, 27399, 35041, 42683, 50325, 57967 |
| anti-HIV_Chain | 4474 | 12116, 19758, 27400, 35042, 42684, 50326, 57968 |
| anti-HIV_Chain | 4475 | 12117, 19759, 27401, 35043, 42685, 50327, 57969 |
| anti-HIV_Chain | 4476 | 12118, 19760, 27402, 35044, 42686, 50328, 57970 |
| anti-HIV_Chain | 4477 | 12119, 19761, 27403, 35045, 42687, 50329, 57971 |
| anti-HIV_Chain | 4478 | 12120, 19762, 27404, 35046, 42688, 50330, 57972 |
| anti-HIV_Chain | 4479 | 12121, 19763, 27405, 35047, 42689, 50331, 57973 |
| anti-HIV_Chain | 4480 | 12122, 19764, 27406, 35048, 42690, 50332, 57974 |

TABLE 3-continued

RNA and amino acid sequences of exemplified antibodies

| Name | Protein SEQ ID NO | RNA SEQ ID NO |
|---|---|---|
| anti-HIV_Chain | 4481 | 12123, 19765, 27407, 35049, 42691, 50333, 57975 |
| anti-HIV_Chain | 4482 | 12124, 19766, 27408, 35050, 42692, 50334, 57976 |
| anti-HIV_Chain | 4483 | 12125, 19767, 27409, 35051, 42693, 50335, 57977 |
| anti-HIV_Chain | 4484 | 12126, 19768, 27410, 35052, 42694, 50336, 57978 |
| anti-HIV_Chain | 4485 | 12127, 19769, 27411, 35053, 42695, 50337, 57979 |
| anti-HIV_Chain | 4486 | 12128, 19770, 27412, 35054, 42696, 50338, 57980 |
| anti-HIV_Chain | 4487 | 12129, 19771, 27413, 35055, 42697, 50339, 57981 |
| anti-HIV_Chain | 4488 | 12130, 19772, 27414, 35056, 42698, 50340, 57982 |
| anti-HIV_Chain | 4489 | 12131, 19773, 27415, 35057, 42699, 50341, 57983 |
| anti-HIV_Chain | 4490 | 12132, 19774, 27416, 35058, 42700, 50342, 57984 |
| anti-HIV_Chain | 4491 | 12133, 19775, 27417, 35059, 42701, 50343, 57985 |
| anti-HIV_Chain | 4492 | 12134, 19776, 27418, 35060, 42702, 50344, 57986 |
| anti-HIV_Chain | 4493 | 12135, 19777, 27419, 35061, 42703, 50345, 57987 |
| anti-HIV_Chain | 4494 | 12136, 19778, 27420, 35062, 42704, 50346, 57988 |
| anti-HIV_Chain | 4495 | 12137, 19779, 27421, 35063, 42705, 50347, 57989 |
| anti-HIV_Chain | 4496 | 12138, 19780, 27422, 35064, 42706, 50348, 57990 |
| anti-HIV_Chain | 4497 | 12139, 19781, 27423, 35065, 42707, 50349, 57991 |
| anti-HIV_Chain | 4498 | 12140, 19782, 27424, 35066, 42708, 50350, 57992 |
| anti-HIV_Chain | 4499 | 12141, 19783, 27425, 35067, 42709, 50351, 57993 |
| anti-HIV_Chain | 4500 | 12142, 19784, 27426, 35068, 42710, 50352, 57994 |
| anti-HIV_Chain | 4501 | 12143, 19785, 27427, 35069, 42711, 50353, 57995 |
| anti-HIV_Chain | 4502 | 12144, 19786, 27428, 35070, 42712, 50354, 57996 |
| anti-HIV_Chain | 4503 | 12145, 19787, 27429, 35071, 42713, 50355, 57997 |
| anti-HIV_Chain | 4504 | 12146, 19788, 27430, 35072, 42714, 50356, 57998 |
| anti-HIV_Chain | 4505 | 12147, 19789, 27431, 35073, 42715, 50357, 57999 |
| anti-HIV_Chain | 4506 | 12148, 19790, 27432, 35074, 42716, 50358, 58000 |
| anti-HIV_Chain | 4507 | 12149, 19791, 27433, 35075, 42717, 50359, 58001 |
| anti-HIV_Chain | 4508 | 12150, 19792, 27434, 35076, 42718, 50360, 58002 |
| anti-HIV_Chain | 4509 | 12151, 19793, 27435, 35077, 42719, 50361, 58003 |
| anti-HIV_Chain | 4510 | 12152, 19794, 27436, 35078, 42720, 50362, 58004 |
| anti-HIV_Chain | 4511 | 12153, 19795, 27437, 35079, 42721, 50363, 58005 |
| anti-HIV_Chain | 4512 | 12154, 19796, 27438, 35080, 42722, 50364, 58006 |
| anti-HIV_Chain | 4513 | 12155, 19797, 27439, 35081, 42723, 50365, 58007 |
| anti-HIV_Chain | 4514 | 12156, 19798, 27440, 35082, 42724, 50366, 58008 |
| anti-HIV_Chain | 4515 | 12157, 19799, 27441, 35083, 42725, 50367, 58009 |
| anti-HIV_Chain | 4516 | 12158, 19800, 27442, 35084, 42726, 50368, 58010 |
| anti-HIV_Chain | 4517 | 12159, 19801, 27443, 35085, 42727, 50369, 58011 |
| anti-HIV_Chain | 4518 | 12160, 19802, 27444, 35086, 42728, 50370, 58012 |
| anti-HIV_Chain | 4519 | 12161, 19803, 27445, 35087, 42729, 50371, 58013 |
| anti-HIV_Chain | 4520 | 12162, 19804, 27446, 35088, 42730, 50372, 58014 |
| anti-HIV_Chain | 4521 | 12163, 19805, 27447, 35089, 42731, 50373, 58015 |
| anti-HIV_Chain | 4522 | 12164, 19806, 27448, 35090, 42732, 50374, 58016 |
| anti-HIV_Chain | 4523 | 12165, 19807, 27449, 35091, 42733, 50375, 58017 |
| anti-HIV_Chain | 4524 | 12166, 19808, 27450, 35092, 42734, 50376, 58018 |
| anti-HIV_Chain | 4525 | 12167, 19809, 27451, 35093, 42735, 50377, 58019 |
| anti-HIV_Chain | 4526 | 12168, 19810, 27452, 35094, 42736, 50378, 58020 |
| anti-HIV_Chain | 4527 | 12169, 19811, 27453, 35095, 42737, 50379, 58021 |
| anti-HIV_Chain | 4528 | 12170, 19812, 27454, 35096, 42738, 50380, 58022 |
| anti-HIV_Chain | 4529 | 12171, 19813, 27455, 35097, 42739, 50381, 58023 |
| anti-HIV_Chain | 4530 | 12172, 19814, 27456, 35098, 42740, 50382, 58024 |
| anti-HIV_Chain | 4531 | 12173, 19815, 27457, 35099, 42741, 50383, 58025 |
| anti-HIV_Chain | 4532 | 12174, 19816, 27458, 35100, 42742, 50384, 58026 |
| anti-HIV_Chain | 4533 | 12175, 19817, 27459, 35101, 42743, 50385, 58027 |
| anti-HIV_Chain | 4534 | 12176, 19818, 27460, 35102, 42744, 50386, 58028 |
| anti-HIV_Chain | 4535 | 12177, 19819, 27461, 35103, 42745, 50387, 58029 |
| anti-HIV_Chain | 4536 | 12178, 19820, 27462, 35104, 42746, 50388, 58030 |
| anti-HIV_Chain | 4537 | 12179, 19821, 27463, 35105, 42747, 50389, 58031 |
| anti-HIV_Chain | 4538 | 12180, 19822, 27464, 35106, 42748, 50390, 58032 |
| anti-HIV_Chain | 4539 | 12181, 19823, 27465, 35107, 42749, 50391, 58033 |
| anti-HIV_Chain | 4540 | 12182, 19824, 27466, 35108, 42750, 50392, 58034 |
| anti-HIV_Chain | 4541 | 12183, 19825, 27467, 35109, 42751, 50393, 58035 |
| anti-HIV_Chain | 4542 | 12184, 19826, 27468, 35110, 42752, 50394, 58036 |
| anti-HIV_LightChain | 4543 | 12185, 19827, 27469, 35111, 42753, 50395, 58037 |
| anti-HIV_Chain | 4544 | 12186, 19828, 27470, 35112, 42754, 50396, 58038 |
| anti-HIV_Chain | 4545 | 12187, 19829, 27471, 35113, 42755, 50397, 58039 |
| anti-HIV_Chain | 4546 | 12188, 19830, 27472, 35114, 42756, 50398, 58040 |
| anti-HIV_Chain | 4547 | 12189, 19831, 27473, 35115, 42757, 50399, 58041 |
| anti-HIV_Chain | 4548 | 12190, 19832, 27474, 35116, 42758, 50400, 58042 |
| anti-HIV_Chain | 4549 | 12191, 19833, 27475, 35117, 42759, 50401, 58043 |
| anti-HIV_Chain | 4550 | 12192, 19834, 27476, 35118, 42760, 50402, 58044 |
| anti-HIV_Chain | 4551 | 12193, 19835, 27477, 35119, 42761, 50403, 58045 |
| anti-HIV_Chain | 4552 | 12194, 19836, 27478, 35120, 42762, 50404, 58046 |
| anti-HIV_Chain | 4553 | 12195, 19837, 27479, 35121, 42763, 50405, 58047 |
| anti-HIV_Chain | 4554 | 12196, 19838, 27480, 35122, 42764, 50406, 58048 |
| anti-HIV_Chain | 4555 | 12197, 19839, 27481, 35123, 42765, 50407, 58049 |
| anti-HIV_Chain | 4556 | 12198, 19840, 27482, 35124, 42766, 50408, 58050 |

TABLE 3-continued

RNA and amino acid sequences of exemplified antibodies

| Name | Protein SEQ ID NO | RNA SEQ ID NO |
| --- | --- | --- |
| anti-HIV_Chain | 4557 | 12199, 19841, 27483, 35125, 42767, 50409, 58051 |
| anti-HIV_Chain | 4558 | 12200, 19842, 27484, 35126, 42768, 50410, 58052 |
| anti-HIV_Chain | 4559 | 12201, 19843, 27485, 35127, 42769, 50411, 58053 |
| anti-HIV_Chain | 4560 | 12202, 19844, 27486, 35128, 42770, 50412, 58054 |
| anti-HIV_Chain | 4561 | 12203, 19845, 27487, 35129, 42771, 50413, 58055 |
| anti-HIV_Chain | 4562 | 12204, 19846, 27488, 35130, 42772, 50414, 58056 |
| anti-HIV_HeavyChain | 4563 | 12205, 19847, 27489, 35131, 42773, 50415, 58057 |
| anti-HIV_HeavyChain | 4564 | 12206, 19848, 27490, 35132, 42774, 50416, 58058 |
| anti-HIV_HeavyChain | 4565 | 12207, 19849, 27491, 35133, 42775, 50417, 58059 |
| anti-HIV_Chain | 4566 | 12208, 19850, 27492, 35134, 42776, 50418, 58060 |
| anti-HIV_Chain | 4567 | 12209, 19851, 27493, 35135, 42777, 50419, 58061 |
| anti-HIV_Chain | 4568 | 12210, 19852, 27494, 35136, 42778, 50420, 58062 |
| anti-HIV_Chain | 4569 | 12211, 19853, 27495, 35137, 42779, 50421, 58063 |
| anti-HIV_Chain | 4570 | 12212, 19854, 27496, 35138, 42780, 50422, 58064 |
| anti-HIV_Chain | 4571 | 12213, 19855, 27497, 35139, 42781, 50423, 58065 |
| anti-HIV_Chain | 4572 | 12214, 19856, 27498, 35140, 42782, 50424, 58066 |
| anti-HIV_Chain | 4573 | 12215, 19857, 27499, 35141, 42783, 50425, 58067 |
| anti-HIV_Chain | 4574 | 12216, 19858, 27500, 35142, 42784, 50426, 58068 |
| anti-HIV_HeavyChain | 4575 | 12217, 19859, 27501, 35143, 42785, 50427, 58069 |
| anti-HIV_HeavyChain | 4576 | 12218, 19860, 27502, 35144, 42786, 50428, 58070 |
| anti-HIV_HeavyChain | 4577 | 12219, 19861, 27503, 35145, 42787, 50429, 58071 |
| anti-HIV_HeavyChain | 4578 | 12220, 19862, 27504, 35146, 42788, 50430, 58072 |
| anti-HIV_HeavyChain | 4579 | 12221, 19863, 27505, 35147, 42789, 50431, 58073 |
| anti-HIV_HeavyChain | 4580 | 12222, 19864, 27506, 35148, 42790, 50432, 58074 |
| anti-HIV_HeavyChain | 4581 | 12223, 19865, 27507, 35149, 42791, 50433, 58075 |
| anti-HIV_HeavyChain | 4582 | 12224, 19866, 27508, 35150, 42792, 50434, 58076 |
| anti-HIV_HeavyChain | 4583 | 12225, 19867, 27509, 35151, 42793, 50435, 58077 |
| anti-HIV_HeavyChain | 4584 | 12226, 19868, 27510, 35152, 42794, 50436, 58078 |
| anti-HIV_HeavyChain | 4585 | 12227, 19869, 27511, 35153, 42795, 50437, 58079 |
| anti-HIV_HeavyChain | 4586 | 12228, 19870, 27512, 35154, 42796, 50438, 58080 |
| anti-HIV_HeavyChain | 4587 | 12229, 19871, 27513, 35155, 42797, 50439, 58081 |
| anti-HIV_Chain | 4588 | 12230, 19872, 27514, 35156, 42798, 50440, 58082 |
| anti-HIV_Chain | 4589 | 12231, 19873, 27515, 35157, 42799, 50441, 58083 |
| anti-HIV_Chain | 4590 | 12232, 19874, 27516, 35158, 42800, 50442, 58084 |
| anti-HIV_Chain | 4591 | 12233, 19875, 27517, 35159, 42801, 50443, 58085 |
| anti-HIV_Chain | 4592 | 12234, 19876, 27518, 35160, 42802, 50444, 58086 |
| anti-HIV_Chain | 4593 | 12235, 19877, 27519, 35161, 42803, 50445, 58087 |
| anti-HIV_Chain | 4594 | 12236, 19878, 27520, 35162, 42804, 50446, 58088 |
| anti-HIV_Chain | 4595 | 12237, 19879, 27521, 35163, 42805, 50447, 58089 |
| anti-HIV_Chain | 4596 | 12238, 19880, 27522, 35164, 42806, 50448, 58090 |
| anti-HIV_Chain | 4597 | 12239, 19881, 27523, 35165, 42807, 50449, 58091 |
| anti-HIV_Chain | 4598 | 12240, 19882, 27524, 35166, 42808, 50450, 58092 |
| anti-HIV_Chain | 4599 | 12241, 19883, 27525, 35167, 42809, 50451, 58093 |
| anti-HIV_Chain | 4600 | 12242, 19884, 27526, 35168, 42810, 50452, 58094 |
| anti-HIV_Chain | 4601 | 12243, 19885, 27527, 35169, 42811, 50453, 58095 |
| anti-HIV_Chain | 4602 | 12244, 19886, 27528, 35170, 42812, 50454, 58096 |
| anti-HIV_Chain | 4603 | 12245, 19887, 27529, 35171, 42813, 50455, 58097 |
| anti-HIV_Chain | 4604 | 12246, 19888, 27530, 35172, 42814, 50456, 58098 |
| anti-HIV_Chain | 4605 | 12247, 19889, 27531, 35173, 42815, 50457, 58099 |
| anti-HIV_Chain | 4606 | 12248, 19890, 27532, 35174, 42816, 50458, 58100 |
| anti-HIV_HeavyChain | 4607 | 12249, 19891, 27533, 35175, 42817, 50459, 58101 |
| anti-HIV_HeavyChain | 4608 | 12250, 19892, 27534, 35176, 42818, 50460, 58102 |
| anti-HIV_Chain | 4609 | 12251, 19893, 27535, 35177, 42819, 50461, 58103 |
| anti-HIV_Chain | 4610 | 12252, 19894, 27536, 35178, 42820, 50462, 58104 |
| anti-HIV_Chain | 4611 | 12253, 19895, 27537, 35179, 42821, 50463, 58105 |
| anti-HIV_Chain | 4612 | 12254, 19896, 27538, 35180, 42822, 50464, 58106 |
| anti-HIV_Chain | 4613 | 12255, 19897, 27539, 35181, 42823, 50465, 58107 |
| anti-HIV_Chain | 4614 | 12256, 19898, 27540, 35182, 42824, 50466, 58108 |
| anti-HIV_HeavyChain | 4615 | 12257, 19899, 27541, 35183, 42825, 50467, 58109 |
| anti-HIV_HeavyChain | 4616 | 12258, 19900, 27542, 35184, 42826, 50468, 58110 |
| anti-HIV_Chain | 4617 | 12259, 19901, 27543, 35185, 42827, 50469, 58111 |
| anti-HIV_Chain | 4618 | 12260, 19902, 27544, 35186, 42828, 50470, 58112 |
| anti-HIV_Chain | 4619 | 12261, 19903, 27545, 35187, 42829, 50471, 58113 |
| anti-HIV_Chain | 4620 | 12262, 19904, 27546, 35188, 42830, 50472, 58114 |
| anti-HIV_Chain | 4621 | 12263, 19905, 27547, 35189, 42831, 50473, 58115 |
| anti-HIV_Chain | 4622 | 12264, 19906, 27548, 35190, 42832, 50474, 58116 |
| anti-HIV_Chain | 4623 | 12265, 19907, 27549, 35191, 42833, 50475, 58117 |
| anti-HIV_Chain | 4624 | 12266, 19908, 27550, 35192, 42834, 50476, 58118 |
| anti-HIV_LightChain | 4625 | 12267, 19909, 27551, 35193, 42835, 50477, 58119 |
| anti-HIV_Chain | 4626 | 12268, 19910, 27552, 35194, 42836, 50478, 58120 |
| anti-HIV_Chain | 4627 | 12269, 19911, 27553, 35195, 42837, 50479, 58121 |
| anti-HIV_SingleChain | 4628 | 12270, 19912, 27554, 35196, 42838, 50480, 58122 |
| anti-HIV_LightChain | 4629 | 12271, 19913, 27555, 35197, 42839, 50481, 58123 |
| anti-HIV_Chain | 4630 | 12272, 19914, 27556, 35198, 42840, 50482, 58124 |
| anti-HIV_Chain | 4631 | 12273, 19915, 27557, 35199, 42841, 50483, 58125 |
| anti-influenza_Fab | 4632 | 12274, 19916, 27558, 35200, 42842, 50484, 58126 |

TABLE 3-continued

RNA and amino acid sequences of exemplified antibodies

| Name | Protein SEQ ID NO | RNA SEQ ID NO |
|---|---|---|
| anti-influenza_Fab | 4633 | 12275, 19917, 27559, 35201, 42843, 50485, 58127 |
| anti-influenza_Fab | 4634 | 12276, 19918, 27560, 35202, 42844, 50486, 58128 |
| anti-influenza_Fab | 4635 | 12277, 19919, 27561, 35203, 42845, 50487, 58129 |
| anti-influenza_Fab | 4636 | 12278, 19920, 27562, 35204, 42846, 50488, 58130 |
| anti-influenza_Fab | 4637 | 12279, 19921, 27563, 35205, 42847, 50489, 58131 |
| anti-influenza_Fab | 4638 | 12280, 19922, 27564, 35206, 42848, 50490, 58132 |
| anti-influenza_Apo | 4639 | 12281, 19923, 27565, 35207, 42849, 50491, 58133 |
| anti-influenza_Apo | 4640 | 12282, 19924, 27566, 35208, 42850, 50492, 58134 |
| anti-influenza-A_kappa_LightChain_V-Region | 4641 | 12283, 19925, 27567, 35209, 42851, 50493, 58135 |
| anti-influenza-A_kappa_LightChain_V-Region | 4642 | 12284, 19926, 27568, 35210, 42852, 50494, 58136 |
| anti-influenza-A_kappa_LightChain_V-Region | 4643 | 12285, 19927, 27569, 35211, 42853, 50495, 58137 |
| anti-influenza-A_kappa_LightChain_V-Region | 4644 | 12286, 19928, 27570, 35212, 42854, 50496, 58138 |
| anti-influenza-A_kappa_LightChain_V-Region | 4645 | 12287, 19929, 27571, 35213, 42855, 50497, 58139 |
| anti-influenza-A_kappa_LightChain_V-Region | 4646 | 12288, 19930, 27572, 35214, 42856, 50498, 58140 |
| anti-influenza-A_HeavyChain_V-Region | 4647 | 12289, 19931, 27573, 35215, 42857, 50499, 58141 |
| anti-influenza-A_HeavyChain_V-Region | 4648 | 12290, 19932, 27574, 35216, 42858, 50500, 58142 |
| anti-influenza-A_HeavyChain_V-Region | 4649 | 12291, 19933, 27575, 35217, 42859, 50501, 58143 |
| anti-influenza-A_HeavyChain_V-Region | 4650 | 12292, 19934, 27576, 35218, 42860, 50502, 58144 |
| anti-influenza-A_HeavyChain_V-Region | 4651 | 12293, 19935, 27577, 35219, 42861, 50503, 58145 |
| anti-influenza-A_HeavyChain_V-Region | 4652 | 12294, 19936, 27578, 35220, 42862, 50504, 58146 |
| anti-influenza-A_HeavyChain_V-Region | 4653 | 12295, 19937, 27579, 35221, 42863, 50505, 58147 |
| anti-influenza-A_LightChain_V-Region | 4654 | 12296, 19938, 27580, 35222, 42864, 50506, 58148 |
| anti-influenza-A_HeavyChain_V-Region | 4655 | 12297, 19939, 27581, 35223, 42865, 50507, 58149 |
| anti-influenza_Chain | 4656 | 12298, 19940, 27582, 35224, 42866, 50508, 58150 |
| anti-influenza_Chain | 4657 | 12299, 19941, 27583, 35225, 42867, 50509, 58151 |
| anti-influenza_Chain | 4658 | 12300, 19942, 27584, 35226, 42868, 50510, 58152 |
| anti-influenza_Chain | 4659 | 12301, 19943, 27585, 35227, 42869, 50511, 58153 |
| anti-influenza_Chain | 4660 | 12302, 19944, 27586, 35228, 42870, 50512, 58154 |
| anti-influenza_Chain | 4661 | 12303, 19945, 27587, 35229, 42871, 50513, 58155 |
| anti-influenza_Chain | 4662 | 12304, 19946, 27588, 35230, 42872, 50514, 58156 |
| anti-influenza_Chain | 4663 | 12305, 19947, 27589, 35231, 42873, 50515, 58157 |
| anti-influenza_Chain | 4664 | 12306, 19948, 27590, 35232, 42874, 50516, 58158 |
| anti-influenza_Chain | 4665 | 12307, 19949, 27591, 35233, 42875, 50517, 58159 |
| anti-influenza_Chain | 4666 | 12308, 19950, 27592, 35234, 42876, 50518, 58160 |
| anti-influenza_Chain | 4667 | 12309, 19951, 27593, 35235, 42877, 50519, 58161 |
| anti-influenza_Chain | 4668 | 12310, 19952, 27594, 35236, 42878, 50520, 58162 |
| anti-influenza_Chain | 4669 | 12311, 19953, 27595, 35237, 42879, 50521, 58163 |
| anti-influenza_Chain | 4670 | 12312, 19954, 27596, 35238, 42880, 50522, 58164 |
| anti-influenza_Chain | 4671 | 12313, 19955, 27597, 35239, 42881, 50523, 58165 |
| anti-influenza_Chain | 4672 | 12314, 19956, 27598, 35240, 42882, 50524, 58166 |
| anti-influenza_Chain | 4673 | 12315, 19957, 27599, 35241, 42883, 50525, 58167 |
| anti-influenza_Chain | 4674 | 12316, 19958, 27600, 35242, 42884, 50526, 58168 |
| anti-influenza_Chain | 4675 | 12317, 19959, 27601, 35243, 42885, 50527, 58169 |
| anti-influenza_Chain | 4676 | 12318, 19960, 27602, 35244, 42886, 50528, 58170 |
| anti-influenza_Chain | 4677 | 12319, 19961, 27603, 35245, 42887, 50529, 58171 |
| anti-influenza_Chain | 4678 | 12320, 19962, 27604, 35246, 42888, 50530, 58172 |
| anti-influenza_Chain | 4679 | 12321, 19963, 27605, 35247, 42889, 50531, 58173 |
| anti-influenza_Chain | 4680 | 12322, 19964, 27606, 35248, 42890, 50532, 58174 |
| anti-influenza_Chain | 4681 | 12323, 19965, 27607, 35249, 42891, 50533, 58175 |
| anti-influenza_Chain | 4682 | 12324, 19966, 27608, 35250, 42892, 50534, 58176 |
| anti-influenza_Chain | 4683 | 12325, 19967, 27609, 35251, 42893, 50535, 58177 |
| anti-influenza_Chain | 4684 | 12326, 19968, 27610, 35252, 42894, 50536, 58178 |
| anti-influenza_Chain | 4685 | 12327, 19969, 27611, 35253, 42895, 50537, 58179 |
| anti-influenza_Chain | 4686 | 12328, 19970, 27612, 35254, 42896, 50538, 58180 |
| anti-influenza_Chain | 4687 | 12329, 19971, 27613, 35255, 42897, 50539, 58181 |
| anti-influenza_Chain | 4688 | 12330, 19972, 27614, 35256, 42898, 50540, 58182 |
| anti-influenza_Chain | 4689 | 12331, 19973, 27615, 35257, 42899, 50541, 58183 |
| anti-influenza_Chain | 4690 | 12332, 19974, 27616, 35258, 42900, 50542, 58184 |
| anti-influenza_Chain | 4691 | 12333, 19975, 27617, 35259, 42901, 50543, 58185 |
| anti-influenza_Chain | 4692 | 12334, 19976, 27618, 35260, 42902, 50544, 58186 |
| anti-influenza_Chain | 4693 | 12335, 19977, 27619, 35261, 42903, 50545, 58187 |
| anti-influenza_Chain | 4694 | 12336, 19978, 27620, 35262, 42904, 50546, 58188 |
| anti-influenza_Chain | 4695 | 12337, 19979, 27621, 35263, 42905, 50547, 58189 |
| anti-influenza_Chain | 4696 | 12338, 19980, 27622, 35264, 42906, 50548, 58190 |
| anti-influenza_Chain | 4697 | 12339, 19981, 27623, 35265, 42907, 50549, 58191 |
| anti-influenza_Chain | 4698 | 12340, 19982, 27624, 35266, 42908, 50550, 58192 |
| anti-influenza_Chain | 4699 | 12341, 19983, 27625, 35267, 42909, 50551, 58193 |
| anti-influenza_Chain | 4700 | 12342, 19984, 27626, 35268, 42910, 50552, 58194 |
| anti-influenza_Chain | 4701 | 12343, 19985, 27627, 35269, 42911, 50553, 58195 |
| anti-influenza_Chain | 4702 | 12344, 19986, 27628, 35270, 42912, 50554, 58196 |
| anti-influenza_Chain | 4703 | 12345, 19987, 27629, 35271, 42913, 50555, 58197 |
| anti-influenza_Chain | 4704 | 12346, 19988, 27630, 35272, 42914, 50556, 58198 |
| anti-influenza_Chain | 4705 | 12347, 19989, 27631, 35273, 42915, 50557, 58199 |
| anti-influenza_Chain | 4706 | 12348, 19990, 27632, 35274, 42916, 50558, 58200 |
| anti-influenza_Chain | 4707 | 12349, 19991, 27633, 35275, 42917, 50559, 58201 |
| anti-influenza_Chain | 4708 | 12350, 19992, 27634, 35276, 42918, 50560, 58202 |

TABLE 3-continued

RNA and amino acid sequences of exemplified antibodies

| Name | Protein SEQ ID NO | RNA SEQ ID NO |
| --- | --- | --- |
| anti-influenza_Chain | 4709 | 12351, 19993, 27635, 35277, 42919, 50561, 58203 |
| anti-influenza_Chain | 4710 | 12352, 19994, 27636, 35278, 42920, 50562, 58204 |
| anti-influenza_Chain | 4711 | 12353, 19995, 27637, 35279, 42921, 50563, 58205 |
| anti-influenza_Chain | 4712 | 12354, 19996, 27638, 35280, 42922, 50564, 58206 |
| anti-influenza_Chain | 4713 | 12355, 19997, 27639, 35281, 42923, 50565, 58207 |
| anti-influenza_Chain | 4714 | 12356, 19998, 27640, 35282, 42924, 50566, 58208 |
| anti-influenza_Chain | 4715 | 12357, 19999, 27641, 35283, 42925, 50567, 58209 |
| anti-influenza_Chain | 4716 | 12358, 20000, 27642, 35284, 42926, 50568, 58210 |
| anti-influenza_Chain | 4717 | 12359, 20001, 27643, 35285, 42927, 50569, 58211 |
| anti-influenza_Chain | 4718 | 12360, 20002, 27644, 35286, 42928, 50570, 58212 |
| anti-influenza_Chain | 4719 | 12361, 20003, 27645, 35287, 42929, 50571, 58213 |
| anti-influenza_Chain | 4720 | 12362, 20004, 27646, 35288, 42930, 50572, 58214 |
| anti-influenza_Chain | 4721 | 12363, 20005, 27647, 35289, 42931, 50573, 58215 |
| anti-influenza_Chain | 4722 | 12364, 20006, 27648, 35290, 42932, 50574, 58216 |
| anti-influenza_Chain | 4723 | 12365, 20007, 27649, 35291, 42933, 50575, 58217 |
| anti-influenza_Chain | 4724 | 12366, 20008, 27650, 35292, 42934, 50576, 58218 |
| anti-influenza_Chain | 4725 | 12367, 20009, 27651, 35293, 42935, 50577, 58219 |
| anti-influenza_Chain | 4726 | 12368, 20010, 27652, 35294, 42936, 50578, 58220 |
| anti-influenza_Chain | 4727 | 12369, 20011, 27653, 35295, 42937, 50579, 58221 |
| anti-influenza_Chain | 4728 | 12370, 20012, 27654, 35296, 42938, 50580, 58222 |
| anti-influenza_Chain | 4729 | 12371, 20013, 27655, 35297, 42939, 50581, 58223 |
| anti-influenza_Chain | 4730 | 12372, 20014, 27656, 35298, 42940, 50582, 58224 |
| anti-influenza_Chain | 4731 | 12373, 20015, 27657, 35299, 42941, 50583, 58225 |
| anti-influenza_Chain | 4732 | 12374, 20016, 27658, 35300, 42942, 50584, 58226 |
| anti-influenza_Chain | 4733 | 12375, 20017, 27659, 35301, 42943, 50585, 58227 |
| anti-influenza_Chain | 4734 | 12376, 20018, 27660, 35302, 42944, 50586, 58228 |
| anti-influenza_Chain | 4735 | 12377, 20019, 27661, 35303, 42945, 50587, 58229 |
| anti-influenza_Chain | 4736 | 12378, 20020, 27662, 35304, 42946, 50588, 58230 |
| anti-influenza_Chain | 4737 | 12379, 20021, 27663, 35305, 42947, 50589, 58231 |
| anti-influenza_Chain | 4738 | 12380, 20022, 27664, 35306, 42948, 50590, 58232 |
| anti-influenza_Chain | 4739 | 12381, 20023, 27665, 35307, 42949, 50591, 58233 |
| anti-influenza_Chain | 4740 | 12382, 20024, 27666, 35308, 42950, 50592, 58234 |
| anti-influenza_Chain | 4741 | 12383, 20025, 27667, 35309, 42951, 50593, 58235 |
| anti-influenza_Chain | 4742 | 12384, 20026, 27668, 35310, 42952, 50594, 58236 |
| anti-influenza_Chain | 4743 | 12385, 20027, 27669, 35311, 42953, 50595, 58237 |
| anti-influenza_Chain | 4744 | 12386, 20028, 27670, 35312, 42954, 50596, 58238 |
| anti-influenza_Chain | 4745 | 12387, 20029, 27671, 35313, 42955, 50597, 58239 |
| anti-influenza_Chain | 4746 | 12388, 20030, 27672, 35314, 42956, 50598, 58240 |
| anti-influenza_Chain | 4747 | 12389, 20031, 27673, 35315, 42957, 50599, 58241 |
| anti-influenza_Chain | 4748 | 12390, 20032, 27674, 35316, 42958, 50600, 58242 |
| anti-influenza_Chain | 4749 | 12391, 20033, 27675, 35317, 42959, 50601, 58243 |
| anti-influenza_Chain | 4750 | 12392, 20034, 27676, 35318, 42960, 50602, 58244 |
| anti-influenza_Chain | 4751 | 12393, 20035, 27677, 35319, 42961, 50603, 58245 |
| anti-influenza_Chain | 4752 | 12394, 20036, 27678, 35320, 42962, 50604, 58246 |
| anti-influenza_Chain | 4753 | 12395, 20037, 27679, 35321, 42963, 50605, 58247 |
| anti-influenza_Chain | 4754 | 12396, 20038, 27680, 35322, 42964, 50606, 58248 |
| anti-influenza_Chain | 4755 | 12397, 20039, 27681, 35323, 42965, 50607, 58249 |
| anti-influenza_Chain | 4756 | 12398, 20040, 27682, 35324, 42966, 50608, 58250 |
| anti-influenza_Chain | 4757 | 12399, 20041, 27683, 35325, 42967, 50609, 58251 |
| anti-influenza_Chain | 4758 | 12400, 20042, 27684, 35326, 42968, 50610, 58252 |
| anti-influenza_Chain | 4759 | 12401, 20043, 27685, 35327, 42969, 50611, 58253 |
| anti-influenza_Chain | 4760 | 12402, 20044, 27686, 35328, 42970, 50612, 58254 |
| anti-influenza_Chain | 4761 | 12403, 20045, 27687, 35329, 42971, 50613, 58255 |
| anti-influenza_Chain | 4762 | 12404, 20046, 27688, 35330, 42972, 50614, 58256 |
| anti-influenza_Chain | 4763 | 12405, 20047, 27689, 35331, 42973, 50615, 58257 |
| anti-influenza_Chain | 4764 | 12406, 20048, 27690, 35332, 42974, 50616, 58258 |
| anti-influenza_Chain | 4765 | 12407, 20049, 27691, 35333, 42975, 50617, 58259 |
| anti-influenza_Chain | 4766 | 12408, 20050, 27692, 35334, 42976, 50618, 58260 |
| anti-influenza_Chain | 4767 | 12409, 20051, 27693, 35335, 42977, 50619, 58261 |
| anti-influenza_Chain | 4768 | 12410, 20052, 27694, 35336, 42978, 50620, 58262 |
| anti-influenza_Chain | 4769 | 12411, 20053, 27695, 35337, 42979, 50621, 58263 |
| anti-influenza_Chain | 4770 | 12412, 20054, 27696, 35338, 42980, 50622, 58264 |
| anti-influenza_Chain | 4771 | 12413, 20055, 27697, 35339, 42981, 50623, 58265 |
| anti-influenza_Chain | 4772 | 12414, 20056, 27698, 35340, 42982, 50624, 58266 |
| anti-influenza_Chain | 4773 | 12415, 20057, 27699, 35341, 42983, 50625, 58267 |
| anti-influenza_Chain | 4774 | 12416, 20058, 27700, 35342, 42984, 50626, 58268 |
| anti-influenza_Chain | 4775 | 12417, 20059, 27701, 35343, 42985, 50627, 58269 |
| anti-influenza_Chain | 4776 | 12418, 20060, 27702, 35344, 42986, 50628, 58270 |
| anti-influenza_Chain | 4777 | 12419, 20061, 27703, 35345, 42987, 50629, 58271 |
| anti-influenza_Chain | 4778 | 12420, 20062, 27704, 35346, 42988, 50630, 58272 |
| anti-influenza_Chain | 4779 | 12421, 20063, 27705, 35347, 42989, 50631, 58273 |
| anti-influenza_Chain | 4780 | 12422, 20064, 27706, 35348, 42990, 50632, 58274 |
| anti-influenza_Chain | 4781 | 12423, 20065, 27707, 35349, 42991, 50633, 58275 |
| anti-influenza_Chain | 4782 | 12424, 20066, 27708, 35350, 42992, 50634, 58276 |
| anti-influenza_Chain | 4783 | 12425, 20067, 27709, 35351, 42993, 50635, 58277 |
| anti-influenza_Chain | 4784 | 12426, 20068, 27710, 35352, 42994, 50636, 58278 |

TABLE 3-continued

RNA and amino acid sequences of exemplified antibodies

| Name | Protein SEQ ID NO | RNA SEQ ID NO |
| --- | --- | --- |
| anti-influenza_Chain | 4785 | 12427, 20069, 27711, 35353, 42995, 50637, 58279 |
| anti-influenza_Chain | 4786 | 12428, 20070, 27712, 35354, 42996, 50638, 58280 |
| anti-influenza_Chain | 4787 | 12429, 20071, 27713, 35355, 42997, 50639, 58281 |
| anti-influenza_Chain | 4788 | 12430, 20072, 27714, 35356, 42998, 50640, 58282 |
| anti-influenza_Chain | 4789 | 12431, 20073, 27715, 35357, 42999, 50641, 58283 |
| anti-influenza_Chain | 4790 | 12432, 20074, 27716, 35358, 43000, 50642, 58284 |
| anti-influenza_Chain | 4791 | 12433, 20075, 27717, 35359, 43001, 50643, 58285 |
| anti-influenza_Chain | 4792 | 12434, 20076, 27718, 35360, 43002, 50644, 58286 |
| anti-influenza_Chain | 4793 | 12435, 20077, 27719, 35361, 43003, 50645, 58287 |
| anti-influenza_Chain | 4794 | 12436, 20078, 27720, 35362, 43004, 50646, 58288 |
| anti-influenza_Chain | 4795 | 12437, 20079, 27721, 35363, 43005, 50647, 58289 |
| anti-influenza_Chain | 4796 | 12438, 20080, 27722, 35364, 43006, 50648, 58290 |
| anti-influenza_Chain | 4797 | 12439, 20081, 27723, 35365, 43007, 50649, 58291 |
| anti-influenza_Chain | 4798 | 12440, 20082, 27724, 35366, 43008, 50650, 58292 |
| anti-influenza_Chain | 4799 | 12441, 20083, 27725, 35367, 43009, 50651, 58293 |
| anti-influenza_Chain | 4800 | 12442, 20084, 27726, 35368, 43010, 50652, 58294 |
| anti-influenza_Chain | 4801 | 12443, 20085, 27727, 35369, 43011, 50653, 58295 |
| anti-influenza_Chain | 4802 | 12444, 20086, 27728, 35370, 43012, 50654, 58296 |
| anti-influenza_Chain | 4803 | 12445, 20087, 27729, 35371, 43013, 50655, 58297 |
| anti-influenza_Chain | 4804 | 12446, 20088, 27730, 35372, 43014, 50656, 58298 |
| anti-influenza_Chain | 4805 | 12447, 20089, 27731, 35373, 43015, 50657, 58299 |
| anti-influenza_Chain | 4806 | 12448, 20090, 27732, 35374, 43016, 50658, 58300 |
| anti-influenza_Chain | 4807 | 12449, 20091, 27733, 35375, 43017, 50659, 58301 |
| anti-influenza_Chain | 4808 | 12450, 20092, 27734, 35376, 43018, 50660, 58302 |
| anti-influenza_Chain | 4809 | 12451, 20093, 27735, 35377, 43019, 50661, 58303 |
| anti-influenza_Chain | 4810 | 12452, 20094, 27736, 35378, 43020, 50662, 58304 |
| anti-influenza_Chain | 4811 | 12453, 20095, 27737, 35379, 43021, 50663, 58305 |
| anti-influenza_Chain | 4812 | 12454, 20096, 27738, 35380, 43022, 50664, 58306 |
| anti-influenza_Chain | 4813 | 12455, 20097, 27739, 35381, 43023, 50665, 58307 |
| anti-influenza_Chain | 4814 | 12456, 20098, 27740, 35382, 43024, 50666, 58308 |
| anti-influenza_Chain | 4815 | 12457, 20099, 27741, 35383, 43025, 50667, 58309 |
| anti-influenza_Chain | 4816 | 12458, 20100, 27742, 35384, 43026, 50668, 58310 |
| anti-influenza_Chain | 4817 | 12459, 20101, 27743, 35385, 43027, 50669, 58311 |
| anti-influenza_Chain | 4818 | 12460, 20102, 27744, 35386, 43028, 50670, 58312 |
| anti-influenza_Chain | 4819 | 12461, 20103, 27745, 35387, 43029, 50671, 58313 |
| anti-influenza_Chain | 4820 | 12462, 20104, 27746, 35388, 43030, 50672, 58314 |
| anti-influenza_Chain | 4821 | 12463, 20105, 27747, 35389, 43031, 50673, 58315 |
| anti-influenza_Chain | 4822 | 12464, 20106, 27748, 35390, 43032, 50674, 58316 |
| anti-influenza_Chain | 4823 | 12465, 20107, 27749, 35391, 43033, 50675, 58317 |
| anti-influenza_Chain | 4824 | 12466, 20108, 27750, 35392, 43034, 50676, 58318 |
| anti-influenza_Chain | 4825 | 12467, 20109, 27751, 35393, 43035, 50677, 58319 |
| anti-influenza_Chain | 4826 | 12468, 20110, 27752, 35394, 43036, 50678, 58320 |
| anti-influenza_Chain | 4827 | 12469, 20111, 27753, 35395, 43037, 50679, 58321 |
| anti-influenza_Chain | 4828 | 12470, 20112, 27754, 35396, 43038, 50680, 58322 |
| anti-influenza_Chain | 4829 | 12471, 20113, 27755, 35397, 43039, 50681, 58323 |
| anti-influenza_Chain | 4830 | 12472, 20114, 27756, 35398, 43040, 50682, 58324 |
| anti-influenza_Chain | 4831 | 12473, 20115, 27757, 35399, 43041, 50683, 58325 |
| anti-influenza_Chain | 4832 | 12474, 20116, 27758, 35400, 43042, 50684, 58326 |
| anti-influenza_Chain | 4833 | 12475, 20117, 27759, 35401, 43043, 50685, 58327 |
| anti-influenza_Chain | 4834 | 12476, 20118, 27760, 35402, 43044, 50686, 58328 |
| anti-influenza_Chain | 4835 | 12477, 20119, 27761, 35403, 43045, 50687, 58329 |
| anti-influenza_Chain | 4836 | 12478, 20120, 27762, 35404, 43046, 50688, 58330 |
| anti-influenza_Chain | 4837 | 12479, 20121, 27763, 35405, 43047, 50689, 58331 |
| anti-influenza_Chain | 4838 | 12480, 20122, 27764, 35406, 43048, 50690, 58332 |
| anti-influenza_Chain | 4839 | 12481, 20123, 27765, 35407, 43049, 50691, 58333 |
| anti-influenza_Chain | 4840 | 12482, 20124, 27766, 35408, 43050, 50692, 58334 |
| anti-influenza_Chain | 4841 | 12483, 20125, 27767, 35409, 43051, 50693, 58335 |
| anti-influenza_Chain | 4842 | 12484, 20126, 27768, 35410, 43052, 50694, 58336 |
| anti-influenza_Chain | 4843 | 12485, 20127, 27769, 35411, 43053, 50695, 58337 |
| anti-influenza_Chain | 4844 | 12486, 20128, 27770, 35412, 43054, 50696, 58338 |
| anti-influenza_Chain | 4845 | 12487, 20129, 27771, 35413, 43055, 50697, 58339 |
| anti-influenza_Chain | 4846 | 12488, 20130, 27772, 35414, 43056, 50698, 58340 |
| anti-influenza_Chain | 4847 | 12489, 20131, 27773, 35415, 43057, 50699, 58341 |
| anti-influenza_Chain | 4848 | 12490, 20132, 27774, 35416, 43058, 50700, 58342 |
| anti-influenza_Chain | 4849 | 12491, 20133, 27775, 35417, 43059, 50701, 58343 |
| anti-influenza_Chain | 4850 | 12492, 20134, 27776, 35418, 43060, 50702, 58344 |
| anti-influenza_Chain | 4851 | 12493, 20135, 27777, 35419, 43061, 50703, 58345 |
| anti-influenza_Chain | 4852 | 12494, 20136, 27778, 35420, 43062, 50704, 58346 |
| anti-influenza_Chain | 4853 | 12495, 20137, 27779, 35421, 43063, 50705, 58347 |
| anti-influenza_Chain | 4854 | 12496, 20138, 27780, 35422, 43064, 50706, 58348 |
| anti-influenza_Chain | 4855 | 12497, 20139, 27781, 35423, 43065, 50707, 58349 |
| anti-influenza_Chain | 4856 | 12498, 20140, 27782, 35424, 43066, 50708, 58350 |
| anti-influenza_Chain | 4857 | 12499, 20141, 27783, 35425, 43067, 50709, 58351 |
| anti-influenza_Chain | 4858 | 12500, 20142, 27784, 35426, 43068, 50710, 58352 |
| anti-influenza_Chain | 4859 | 12501, 20143, 27785, 35427, 43069, 50711, 58353 |
| anti-influenza_Chain | 4860 | 12502, 20144, 27786, 35428, 43070, 50712, 58354 |

TABLE 3-continued

RNA and amino acid sequences of exemplified antibodies

| Name | Protein SEQ ID NO | RNA SEQ ID NO |
| --- | --- | --- |
| anti-influenza_Chain | 4861 | 12503, 20145, 27787, 35429, 43071, 50713, 58355 |
| anti-influenza_Chain | 4862 | 12504, 20146, 27788, 35430, 43072, 50714, 58356 |
| anti-influenza_Chain | 4863 | 12505, 20147, 27789, 35431, 43073, 50715, 58357 |
| anti-influenza_Chain | 4864 | 12506, 20148, 27790, 35432, 43074, 50716, 58358 |
| anti-influenza_Chain | 4865 | 12507, 20149, 27791, 35433, 43075, 50717, 58359 |
| anti-influenza_Chain | 4866 | 12508, 20150, 27792, 35434, 43076, 50718, 58360 |
| anti-influenza_Chain | 4867 | 12509, 20151, 27793, 35435, 43077, 50719, 58361 |
| anti-influenza_Chain | 4868 | 12510, 20152, 27794, 35436, 43078, 50720, 58362 |
| anti-influenza_Chain | 4869 | 12511, 20153, 27795, 35437, 43079, 50721, 58363 |
| anti-influenza_Chain | 4870 | 12512, 20154, 27796, 35438, 43080, 50722, 58364 |
| anti-influenza_Chain | 4871 | 12513, 20155, 27797, 35439, 43081, 50723, 58365 |
| anti-influenza_Chain | 4872 | 12514, 20156, 27798, 35440, 43082, 50724, 58366 |
| anti-influenza_Chain | 4873 | 12515, 20157, 27799, 35441, 43083, 50725, 58367 |
| anti-influenza_Chain | 4874 | 12516, 20158, 27800, 35442, 43084, 50726, 58368 |
| anti-influenza_Chain | 4875 | 12517, 20159, 27801, 35443, 43085, 50727, 58369 |
| anti-influenza_Chain | 4876 | 12518, 20160, 27802, 35444, 43086, 50728, 58370 |
| anti-influenza_Chain | 4877 | 12519, 20161, 27803, 35445, 43087, 50729, 58371 |
| anti-influenza_Chain | 4878 | 12520, 20162, 27804, 35446, 43088, 50730, 58372 |
| anti-influenza_Chain | 4879 | 12521, 20163, 27805, 35447, 43089, 50731, 58373 |
| anti-influenza_Chain | 4880 | 12522, 20164, 27806, 35448, 43090, 50732, 58374 |
| anti-influenza_Chain | 4881 | 12523, 20165, 27807, 35449, 43091, 50733, 58375 |
| anti-influenza_Chain | 4882 | 12524, 20166, 27808, 35450, 43092, 50734, 58376 |
| anti-influenza_Chain | 4883 | 12525, 20167, 27809, 35451, 43093, 50735, 58377 |
| anti-influenza_Chain | 4884 | 12526, 20168, 27810, 35452, 43094, 50736, 58378 |
| anti-influenza_Chain | 4885 | 12527, 20169, 27811, 35453, 43095, 50737, 58379 |
| anti-influenza_Chain | 4886 | 12528, 20170, 27812, 35454, 43096, 50738, 58380 |
| anti-influenza_Chain | 4887 | 12529, 20171, 27813, 35455, 43097, 50739, 58381 |
| anti-influenza_Chain | 4888 | 12530, 20172, 27814, 35456, 43098, 50740, 58382 |
| anti-influenza_Chain | 4889 | 12531, 20173, 27815, 35457, 43099, 50741, 58383 |
| anti-influenza_Chain | 4890 | 12532, 20174, 27816, 35458, 43100, 50742, 58384 |
| anti-influenza_Chain | 4891 | 12533, 20175, 27817, 35459, 43101, 50743, 58385 |
| anti-influenza_Chain | 4892 | 12534, 20176, 27818, 35460, 43102, 50744, 58386 |
| anti-influenza_Chain | 4893 | 12535, 20177, 27819, 35461, 43103, 50745, 58387 |
| anti-influenza_Chain | 4894 | 12536, 20178, 27820, 35462, 43104, 50746, 58388 |
| anti-influenza_Chain | 4895 | 12537, 20179, 27821, 35463, 43105, 50747, 58389 |
| anti-influenza_Chain | 4896 | 12538, 20180, 27822, 35464, 43106, 50748, 58390 |
| anti-influenza_Chain | 4897 | 12539, 20181, 27823, 35465, 43107, 50749, 58391 |
| anti-influenza_Chain | 4898 | 12540, 20182, 27824, 35466, 43108, 50750, 58392 |
| anti-influenza_Chain | 4899 | 12541, 20183, 27825, 35467, 43109, 50751, 58393 |
| anti-influenza_Chain | 4900 | 12542, 20184, 27826, 35468, 43110, 50752, 58394 |
| anti-influenza_Chain | 4901 | 12543, 20185, 27827, 35469, 43111, 50753, 58395 |
| anti-influenza_Chain | 4902 | 12544, 20186, 27828, 35470, 43112, 50754, 58396 |
| anti-influenza_Chain | 4903 | 12545, 20187, 27829, 35471, 43113, 50755, 58397 |
| anti-influenza_Chain | 4904 | 12546, 20188, 27830, 35472, 43114, 50756, 58398 |
| anti-influenza_Chain | 4905 | 12547, 20189, 27831, 35473, 43115, 50757, 58399 |
| anti-influenza_Chain | 4906 | 12548, 20190, 27832, 35474, 43116, 50758, 58400 |
| anti-influenza_Chain | 4907 | 12549, 20191, 27833, 35475, 43117, 50759, 58401 |
| anti-influenza_Chain | 4908 | 12550, 20192, 27834, 35476, 43118, 50760, 58402 |
| anti-influenza_Chain | 4909 | 12551, 20193, 27835, 35477, 43119, 50761, 58403 |
| anti-influenza_Chain | 4910 | 12552, 20194, 27836, 35478, 43120, 50762, 58404 |
| anti-influenza_Chain | 4911 | 12553, 20195, 27837, 35479, 43121, 50763, 58405 |
| anti-influenza_Chain | 4912 | 12554, 20196, 27838, 35480, 43122, 50764, 58406 |
| anti-influenza_Chain | 4913 | 12555, 20197, 27839, 35481, 43123, 50765, 58407 |
| anti-influenza_Chain | 4914 | 12556, 20198, 27840, 35482, 43124, 50766, 58408 |
| anti-influenza_Chain | 4915 | 12557, 20199, 27841, 35483, 43125, 50767, 58409 |
| anti-influenza_Chain | 4916 | 12558, 20200, 27842, 35484, 43126, 50768, 58410 |
| anti-influenza_Chain | 4917 | 12559, 20201, 27843, 35485, 43127, 50769, 58411 |
| anti-influenza_Chain | 4918 | 12560, 20202, 27844, 35486, 43128, 50770, 58412 |
| anti-influenza_Chain | 4919 | 12561, 20203, 27845, 35487, 43129, 50771, 58413 |
| anti-influenza_Chain | 4920 | 12562, 20204, 27846, 35488, 43130, 50772, 58414 |
| anti-influenza_Chain | 4921 | 12563, 20205, 27847, 35489, 43131, 50773, 58415 |
| anti-influenza_Chain | 4922 | 12564, 20206, 27848, 35490, 43132, 50774, 58416 |
| anti-influenza_Chain | 4923 | 12565, 20207, 27849, 35491, 43133, 50775, 58417 |
| anti-influenza_Chain | 4924 | 12566, 20208, 27850, 35492, 43134, 50776, 58418 |
| anti-influenza_Chain | 4925 | 12567, 20209, 27851, 35493, 43135, 50777, 58419 |
| anti-influenza_Chain | 4926 | 12568, 20210, 27852, 35494, 43136, 50778, 58420 |
| anti-influenza_Chain | 4927 | 12569, 20211, 27853, 35495, 43137, 50779, 58421 |
| anti-influenza_Chain | 4928 | 12570, 20212, 27854, 35496, 43138, 50780, 58422 |
| anti-influenza_Chain | 4929 | 12571, 20213, 27855, 35497, 43139, 50781, 58423 |
| anti-influenza_Chain | 4930 | 12572, 20214, 27856, 35498, 43140, 50782, 58424 |
| anti-influenza_Chain | 4931 | 12573, 20215, 27857, 35499, 43141, 50783, 58425 |
| anti-influenza_Chain | 4932 | 12574, 20216, 27858, 35500, 43142, 50784, 58426 |
| anti-influenza_Chain | 4933 | 12575, 20217, 27859, 35501, 43143, 50785, 58427 |
| anti-influenza_Chain | 4934 | 12576, 20218, 27860, 35502, 43144, 50786, 58428 |
| anti-influenza_Chain | 4935 | 12577, 20219, 27861, 35503, 43145, 50787, 58429 |
| anti-influenza_Chain | 4936 | 12578, 20220, 27862, 35504, 43146, 50788, 58430 |

TABLE 3-continued

RNA and amino acid sequences of exemplified antibodies

| Name | Protein SEQ ID NO | RNA SEQ ID NO |
|---|---|---|
| anti-influenza_Chain | 4937 | 12579, 20221, 27863, 35505, 43147, 50789, 58431 |
| anti-influenza_Chain | 4938 | 12580, 20222, 27864, 35506, 43148, 50790, 58432 |
| anti-influenza_Chain | 4939 | 12581, 20223, 27865, 35507, 43149, 50791, 58433 |
| anti-influenza_Chain | 4940 | 12582, 20224, 27866, 35508, 43150, 50792, 58434 |
| anti-influenza_Chain | 4941 | 12583, 20225, 27867, 35509, 43151, 50793, 58435 |
| anti-influenza_Chain | 4942 | 12584, 20226, 27868, 35510, 43152, 50794, 58436 |
| anti-influenza_Chain | 4943 | 12585, 20227, 27869, 35511, 43153, 50795, 58437 |
| anti-influenza_Chain | 4944 | 12586, 20228, 27870, 35512, 43154, 50796, 58438 |
| anti-influenza_Chain | 4945 | 12587, 20229, 27871, 35513, 43155, 50797, 58439 |
| anti-influenza_Chain | 4946 | 12588, 20230, 27872, 35514, 43156, 50798, 58440 |
| anti-influenza_Chain | 4947 | 12589, 20231, 27873, 35515, 43157, 50799, 58441 |
| anti-influenza_Chain | 4948 | 12590, 20232, 27874, 35516, 43158, 50800, 58442 |
| anti-influenza_Chain | 4949 | 12591, 20233, 27875, 35517, 43159, 50801, 58443 |
| anti-influenza_Chain | 4950 | 12592, 20234, 27876, 35518, 43160, 50802, 58444 |
| anti-influenza_Chain | 4951 | 12593, 20235, 27877, 35519, 43161, 50803, 58445 |
| anti-influenza_Chain | 4952 | 12594, 20236, 27878, 35520, 43162, 50804, 58446 |
| anti-influenza_Chain | 4953 | 12595, 20237, 27879, 35521, 43163, 50805, 58447 |
| anti-influenza_Chain | 4954 | 12596, 20238, 27880, 35522, 43164, 50806, 58448 |
| anti-influenza_Chain | 4955 | 12597, 20239, 27881, 35523, 43165, 50807, 58449 |
| anti-influenza_Chain | 4956 | 12598, 20240, 27882, 35524, 43166, 50808, 58450 |
| anti-influenza_Chain | 4957 | 12599, 20241, 27883, 35525, 43167, 50809, 58451 |
| anti-influenza_Chain | 4958 | 12600, 20242, 27884, 35526, 43168, 50810, 58452 |
| anti-influenza_Chain | 4959 | 12601, 20243, 27885, 35527, 43169, 50811, 58453 |
| anti-influenza_Chain | 4960 | 12602, 20244, 27886, 35528, 43170, 50812, 58454 |
| anti-influenza_Chain | 4961 | 12603, 20245, 27887, 35529, 43171, 50813, 58455 |
| anti-influenza_Chain | 4962 | 12604, 20246, 27888, 35530, 43172, 50814, 58456 |
| anti-influenza_Chain | 4963 | 12605, 20247, 27889, 35531, 43173, 50815, 58457 |
| anti-influenza_Chain | 4964 | 12606, 20248, 27890, 35532, 43174, 50816, 58458 |
| anti-influenza_Chain | 4965 | 12607, 20249, 27891, 35533, 43175, 50817, 58459 |
| anti-influenza_Chain | 4966 | 12608, 20250, 27892, 35534, 43176, 50818, 58460 |
| anti-influenza_Chain | 4967 | 12609, 20251, 27893, 35535, 43177, 50819, 58461 |
| anti-influenza_Chain | 4968 | 12610, 20252, 27894, 35536, 43178, 50820, 58462 |
| anti-influenza_Chain | 4969 | 12611, 20253, 27895, 35537, 43179, 50821, 58463 |
| anti-influenza_Chain | 4970 | 12612, 20254, 27896, 35538, 43180, 50822, 58464 |
| anti-influenza_Chain | 4971 | 12613, 20255, 27897, 35539, 43181, 50823, 58465 |
| anti-influenza_Chain | 4972 | 12614, 20256, 27898, 35540, 43182, 50824, 58466 |
| anti-influenza_Chain | 4973 | 12615, 20257, 27899, 35541, 43183, 50825, 58467 |
| anti-influenza_Chain | 4974 | 12616, 20258, 27900, 35542, 43184, 50826, 58468 |
| anti-influenza_Chain | 4975 | 12617, 20259, 27901, 35543, 43185, 50827, 58469 |
| anti-influenza_Chain | 4976 | 12618, 20260, 27902, 35544, 43186, 50828, 58470 |
| anti-influenza_Chain | 4977 | 12619, 20261, 27903, 35545, 43187, 50829, 58471 |
| anti-influenza_Chain | 4978 | 12620, 20262, 27904, 35546, 43188, 50830, 58472 |
| anti-influenza_Chain | 4979 | 12621, 20263, 27905, 35547, 43189, 50831, 58473 |
| anti-influenza_Chain | 4980 | 12622, 20264, 27906, 35548, 43190, 50832, 58474 |
| anti-influenza_Chain | 4981 | 12623, 20265, 27907, 35549, 43191, 50833, 58475 |
| anti-influenza_Chain | 4982 | 12624, 20266, 27908, 35550, 43192, 50834, 58476 |
| anti-influenza_Chain | 4983 | 12625, 20267, 27909, 35551, 43193, 50835, 58477 |
| anti-influenza_Chain | 4984 | 12626, 20268, 27910, 35552, 43194, 50836, 58478 |
| anti-influenza_Chain | 4985 | 12627, 20269, 27911, 35553, 43195, 50837, 58479 |
| anti-influenza_Chain | 4986 | 12628, 20270, 27912, 35554, 43196, 50838, 58480 |
| anti-influenza_Chain | 4987 | 12629, 20271, 27913, 35555, 43197, 50839, 58481 |
| anti-influenza_Chain | 4988 | 12630, 20272, 27914, 35556, 43198, 50840, 58482 |
| anti-influenza_Chain | 4989 | 12631, 20273, 27915, 35557, 43199, 50841, 58483 |
| anti-influenza_Chain | 4990 | 12632, 20274, 27916, 35558, 43200, 50842, 58484 |
| anti-influenza_Chain | 4991 | 12633, 20275, 27917, 35559, 43201, 50843, 58485 |
| anti-influenza_Chain | 4992 | 12634, 20276, 27918, 35560, 43202, 50844, 58486 |
| anti-influenza_Chain | 4993 | 12635, 20277, 27919, 35561, 43203, 50845, 58487 |
| anti-influenza_Chain | 4994 | 12636, 20278, 27920, 35562, 43204, 50846, 58488 |
| anti-influenza_Chain | 4995 | 12637, 20279, 27921, 35563, 43205, 50847, 58489 |
| anti-influenza_Chain | 4996 | 12638, 20280, 27922, 35564, 43206, 50848, 58490 |
| anti-influenza_Chain | 4997 | 12639, 20281, 27923, 35565, 43207, 50849, 58491 |
| anti-influenza_Chain | 4998 | 12640, 20282, 27924, 35566, 43208, 50850, 58492 |
| anti-influenza_Chain | 4999 | 12641, 20283, 27925, 35567, 43209, 50851, 58493 |
| anti-influenza_Chain | 5000 | 12642, 20284, 27926, 35568, 43210, 50852, 58494 |
| anti-influenza_Chain | 5001 | 12643, 20285, 27927, 35569, 43211, 50853, 58495 |
| anti-influenza_Chain | 5002 | 12644, 20286, 27928, 35570, 43212, 50854, 58496 |
| anti-influenza_Chain | 5003 | 12645, 20287, 27929, 35571, 43213, 50855, 58497 |
| anti-influenza_Chain | 5004 | 12646, 20288, 27930, 35572, 43214, 50856, 58498 |
| anti-influenza_Chain | 5005 | 12647, 20289, 27931, 35573, 43215, 50857, 58499 |
| anti-influenza_Chain | 5006 | 12648, 20290, 27932, 35574, 43216, 50858, 58500 |
| anti-influenza_Chain | 5007 | 12649, 20291, 27933, 35575, 43217, 50859, 58501 |
| anti-influenza_Chain | 5008 | 12650, 20292, 27934, 35576, 43218, 50860, 58502 |
| anti-influenza_Chain | 5009 | 12651, 20293, 27935, 35577, 43219, 50861, 58503 |
| anti-influenza_Chain | 5010 | 12652, 20294, 27936, 35578, 43220, 50862, 58504 |
| anti-influenza_Chain | 5011 | 12653, 20295, 27937, 35579, 43221, 50863, 58505 |
| anti-influenza_Chain | 5012 | 12654, 20296, 27938, 35580, 43222, 50864, 58506 |

TABLE 3-continued

RNA and amino acid sequences of exemplified antibodies

| Name | Protein SEQ ID NO | RNA SEQ ID NO |
|---|---|---|
| anti-influenza_Chain | 5013 | 12655, 20297, 27939, 35581, 43223, 50865, 58507 |
| anti-influenza_Chain | 5014 | 12656, 20298, 27940, 35582, 43224, 50866, 58508 |
| anti-influenza_Chain | 5015 | 12657, 20299, 27941, 35583, 43225, 50867, 58509 |
| anti-influenza_Chain | 5016 | 12658, 20300, 27942, 35584, 43226, 50868, 58510 |
| anti-influenza_Chain | 5017 | 12659, 20301, 27943, 35585, 43227, 50869, 58511 |
| anti-influenza_Chain | 5018 | 12660, 20302, 27944, 35586, 43228, 50870, 58512 |
| anti-influenza_Chain | 5019 | 12661, 20303, 27945, 35587, 43229, 50871, 58513 |
| anti-influenza_Chain | 5020 | 12662, 20304, 27946, 35588, 43230, 50872, 58514 |
| anti-influenza_Chain | 5021 | 12663, 20305, 27947, 35589, 43231, 50873, 58515 |
| anti-influenza_Chain | 5022 | 12664, 20306, 27948, 35590, 43232, 50874, 58516 |
| anti-influenza_Chain | 5023 | 12665, 20307, 27949, 35591, 43233, 50875, 58517 |
| anti-influenza_Chain | 5024 | 12666, 20308, 27950, 35592, 43234, 50876, 58518 |
| anti-influenza_Chain | 5025 | 12667, 20309, 27951, 35593, 43235, 50877, 58519 |
| anti-influenza_Chain | 5026 | 12668, 20310, 27952, 35594, 43236, 50878, 58520 |
| anti-influenza_Chain | 5027 | 12669, 20311, 27953, 35595, 43237, 50879, 58521 |
| anti-influenza_Chain | 5028 | 12670, 20312, 27954, 35596, 43238, 50880, 58522 |
| anti-influenza_Chain | 5029 | 12671, 20313, 27955, 35597, 43239, 50881, 58523 |
| anti-influenza_Chain | 5030 | 12672, 20314, 27956, 35598, 43240, 50882, 58524 |
| anti-influenza_Chain | 5031 | 12673, 20315, 27957, 35599, 43241, 50883, 58525 |
| anti-influenza_Chain | 5032 | 12674, 20316, 27958, 35600, 43242, 50884, 58526 |
| anti-influenza_Chain | 5033 | 12675, 20317, 27959, 35601, 43243, 50885, 58527 |
| anti-influenza_Chain | 5034 | 12676, 20318, 27960, 35602, 43244, 50886, 58528 |
| anti-influenza_Chain | 5035 | 12677, 20319, 27961, 35603, 43245, 50887, 58529 |
| anti-influenza_Chain | 5036 | 12678, 20320, 27962, 35604, 43246, 50888, 58530 |
| anti-influenza_Chain | 5037 | 12679, 20321, 27963, 35605, 43247, 50889, 58531 |
| anti-influenza_Chain | 5038 | 12680, 20322, 27964, 35606, 43248, 50890, 58532 |
| anti-influenza_Chain | 5039 | 12681, 20323, 27965, 35607, 43249, 50891, 58533 |
| anti-influenza_Chain | 5040 | 12682, 20324, 27966, 35608, 43250, 50892, 58534 |
| anti-influenza_Chain | 5041 | 12683, 20325, 27967, 35609, 43251, 50893, 58535 |
| anti-influenza_Chain | 5042 | 12684, 20326, 27968, 35610, 43252, 50894, 58536 |
| anti-influenza_Chain | 5043 | 12685, 20327, 27969, 35611, 43253, 50895, 58537 |
| anti-influenza_Chain | 5044 | 12686, 20328, 27970, 35612, 43254, 50896, 58538 |
| anti-influenza_Chain | 5045 | 12687, 20329, 27971, 35613, 43255, 50897, 58539 |
| anti-influenza_Chain | 5046 | 12688, 20330, 27972, 35614, 43256, 50898, 58540 |
| anti-influenza_Chain | 5047 | 12689, 20331, 27973, 35615, 43257, 50899, 58541 |
| anti-influenza_Chain | 5048 | 12690, 20332, 27974, 35616, 43258, 50900, 58542 |
| anti-influenza_Chain | 5049 | 12691, 20333, 27975, 35617, 43259, 50901, 58543 |
| anti-influenza_Chain | 5050 | 12692, 20334, 27976, 35618, 43260, 50902, 58544 |
| anti-influenza_Chain | 5051 | 12693, 20335, 27977, 35619, 43261, 50903, 58545 |
| anti-influenza_Chain | 5052 | 12694, 20336, 27978, 35620, 43262, 50904, 58546 |
| anti-influenza_Chain | 5053 | 12695, 20337, 27979, 35621, 43263, 50905, 58547 |
| anti-influenza_Chain | 5054 | 12696, 20338, 27980, 35622, 43264, 50906, 58548 |
| anti-influenza_Chain | 5055 | 12697, 20339, 27981, 35623, 43265, 50907, 58549 |
| anti-influenza_Chain | 5056 | 12698, 20340, 27982, 35624, 43266, 50908, 58550 |
| anti-influenza_Chain | 5057 | 12699, 20341, 27983, 35625, 43267, 50909, 58551 |
| anti-influenza_Chain | 5058 | 12700, 20342, 27984, 35626, 43268, 50910, 58552 |
| anti-influenza_Chain | 5059 | 12701, 20343, 27985, 35627, 43269, 50911, 58553 |
| anti-influenza_Chain | 5060 | 12702, 20344, 27986, 35628, 43270, 50912, 58554 |
| anti-influenza_Chain | 5061 | 12703, 20345, 27987, 35629, 43271, 50913, 58555 |
| anti-influenza_Chain | 5062 | 12704, 20346, 27988, 35630, 43272, 50914, 58556 |
| anti-influenza_Chain | 5063 | 12705, 20347, 27989, 35631, 43273, 50915, 58557 |
| anti-influenza_Chain | 5064 | 12706, 20348, 27990, 35632, 43274, 50916, 58558 |
| anti-influenza_Chain | 5065 | 12707, 20349, 27991, 35633, 43275, 50917, 58559 |
| anti-influenza_Chain | 5066 | 12708, 20350, 27992, 35634, 43276, 50918, 58560 |
| anti-influenza_Chain | 5067 | 12709, 20351, 27993, 35635, 43277, 50919, 58561 |
| anti-influenza_Chain | 5068 | 12710, 20352, 27994, 35636, 43278, 50920, 58562 |
| anti-influenza_Chain | 5069 | 12711, 20353, 27995, 35637, 43279, 50921, 58563 |
| anti-influenza_Chain | 5070 | 12712, 20354, 27996, 35638, 43280, 50922, 58564 |
| anti-influenza_Chain | 5071 | 12713, 20355, 27997, 35639, 43281, 50923, 58565 |
| anti-influenza_Chain | 5072 | 12714, 20356, 27998, 35640, 43282, 50924, 58566 |
| anti-influenza_Chain | 5073 | 12715, 20357, 27999, 35641, 43283, 50925, 58567 |
| anti-influenza_Chain | 5074 | 12716, 20358, 28000, 35642, 43284, 50926, 58568 |
| anti-influenza_Chain | 5075 | 12717, 20359, 28001, 35643, 43285, 50927, 58569 |
| anti-influenza_Chain | 5076 | 12718, 20360, 28002, 35644, 43286, 50928, 58570 |
| anti-influenza_Chain | 5077 | 12719, 20361, 28003, 35645, 43287, 50929, 58571 |
| anti-influenza_Chain | 5078 | 12720, 20362, 28004, 35646, 43288, 50930, 58572 |
| anti-influenza_Chain | 5079 | 12721, 20363, 28005, 35647, 43289, 50931, 58573 |
| anti-influenza_Chain | 5080 | 12722, 20364, 28006, 35648, 43290, 50932, 58574 |
| anti-influenza_Chain | 5081 | 12723, 20365, 28007, 35649, 43291, 50933, 58575 |
| anti-influenza_Chain | 5082 | 12724, 20366, 28008, 35650, 43292, 50934, 58576 |
| anti-influenza_Chain | 5083 | 12725, 20367, 28009, 35651, 43293, 50935, 58577 |
| anti-influenza_Chain | 5084 | 12726, 20368, 28010, 35652, 43294, 50936, 58578 |
| anti-influenza_Chain | 5085 | 12727, 20369, 28011, 35653, 43295, 50937, 58579 |
| anti-influenza_Chain | 5086 | 12728, 20370, 28012, 35654, 43296, 50938, 58580 |
| anti-influenza_Chain | 5087 | 12729, 20371, 28013, 35655, 43297, 50939, 58581 |
| anti-influenza_Chain | 5088 | 12730, 20372, 28014, 35656, 43298, 50940, 58582 |

TABLE 3-continued

RNA and amino acid sequences of exemplified antibodies

| Name | Protein SEQ ID NO | RNA SEQ ID NO |
| --- | --- | --- |
| anti-influenza_Chain | 5089 | 12731, 20373, 28015, 35657, 43299, 50941, 58583 |
| anti-influenza_Chain | 5090 | 12732, 20374, 28016, 35658, 43300, 50942, 58584 |
| anti-influenza_Chain | 5091 | 12733, 20375, 28017, 35659, 43301, 50943, 58585 |
| anti-influenza_Chain | 5092 | 12734, 20376, 28018, 35660, 43302, 50944, 58586 |
| anti-influenza_Chain | 5093 | 12735, 20377, 28019, 35661, 43303, 50945, 58587 |
| anti-influenza_Chain | 5094 | 12736, 20378, 28020, 35662, 43304, 50946, 58588 |
| anti-influenza_Chain | 5095 | 12737, 20379, 28021, 35663, 43305, 50947, 58589 |
| anti-influenza_Chain | 5096 | 12738, 20380, 28022, 35664, 43306, 50948, 58590 |
| anti-influenza_Chain | 5097 | 12739, 20381, 28023, 35665, 43307, 50949, 58591 |
| anti-influenza_Chain | 5098 | 12740, 20382, 28024, 35666, 43308, 50950, 58592 |
| anti-influenza_Chain | 5099 | 12741, 20383, 28025, 35667, 43309, 50951, 58593 |
| anti-influenza_Chain | 5100 | 12742, 20384, 28026, 35668, 43310, 50952, 58594 |
| anti-influenza_Chain | 5101 | 12743, 20385, 28027, 35669, 43311, 50953, 58595 |
| anti-influenza_Chain | 5102 | 12744, 20386, 28028, 35670, 43312, 50954, 58596 |
| anti-influenza_Chain | 5103 | 12745, 20387, 28029, 35671, 43313, 50955, 58597 |
| anti-influenza_Chain | 5104 | 12746, 20388, 28030, 35672, 43314, 50956, 58598 |
| anti-influenza_Chain | 5105 | 12747, 20389, 28031, 35673, 43315, 50957, 58599 |
| anti-influenza_Chain | 5106 | 12748, 20390, 28032, 35674, 43316, 50958, 58600 |
| anti-influenza_Chain | 5107 | 12749, 20391, 28033, 35675, 43317, 50959, 58601 |
| anti-influenza_Chain | 5108 | 12750, 20392, 28034, 35676, 43318, 50960, 58602 |
| anti-influenza_Chain | 5109 | 12751, 20393, 28035, 35677, 43319, 50961, 58603 |
| anti-influenza_Chain | 5110 | 12752, 20394, 28036, 35678, 43320, 50962, 58604 |
| anti-influenza_Chain | 5111 | 12753, 20395, 28037, 35679, 43321, 50963, 58605 |
| anti-influenza_Chain | 5112 | 12754, 20396, 28038, 35680, 43322, 50964, 58606 |
| anti-influenza_Chain | 5113 | 12755, 20397, 28039, 35681, 43323, 50965, 58607 |
| anti-influenza_Chain | 5114 | 12756, 20398, 28040, 35682, 43324, 50966, 58608 |
| anti-influenza_Chain | 5115 | 12757, 20399, 28041, 35683, 43325, 50967, 58609 |
| anti-influenza_Chain | 5116 | 12758, 20400, 28042, 35684, 43326, 50968, 58610 |
| anti-influenza_Chain | 5117 | 12759, 20401, 28043, 35685, 43327, 50969, 58611 |
| anti-influenza_Chain | 5118 | 12760, 20402, 28044, 35686, 43328, 50970, 58612 |
| anti-influenza_Chain | 5119 | 12761, 20403, 28045, 35687, 43329, 50971, 58613 |
| anti-influenza_Chain | 5120 | 12762, 20404, 28046, 35688, 43330, 50972, 58614 |
| anti-influenza_Chain | 5121 | 12763, 20405, 28047, 35689, 43331, 50973, 58615 |
| anti-influenza_Chain | 5122 | 12764, 20406, 28048, 35690, 43332, 50974, 58616 |
| anti-influenza_Chain | 5123 | 12765, 20407, 28049, 35691, 43333, 50975, 58617 |
| anti-influenza_Chain | 5124 | 12766, 20408, 28050, 35692, 43334, 50976, 58618 |
| anti-influenza_Chain | 5125 | 12767, 20409, 28051, 35693, 43335, 50977, 58619 |
| anti-influenza_Chain | 5126 | 12768, 20410, 28052, 35694, 43336, 50978, 58620 |
| anti-influenza_Chain | 5127 | 12769, 20411, 28053, 35695, 43337, 50979, 58621 |
| anti-influenza_Chain | 5128 | 12770, 20412, 28054, 35696, 43338, 50980, 58622 |
| anti-influenza_Chain | 5129 | 12771, 20413, 28055, 35697, 43339, 50981, 58623 |
| anti-influenza_Chain | 5130 | 12772, 20414, 28056, 35698, 43340, 50982, 58624 |
| anti-influenza_Chain | 5131 | 12773, 20415, 28057, 35699, 43341, 50983, 58625 |
| anti-influenza_Chain | 5132 | 12774, 20416, 28058, 35700, 43342, 50984, 58626 |
| anti-influenza_Chain | 5133 | 12775, 20417, 28059, 35701, 43343, 50985, 58627 |
| anti-influenza_Chain | 5134 | 12776, 20418, 28060, 35702, 43344, 50986, 58628 |
| anti-influenza_Chain | 5135 | 12777, 20419, 28061, 35703, 43345, 50987, 58629 |
| anti-influenza_Chain | 5136 | 12778, 20420, 28062, 35704, 43346, 50988, 58630 |
| anti-influenza_Chain | 5137 | 12779, 20421, 28063, 35705, 43347, 50989, 58631 |
| anti-influenza_Chain | 5138 | 12780, 20422, 28064, 35706, 43348, 50990, 58632 |
| anti-influenza_Chain | 5139 | 12781, 20423, 28065, 35707, 43349, 50991, 58633 |
| anti-influenza_Chain | 5140 | 12782, 20424, 28066, 35708, 43350, 50992, 58634 |
| anti-influenza_Chain | 5141 | 12783, 20425, 28067, 35709, 43351, 50993, 58635 |
| anti-influenza_Chain | 5142 | 12784, 20426, 28068, 35710, 43352, 50994, 58636 |
| anti-influenza_Chain | 5143 | 12785, 20427, 28069, 35711, 43353, 50995, 58637 |
| anti-influenza_Chain | 5144 | 12786, 20428, 28070, 35712, 43354, 50996, 58638 |
| anti-influenza_Chain | 5145 | 12787, 20429, 28071, 35713, 43355, 50997, 58639 |
| anti-influenza_Chain | 5146 | 12788, 20430, 28072, 35714, 43356, 50998, 58640 |
| anti-influenza_Chain | 5147 | 12789, 20431, 28073, 35715, 43357, 50999, 58641 |
| anti-influenza_Chain | 5148 | 12790, 20432, 28074, 35716, 43358, 51000, 58642 |
| anti-influenza_Chain | 5149 | 12791, 20433, 28075, 35717, 43359, 51001, 58643 |
| anti-influenza_Chain | 5150 | 12792, 20434, 28076, 35718, 43360, 51002, 58644 |
| anti-influenza_Chain | 5151 | 12793, 20435, 28077, 35719, 43361, 51003, 58645 |
| anti-influenza_Chain | 5152 | 12794, 20436, 28078, 35720, 43362, 51004, 58646 |
| anti-influenza_Chain | 5153 | 12795, 20437, 28079, 35721, 43363, 51005, 58647 |
| anti-influenza_Chain | 5154 | 12796, 20438, 28080, 35722, 43364, 51006, 58648 |
| anti-influenza_Chain | 5155 | 12797, 20439, 28081, 35723, 43365, 51007, 58649 |
| anti-influenza_Chain | 5156 | 12798, 20440, 28082, 35724, 43366, 51008, 58650 |
| anti-influenza_Chain | 5157 | 12799, 20441, 28083, 35725, 43367, 51009, 58651 |
| anti-influenza_Chain | 5158 | 12800, 20442, 28084, 35726, 43368, 51010, 58652 |
| anti-influenza_Chain | 5159 | 12801, 20443, 28085, 35727, 43369, 51011, 58653 |
| anti-influenza_Chain | 5160 | 12802, 20444, 28086, 35728, 43370, 51012, 58654 |
| anti-influenza_Chain | 5161 | 12803, 20445, 28087, 35729, 43371, 51013, 58655 |
| anti-influenza_Chain | 5162 | 12804, 20446, 28088, 35730, 43372, 51014, 58656 |
| anti-influenza_Chain | 5163 | 12805, 20447, 28089, 35731, 43373, 51015, 58657 |
| anti-influenza_Chain | 5164 | 12806, 20448, 28090, 35732, 43374, 51016, 58658 |

TABLE 3-continued

RNA and amino acid sequences of exemplified antibodies

| Name | Protein SEQ ID NO | RNA SEQ ID NO |
| --- | --- | --- |
| anti-influenza_Chain | 5165 | 12807, 20449, 28091, 35733, 43375, 51017, 58659 |
| anti-influenza_Chain | 5166 | 12808, 20450, 28092, 35734, 43376, 51018, 58660 |
| anti-influenza_Chain | 5167 | 12809, 20451, 28093, 35735, 43377, 51019, 58661 |
| anti-influenza_Chain | 5168 | 12810, 20452, 28094, 35736, 43378, 51020, 58662 |
| anti-influenza_Chain | 5169 | 12811, 20453, 28095, 35737, 43379, 51021, 58663 |
| anti-influenza_Chain | 5170 | 12812, 20454, 28096, 35738, 43380, 51022, 58664 |
| anti-influenza_Chain | 5171 | 12813, 20455, 28097, 35739, 43381, 51023, 58665 |
| anti-influenza_Chain | 5172 | 12814, 20456, 28098, 35740, 43382, 51024, 58666 |
| anti-influenza_Chain | 5173 | 12815, 20457, 28099, 35741, 43383, 51025, 58667 |
| anti-influenza_Chain | 5174 | 12816, 20458, 28100, 35742, 43384, 51026, 58668 |
| anti-influenza_Chain | 5175 | 12817, 20459, 28101, 35743, 43385, 51027, 58669 |
| anti-influenza_Chain | 5176 | 12818, 20460, 28102, 35744, 43386, 51028, 58670 |
| anti-influenza_Chain | 5177 | 12819, 20461, 28103, 35745, 43387, 51029, 58671 |
| anti-influenza_Chain | 5178 | 12820, 20462, 28104, 35746, 43388, 51030, 58672 |
| anti-influenza_Chain | 5179 | 12821, 20463, 28105, 35747, 43389, 51031, 58673 |
| anti-influenza_Chain | 5180 | 12822, 20464, 28106, 35748, 43390, 51032, 58674 |
| anti-influenza_Chain | 5181 | 12823, 20465, 28107, 35749, 43391, 51033, 58675 |
| anti-influenza_Chain | 5182 | 12824, 20466, 28108, 35750, 43392, 51034, 58676 |
| anti-influenza_Chain | 5183 | 12825, 20467, 28109, 35751, 43393, 51035, 58677 |
| anti-influenza_Chain | 5184 | 12826, 20468, 28110, 35752, 43394, 51036, 58678 |
| anti-influenza_Chain | 5185 | 12827, 20469, 28111, 35753, 43395, 51037, 58679 |
| anti-influenza_Chain | 5186 | 12828, 20470, 28112, 35754, 43396, 51038, 58680 |
| anti-influenza_Chain | 5187 | 12829, 20471, 28113, 35755, 43397, 51039, 58681 |
| anti-influenza_Chain | 5188 | 12830, 20472, 28114, 35756, 43398, 51040, 58682 |
| anti-influenza_Chain | 5189 | 12831, 20473, 28115, 35757, 43399, 51041, 58683 |
| anti-influenza_Chain | 5190 | 12832, 20474, 28116, 35758, 43400, 51042, 58684 |
| anti-influenza_Chain | 5191 | 12833, 20475, 28117, 35759, 43401, 51043, 58685 |
| anti-influenza_Chain | 5192 | 12834, 20476, 28118, 35760, 43402, 51044, 58686 |
| anti-influenza_Chain | 5193 | 12835, 20477, 28119, 35761, 43403, 51045, 58687 |
| anti-influenza_Chain | 5194 | 12836, 20478, 28120, 35762, 43404, 51046, 58688 |
| anti-influenza_Chain | 5195 | 12837, 20479, 28121, 35763, 43405, 51047, 58689 |
| anti-influenza_Chain | 5196 | 12838, 20480, 28122, 35764, 43406, 51048, 58690 |
| anti-influenza_Chain | 5197 | 12839, 20481, 28123, 35765, 43407, 51049, 58691 |
| anti-influenza_Chain | 5198 | 12840, 20482, 28124, 35766, 43408, 51050, 58692 |
| anti-influenza_Chain | 5199 | 12841, 20483, 28125, 35767, 43409, 51051, 58693 |
| anti-influenza_Chain | 5200 | 12842, 20484, 28126, 35768, 43410, 51052, 58694 |
| anti-influenza_Chain | 5201 | 12843, 20485, 28127, 35769, 43411, 51053, 58695 |
| anti-influenza_Chain | 5202 | 12844, 20486, 28128, 35770, 43412, 51054, 58696 |
| anti-influenza_Chain | 5203 | 12845, 20487, 28129, 35771, 43413, 51055, 58697 |
| anti-influenza_Chain | 5204 | 12846, 20488, 28130, 35772, 43414, 51056, 58698 |
| anti-influenza_Chain | 5205 | 12847, 20489, 28131, 35773, 43415, 51057, 58699 |
| anti-influenza_Chain | 5206 | 12848, 20490, 28132, 35774, 43416, 51058, 58700 |
| anti-influenza_Chain | 5207 | 12849, 20491, 28133, 35775, 43417, 51059, 58701 |
| anti-influenza_Chain | 5208 | 12850, 20492, 28134, 35776, 43418, 51060, 58702 |
| anti-influenza_Chain | 5209 | 12851, 20493, 28135, 35777, 43419, 51061, 58703 |
| anti-influenza_Chain | 5210 | 12852, 20494, 28136, 35778, 43420, 51062, 58704 |
| anti-influenza_Chain | 5211 | 12853, 20495, 28137, 35779, 43421, 51063, 58705 |
| anti-influenza_Chain | 5212 | 12854, 20496, 28138, 35780, 43422, 51064, 58706 |
| anti-influenza_Chain | 5213 | 12855, 20497, 28139, 35781, 43423, 51065, 58707 |
| anti-influenza_Chain | 5214 | 12856, 20498, 28140, 35782, 43424, 51066, 58708 |
| anti-influenza_Chain | 5215 | 12857, 20499, 28141, 35783, 43425, 51067, 58709 |
| anti-influenza_Chain | 5216 | 12858, 20500, 28142, 35784, 43426, 51068, 58710 |
| anti-influenza_Chain | 5217 | 12859, 20501, 28143, 35785, 43427, 51069, 58711 |
| anti-influenza_Chain | 5218 | 12860, 20502, 28144, 35786, 43428, 51070, 58712 |
| anti-influenza_Chain | 5219 | 12861, 20503, 28145, 35787, 43429, 51071, 58713 |
| anti-influenza_Chain | 5220 | 12862, 20504, 28146, 35788, 43430, 51072, 58714 |
| anti-influenza_Chain | 5221 | 12863, 20505, 28147, 35789, 43431, 51073, 58715 |
| anti-influenza_Chain | 5222 | 12864, 20506, 28148, 35790, 43432, 51074, 58716 |
| anti-influenza_Chain | 5223 | 12865, 20507, 28149, 35791, 43433, 51075, 58717 |
| anti-influenza_Chain | 5224 | 12866, 20508, 28150, 35792, 43434, 51076, 58718 |
| anti-influenza_Chain | 5225 | 12867, 20509, 28151, 35793, 43435, 51077, 58719 |
| anti-influenza_Chain | 5226 | 12868, 20510, 28152, 35794, 43436, 51078, 58720 |
| anti-influenza_Chain | 5227 | 12869, 20511, 28153, 35795, 43437, 51079, 58721 |
| anti-influenza_Chain | 5228 | 12870, 20512, 28154, 35796, 43438, 51080, 58722 |
| anti-influenza_Chain | 5229 | 12871, 20513, 28155, 35797, 43439, 51081, 58723 |
| anti-influenza_Chain | 5230 | 12872, 20514, 28156, 35798, 43440, 51082, 58724 |
| anti-influenza_Chain | 5231 | 12873, 20515, 28157, 35799, 43441, 51083, 58725 |
| anti-influenza_Chain | 5232 | 12874, 20516, 28158, 35800, 43442, 51084, 58726 |
| anti-influenza_Chain | 5233 | 12875, 20517, 28159, 35801, 43443, 51085, 58727 |
| anti-influenza_Chain | 5234 | 12876, 20518, 28160, 35802, 43444, 51086, 58728 |
| anti-influenza_Chain | 5235 | 12877, 20519, 28161, 35803, 43445, 51087, 58729 |
| anti-influenza_Chain | 5236 | 12878, 20520, 28162, 35804, 43446, 51088, 58730 |
| anti-influenza_Chain | 5237 | 12879, 20521, 28163, 35805, 43447, 51089, 58731 |
| anti-influenza_Chain | 5238 | 12880, 20522, 28164, 35806, 43448, 51090, 58732 |
| anti-influenza_Chain | 5239 | 12881, 20523, 28165, 35807, 43449, 51091, 58733 |
| anti-influenza_Chain | 5240 | 12882, 20524, 28166, 35808, 43450, 51092, 58734 |

TABLE 3-continued

RNA and amino acid sequences of exemplified antibodies

| Name | Protein SEQ ID NO | RNA SEQ ID NO |
| --- | --- | --- |
| anti-influenza_Chain | 5241 | 12883, 20525, 28167, 35809, 43451, 51093, 58735 |
| anti-influenza_Chain | 5242 | 12884, 20526, 28168, 35810, 43452, 51094, 58736 |
| anti-influenza_Chain | 5243 | 12885, 20527, 28169, 35811, 43453, 51095, 58737 |
| anti-influenza_Chain | 5244 | 12886, 20528, 28170, 35812, 43454, 51096, 58738 |
| anti-influenza_Chain | 5245 | 12887, 20529, 28171, 35813, 43455, 51097, 58739 |
| anti-influenza_Chain | 5246 | 12888, 20530, 28172, 35814, 43456, 51098, 58740 |
| anti-influenza_Chain | 5247 | 12889, 20531, 28173, 35815, 43457, 51099, 58741 |
| anti-influenza_Chain | 5248 | 12890, 20532, 28174, 35816, 43458, 51100, 58742 |
| anti-influenza_Chain | 5249 | 12891, 20533, 28175, 35817, 43459, 51101, 58743 |
| anti-influenza_Chain | 5250 | 12892, 20534, 28176, 35818, 43460, 51102, 58744 |
| anti-influenza_Chain | 5251 | 12893, 20535, 28177, 35819, 43461, 51103, 58745 |
| anti-influenza_Chain | 5252 | 12894, 20536, 28178, 35820, 43462, 51104, 58746 |
| anti-influenza_Chain | 5253 | 12895, 20537, 28179, 35821, 43463, 51105, 58747 |
| anti-influenza_Chain | 5254 | 12896, 20538, 28180, 35822, 43464, 51106, 58748 |
| anti-influenza_Chain | 5255 | 12897, 20539, 28181, 35823, 43465, 51107, 58749 |
| anti-influenza_Chain | 5256 | 12898, 20540, 28182, 35824, 43466, 51108, 58750 |
| anti-influenza_Chain | 5257 | 12899, 20541, 28183, 35825, 43467, 51109, 58751 |
| anti-influenza_Chain | 5258 | 12900, 20542, 28184, 35826, 43468, 51110, 58752 |
| anti-influenza_Chain | 5259 | 12901, 20543, 28185, 35827, 43469, 51111, 58753 |
| anti-influenza_Chain | 5260 | 12902, 20544, 28186, 35828, 43470, 51112, 58754 |
| anti-influenza_Chain | 5261 | 12903, 20545, 28187, 35829, 43471, 51113, 58755 |
| anti-influenza_Chain | 5262 | 12904, 20546, 28188, 35830, 43472, 51114, 58756 |
| anti-influenza_Chain | 5263 | 12905, 20547, 28189, 35831, 43473, 51115, 58757 |
| anti-influenza_Chain | 5264 | 12906, 20548, 28190, 35832, 43474, 51116, 58758 |
| anti-influenza_Chain | 5265 | 12907, 20549, 28191, 35833, 43475, 51117, 58759 |
| anti-influenza_Chain | 5266 | 12908, 20550, 28192, 35834, 43476, 51118, 58760 |
| anti-influenza_Chain | 5267 | 12909, 20551, 28193, 35835, 43477, 51119, 58761 |
| anti-influenza_Chain | 5268 | 12910, 20552, 28194, 35836, 43478, 51120, 58762 |
| anti-influenza_Chain | 5269 | 12911, 20553, 28195, 35837, 43479, 51121, 58763 |
| anti-influenza_Chain | 5270 | 12912, 20554, 28196, 35838, 43480, 51122, 58764 |
| anti-influenza_Chain | 5271 | 12913, 20555, 28197, 35839, 43481, 51123, 58765 |
| anti-influenza_Chain | 5272 | 12914, 20556, 28198, 35840, 43482, 51124, 58766 |
| anti-influenza_Chain | 5273 | 12915, 20557, 28199, 35841, 43483, 51125, 58767 |
| anti-influenza_Chain | 5274 | 12916, 20558, 28200, 35842, 43484, 51126, 58768 |
| anti-influenza_Chain | 5275 | 12917, 20559, 28201, 35843, 43485, 51127, 58769 |
| anti-influenza_Chain | 5276 | 12918, 20560, 28202, 35844, 43486, 51128, 58770 |
| anti-influenza_Chain | 5277 | 12919, 20561, 28203, 35845, 43487, 51129, 58771 |
| anti-influenza_Chain | 5278 | 12920, 20562, 28204, 35846, 43488, 51130, 58772 |
| anti-influenza_Chain | 5279 | 12921, 20563, 28205, 35847, 43489, 51131, 58773 |
| anti-influenza_Chain | 5280 | 12922, 20564, 28206, 35848, 43490, 51132, 58774 |
| anti-influenza_Chain | 5281 | 12923, 20565, 28207, 35849, 43491, 51133, 58775 |
| anti-influenza_Chain | 5282 | 12924, 20566, 28208, 35850, 43492, 51134, 58776 |
| anti-influenza_Chain | 5283 | 12925, 20567, 28209, 35851, 43493, 51135, 58777 |
| anti-influenza_Chain | 5284 | 12926, 20568, 28210, 35852, 43494, 51136, 58778 |
| anti-influenza_Chain | 5285 | 12927, 20569, 28211, 35853, 43495, 51137, 58779 |
| anti-influenza_Chain | 5286 | 12928, 20570, 28212, 35854, 43496, 51138, 58780 |
| anti-influenza_Chain | 5287 | 12929, 20571, 28213, 35855, 43497, 51139, 58781 |
| anti-influenza_Chain | 5288 | 12930, 20572, 28214, 35856, 43498, 51140, 58782 |
| anti-influenza_Chain | 5289 | 12931, 20573, 28215, 35857, 43499, 51141, 58783 |
| anti-influenza_Chain | 5290 | 12932, 20574, 28216, 35858, 43500, 51142, 58784 |
| anti-influenza_Chain | 5291 | 12933, 20575, 28217, 35859, 43501, 51143, 58785 |
| anti-influenza_Chain | 5292 | 12934, 20576, 28218, 35860, 43502, 51144, 58786 |
| anti-influenza_Chain | 5293 | 12935, 20577, 28219, 35861, 43503, 51145, 58787 |
| anti-influenza_Chain | 5294 | 12936, 20578, 28220, 35862, 43504, 51146, 58788 |
| anti-influenza_Chain | 5295 | 12937, 20579, 28221, 35863, 43505, 51147, 58789 |
| anti-influenza_Chain | 5296 | 12938, 20580, 28222, 35864, 43506, 51148, 58790 |
| anti-influenza_Chain | 5297 | 12939, 20581, 28223, 35865, 43507, 51149, 58791 |
| anti-influenza_Chain | 5298 | 12940, 20582, 28224, 35866, 43508, 51150, 58792 |
| anti-influenza_Chain | 5299 | 12941, 20583, 28225, 35867, 43509, 51151, 58793 |
| anti-influenza_Chain | 5300 | 12942, 20584, 28226, 35868, 43510, 51152, 58794 |
| anti-influenza_Chain | 5301 | 12943, 20585, 28227, 35869, 43511, 51153, 58795 |
| anti-influenza_Chain | 5302 | 12944, 20586, 28228, 35870, 43512, 51154, 58796 |
| anti-influenza_Chain | 5303 | 12945, 20587, 28229, 35871, 43513, 51155, 58797 |
| anti-influenza_Chain | 5304 | 12946, 20588, 28230, 35872, 43514, 51156, 58798 |
| anti-influenza_Chain | 5305 | 12947, 20589, 28231, 35873, 43515, 51157, 58799 |
| anti-influenza_Chain | 5306 | 12948, 20590, 28232, 35874, 43516, 51158, 58800 |
| anti-influenza_Chain | 5307 | 12949, 20591, 28233, 35875, 43517, 51159, 58801 |
| anti-influenza_Chain | 5308 | 12950, 20592, 28234, 35876, 43518, 51160, 58802 |
| anti-influenza_Chain | 5309 | 12951, 20593, 28235, 35877, 43519, 51161, 58803 |
| anti-influenza_Chain | 5310 | 12952, 20594, 28236, 35878, 43520, 51162, 58804 |
| anti-influenza_Chain | 5311 | 12953, 20595, 28237, 35879, 43521, 51163, 58805 |
| anti-influenza_Chain | 5312 | 12954, 20596, 28238, 35880, 43522, 51164, 58806 |
| anti-influenza_Chain | 5313 | 12955, 20597, 28239, 35881, 43523, 51165, 58807 |
| anti-influenza_Chain | 5314 | 12956, 20598, 28240, 35882, 43524, 51166, 58808 |
| anti-influenza_Chain | 5315 | 12957, 20599, 28241, 35883, 43525, 51167, 58809 |
| anti-influenza_Chain | 5316 | 12958, 20600, 28242, 35884, 43526, 51168, 58810 |

TABLE 3-continued

RNA and amino acid sequences of exemplified antibodies

| Name | Protein SEQ ID NO | RNA SEQ ID NO |
| --- | --- | --- |
| anti-influenza_Chain | 5317 | 12959, 20601, 28243, 35885, 43527, 51169, 58811 |
| anti-influenza_Chain | 5318 | 12960, 20602, 28244, 35886, 43528, 51170, 58812 |
| anti-influenza_Chain | 5319 | 12961, 20603, 28245, 35887, 43529, 51171, 58813 |
| anti-influenza_Chain | 5320 | 12962, 20604, 28246, 35888, 43530, 51172, 58814 |
| anti-influenza_Chain | 5321 | 12963, 20605, 28247, 35889, 43531, 51173, 58815 |
| anti-influenza_Chain | 5322 | 12964, 20606, 28248, 35890, 43532, 51174, 58816 |
| anti-influenza_Chain | 5323 | 12965, 20607, 28249, 35891, 43533, 51175, 58817 |
| anti-influenza_Chain | 5324 | 12966, 20608, 28250, 35892, 43534, 51176, 58818 |
| anti-influenza_Chain | 5325 | 12967, 20609, 28251, 35893, 43535, 51177, 58819 |
| anti-influenza_Chain | 5326 | 12968, 20610, 28252, 35894, 43536, 51178, 58820 |
| anti-influenza_Chain | 5327 | 12969, 20611, 28253, 35895, 43537, 51179, 58821 |
| anti-influenza_Chain | 5328 | 12970, 20612, 28254, 35896, 43538, 51180, 58822 |
| anti-influenza_Chain | 5329 | 12971, 20613, 28255, 35897, 43539, 51181, 58823 |
| anti-influenza_Chain | 5330 | 12972, 20614, 28256, 35898, 43540, 51182, 58824 |
| anti-influenza_Chain | 5331 | 12973, 20615, 28257, 35899, 43541, 51183, 58825 |
| anti-influenza_Chain | 5332 | 12974, 20616, 28258, 35900, 43542, 51184, 58826 |
| anti-influenza_Chain | 5333 | 12975, 20617, 28259, 35901, 43543, 51185, 58827 |
| anti-influenza_Chain | 5334 | 12976, 20618, 28260, 35902, 43544, 51186, 58828 |
| anti-influenza_Chain | 5335 | 12977, 20619, 28261, 35903, 43545, 51187, 58829 |
| anti-influenza_Chain | 5336 | 12978, 20620, 28262, 35904, 43546, 51188, 58830 |
| anti-influenza_Chain | 5337 | 12979, 20621, 28263, 35905, 43547, 51189, 58831 |
| anti-influenza_Chain | 5338 | 12980, 20622, 28264, 35906, 43548, 51190, 58832 |
| anti-influenza_Chain | 5339 | 12981, 20623, 28265, 35907, 43549, 51191, 58833 |
| anti-influenza_Chain | 5340 | 12982, 20624, 28266, 35908, 43550, 51192, 58834 |
| anti-influenza_Chain | 5341 | 12983, 20625, 28267, 35909, 43551, 51193, 58835 |
| anti-influenza_Chain | 5342 | 12984, 20626, 28268, 35910, 43552, 51194, 58836 |
| anti-influenza_Chain | 5343 | 12985, 20627, 28269, 35911, 43553, 51195, 58837 |
| anti-influenza_Chain | 5344 | 12986, 20628, 28270, 35912, 43554, 51196, 58838 |
| anti-influenza_Chain | 5345 | 12987, 20629, 28271, 35913, 43555, 51197, 58839 |
| anti-influenza_Chain | 5346 | 12988, 20630, 28272, 35914, 43556, 51198, 58840 |
| anti-influenza_Chain | 5347 | 12989, 20631, 28273, 35915, 43557, 51199, 58841 |
| anti-influenza_Chain | 5348 | 12990, 20632, 28274, 35916, 43558, 51200, 58842 |
| anti-influenza_Chain | 5349 | 12991, 20633, 28275, 35917, 43559, 51201, 58843 |
| anti-influenza_Chain | 5350 | 12992, 20634, 28276, 35918, 43560, 51202, 58844 |
| anti-influenza_Chain | 5351 | 12993, 20635, 28277, 35919, 43561, 51203, 58845 |
| anti-influenza_Chain | 5352 | 12994, 20636, 28278, 35920, 43562, 51204, 58846 |
| anti-influenza_Chain | 5353 | 12995, 20637, 28279, 35921, 43563, 51205, 58847 |
| anti-influenza_Chain | 5354 | 12996, 20638, 28280, 35922, 43564, 51206, 58848 |
| anti-influenza_Chain | 5355 | 12997, 20639, 28281, 35923, 43565, 51207, 58849 |
| anti-influenza_Chain | 5356 | 12998, 20640, 28282, 35924, 43566, 51208, 58850 |
| anti-influenza_Chain | 5357 | 12999, 20641, 28283, 35925, 43567, 51209, 58851 |
| anti-influenza_Chain | 5358 | 13000, 20642, 28284, 35926, 43568, 51210, 58852 |
| anti-influenza_Chain | 5359 | 13001, 20643, 28285, 35927, 43569, 51211, 58853 |
| anti-influenza_Chain | 5360 | 13002, 20644, 28286, 35928, 43570, 51212, 58854 |
| anti-influenza_Chain | 5361 | 13003, 20645, 28287, 35929, 43571, 51213, 58855 |
| anti-influenza_Chain | 5362 | 13004, 20646, 28288, 35930, 43572, 51214, 58856 |
| anti-influenza_Chain | 5363 | 13005, 20647, 28289, 35931, 43573, 51215, 58857 |
| anti-influenza_Chain | 5364 | 13006, 20648, 28290, 35932, 43574, 51216, 58858 |
| anti-influenza_Chain | 5365 | 13007, 20649, 28291, 35933, 43575, 51217, 58859 |
| anti-influenza_Chain | 5366 | 13008, 20650, 28292, 35934, 43576, 51218, 58860 |
| anti-influenza_Chain | 5367 | 13009, 20651, 28293, 35935, 43577, 51219, 58861 |
| anti-influenza_Chain | 5368 | 13010, 20652, 28294, 35936, 43578, 51220, 58862 |
| anti-influenza_Chain | 5369 | 13011, 20653, 28295, 35937, 43579, 51221, 58863 |
| anti-influenza_Chain | 5370 | 13012, 20654, 28296, 35938, 43580, 51222, 58864 |
| anti-influenza_Chain | 5371 | 13013, 20655, 28297, 35939, 43581, 51223, 58865 |
| anti-influenza_Chain | 5372 | 13014, 20656, 28298, 35940, 43582, 51224, 58866 |
| anti-influenza_Chain | 5373 | 13015, 20657, 28299, 35941, 43583, 51225, 58867 |
| anti-influenza_Chain | 5374 | 13016, 20658, 28300, 35942, 43584, 51226, 58868 |
| anti-influenza_Chain | 5375 | 13017, 20659, 28301, 35943, 43585, 51227, 58869 |
| anti-influenza_Chain | 5376 | 13018, 20660, 28302, 35944, 43586, 51228, 58870 |
| anti-influenza_Chain | 5377 | 13019, 20661, 28303, 35945, 43587, 51229, 58871 |
| anti-influenza_Chain | 5378 | 13020, 20662, 28304, 35946, 43588, 51230, 58872 |
| anti-influenza_Chain | 5379 | 13021, 20663, 28305, 35947, 43589, 51231, 58873 |
| anti-influenza_Chain | 5380 | 13022, 20664, 28306, 35948, 43590, 51232, 58874 |
| anti-influenza_Chain | 5381 | 13023, 20665, 28307, 35949, 43591, 51233, 58875 |
| anti-influenza_Chain | 5382 | 13024, 20666, 28308, 35950, 43592, 51234, 58876 |
| anti-influenza_Chain | 5383 | 13025, 20667, 28309, 35951, 43593, 51235, 58877 |
| anti-influenza_Chain | 5384 | 13026, 20668, 28310, 35952, 43594, 51236, 58878 |
| anti-influenza_Chain | 5385 | 13027, 20669, 28311, 35953, 43595, 51237, 58879 |
| anti-influenza_Chain | 5386 | 13028, 20670, 28312, 35954, 43596, 51238, 58880 |
| anti-influenza_Chain | 5387 | 13029, 20671, 28313, 35955, 43597, 51239, 58881 |
| anti-influenza_Chain | 5388 | 13030, 20672, 28314, 35956, 43598, 51240, 58882 |
| anti-influenza_Chain | 5389 | 13031, 20673, 28315, 35957, 43599, 51241, 58883 |
| anti-influenza_Chain | 5390 | 13032, 20674, 28316, 35958, 43600, 51242, 58884 |
| anti-influenza_Chain | 5391 | 13033, 20675, 28317, 35959, 43601, 51243, 58885 |
| anti-influenza_Chain | 5392 | 13034, 20676, 28318, 35960, 43602, 51244, 58886 |

TABLE 3-continued

RNA and amino acid sequences of exemplified antibodies

| Name | Protein SEQ ID NO | RNA SEQ ID NO |
| --- | --- | --- |
| anti-influenza_Chain | 5393 | 13035, 20677, 28319, 35961, 43603, 51245, 58887 |
| anti-influenza_Chain | 5394 | 13036, 20678, 28320, 35962, 43604, 51246, 58888 |
| anti-influenza_Chain | 5395 | 13037, 20679, 28321, 35963, 43605, 51247, 58889 |
| anti-influenza_Chain | 5396 | 13038, 20680, 28322, 35964, 43606, 51248, 58890 |
| anti-influenza_Chain | 5397 | 13039, 20681, 28323, 35965, 43607, 51249, 58891 |
| anti-influenza_Chain | 5398 | 13040, 20682, 28324, 35966, 43608, 51250, 58892 |
| anti-influenza_Chain | 5399 | 13041, 20683, 28325, 35967, 43609, 51251, 58893 |
| anti-influenza_Chain | 5400 | 13042, 20684, 28326, 35968, 43610, 51252, 58894 |
| anti-influenza_Chain | 5401 | 13043, 20685, 28327, 35969, 43611, 51253, 58895 |
| anti-influenza_Chain | 5402 | 13044, 20686, 28328, 35970, 43612, 51254, 58896 |
| anti-influenza_Chain | 5403 | 13045, 20687, 28329, 35971, 43613, 51255, 58897 |
| anti-influenza_Chain | 5404 | 13046, 20688, 28330, 35972, 43614, 51256, 58898 |
| anti-influenza_Chain | 5405 | 13047, 20689, 28331, 35973, 43615, 51257, 58899 |
| anti-influenza_Chain | 5406 | 13048, 20690, 28332, 35974, 43616, 51258, 58900 |
| anti-influenza_Chain | 5407 | 13049, 20691, 28333, 35975, 43617, 51259, 58901 |
| anti-influenza_Chain | 5408 | 13050, 20692, 28334, 35976, 43618, 51260, 58902 |
| anti-influenza_Chain | 5409 | 13051, 20693, 28335, 35977, 43619, 51261, 58903 |
| anti-influenza_Chain | 5410 | 13052, 20694, 28336, 35978, 43620, 51262, 58904 |
| anti-influenza_Chain | 5411 | 13053, 20695, 28337, 35979, 43621, 51263, 58905 |
| anti-influenza_Chain | 5412 | 13054, 20696, 28338, 35980, 43622, 51264, 58906 |
| anti-influenza_Chain | 5413 | 13055, 20697, 28339, 35981, 43623, 51265, 58907 |
| anti-influenza_Chain | 5414 | 13056, 20698, 28340, 35982, 43624, 51266, 58908 |
| anti-influenza_Chain | 5415 | 13057, 20699, 28341, 35983, 43625, 51267, 58909 |
| anti-influenza_Chain | 5416 | 13058, 20700, 28342, 35984, 43626, 51268, 58910 |
| anti-influenza_Chain | 5417 | 13059, 20701, 28343, 35985, 43627, 51269, 58911 |
| anti-influenza_Chain | 5418 | 13060, 20702, 28344, 35986, 43628, 51270, 58912 |
| anti-influenza_Chain | 5419 | 13061, 20703, 28345, 35987, 43629, 51271, 58913 |
| anti-influenza_Chain | 5420 | 13062, 20704, 28346, 35988, 43630, 51272, 58914 |
| anti-influenza_Chain | 5421 | 13063, 20705, 28347, 35989, 43631, 51273, 58915 |
| anti-influenza_Chain | 5422 | 13064, 20706, 28348, 35990, 43632, 51274, 58916 |
| anti-influenza_Chain | 5423 | 13065, 20707, 28349, 35991, 43633, 51275, 58917 |
| anti-influenza_Chain | 5424 | 13066, 20708, 28350, 35992, 43634, 51276, 58918 |
| anti-influenza_Chain | 5425 | 13067, 20709, 28351, 35993, 43635, 51277, 58919 |
| anti-influenza_Chain | 5426 | 13068, 20710, 28352, 35994, 43636, 51278, 58920 |
| anti-influenza_Chain | 5427 | 13069, 20711, 28353, 35995, 43637, 51279, 58921 |
| anti-influenza_Chain | 5428 | 13070, 20712, 28354, 35996, 43638, 51280, 58922 |
| anti-influenza_Chain | 5429 | 13071, 20713, 28355, 35997, 43639, 51281, 58923 |
| anti-influenza_Chain | 5430 | 13072, 20714, 28356, 35998, 43640, 51282, 58924 |
| anti-influenza_Chain | 5431 | 13073, 20715, 28357, 35999, 43641, 51283, 58925 |
| anti-influenza_Chain | 5432 | 13074, 20716, 28358, 36000, 43642, 51284, 58926 |
| anti-influenza_Chain | 5433 | 13075, 20717, 28359, 36001, 43643, 51285, 58927 |
| anti-influenza_Chain | 5434 | 13076, 20718, 28360, 36002, 43644, 51286, 58928 |
| anti-influenza_Chain | 5435 | 13077, 20719, 28361, 36003, 43645, 51287, 58929 |
| anti-influenza_Chain | 5436 | 13078, 20720, 28362, 36004, 43646, 51288, 58930 |
| anti-influenza_Chain | 5437 | 13079, 20721, 28363, 36005, 43647, 51289, 58931 |
| anti-influenza_Chain | 5438 | 13080, 20722, 28364, 36006, 43648, 51290, 58932 |
| anti-influenza_Chain | 5439 | 13081, 20723, 28365, 36007, 43649, 51291, 58933 |
| anti-influenza_Chain | 5440 | 13082, 20724, 28366, 36008, 43650, 51292, 58934 |
| anti-influenza_Chain | 5441 | 13083, 20725, 28367, 36009, 43651, 51293, 58935 |
| anti-influenza_Chain | 5442 | 13084, 20726, 28368, 36010, 43652, 51294, 58936 |
| anti-influenza_Chain | 5443 | 13085, 20727, 28369, 36011, 43653, 51295, 58937 |
| anti-influenza_Chain | 5444 | 13086, 20728, 28370, 36012, 43654, 51296, 58938 |
| anti-influenza_Chain | 5445 | 13087, 20729, 28371, 36013, 43655, 51297, 58939 |
| anti-influenza_Chain | 5446 | 13088, 20730, 28372, 36014, 43656, 51298, 58940 |
| anti-influenza_Chain | 5447 | 13089, 20731, 28373, 36015, 43657, 51299, 58941 |
| anti-influenza_Chain | 5448 | 13090, 20732, 28374, 36016, 43658, 51300, 58942 |
| anti-influenza_Chain | 5449 | 13091, 20733, 28375, 36017, 43659, 51301, 58943 |
| anti-influenza_Chain | 5450 | 13092, 20734, 28376, 36018, 43660, 51302, 58944 |
| anti-influenza_Chain | 5451 | 13093, 20735, 28377, 36019, 43661, 51303, 58945 |
| anti-influenza_Chain | 5452 | 13094, 20736, 28378, 36020, 43662, 51304, 58946 |
| anti-influenza_Chain | 5453 | 13095, 20737, 28379, 36021, 43663, 51305, 58947 |
| anti-influenza_Chain | 5454 | 13096, 20738, 28380, 36022, 43664, 51306, 58948 |
| anti-influenza_Chain | 5455 | 13097, 20739, 28381, 36023, 43665, 51307, 58949 |
| anti-influenza_Chain | 5456 | 13098, 20740, 28382, 36024, 43666, 51308, 58950 |
| anti-influenza_Chain | 5457 | 13099, 20741, 28383, 36025, 43667, 51309, 58951 |
| anti-influenza_Chain | 5458 | 13100, 20742, 28384, 36026, 43668, 51310, 58952 |
| anti-influenza_Chain | 5459 | 13101, 20743, 28385, 36027, 43669, 51311, 58953 |
| anti-influenza_Chain | 5460 | 13102, 20744, 28386, 36028, 43670, 51312, 58954 |
| anti-influenza_Chain | 5461 | 13103, 20745, 28387, 36029, 43671, 51313, 58955 |
| anti-influenza_Chain | 5462 | 13104, 20746, 28388, 36030, 43672, 51314, 58956 |
| anti-influenza_Chain | 5463 | 13105, 20747, 28389, 36031, 43673, 51315, 58957 |
| anti-influenza_Chain | 5464 | 13106, 20748, 28390, 36032, 43674, 51316, 58958 |
| anti-influenza_Chain | 5465 | 13107, 20749, 28391, 36033, 43675, 51317, 58959 |
| anti-influenza_Chain | 5466 | 13108, 20750, 28392, 36034, 43676, 51318, 58960 |
| anti-influenza_Chain | 5467 | 13109, 20751, 28393, 36035, 43677, 51319, 58961 |
| anti-influenza_Chain | 5468 | 13110, 20752, 28394, 36036, 43678, 51320, 58962 |

TABLE 3-continued

RNA and amino acid sequences of exemplified antibodies

| Name | Protein SEQ ID NO | RNA SEQ ID NO |
| --- | --- | --- |
| anti-influenza_Chain | 5469 | 13111, 20753, 28395, 36037, 43679, 51321, 58963 |
| anti-influenza_Chain | 5470 | 13112, 20754, 28396, 36038, 43680, 51322, 58964 |
| anti-influenza_Chain | 5471 | 13113, 20755, 28397, 36039, 43681, 51323, 58965 |
| anti-influenza_Chain | 5472 | 13114, 20756, 28398, 36040, 43682, 51324, 58966 |
| anti-influenza_Chain | 5473 | 13115, 20757, 28399, 36041, 43683, 51325, 58967 |
| anti-influenza_Chain | 5474 | 13116, 20758, 28400, 36042, 43684, 51326, 58968 |
| anti-influenza_Chain | 5475 | 13117, 20759, 28401, 36043, 43685, 51327, 58969 |
| anti-influenza_Chain | 5476 | 13118, 20760, 28402, 36044, 43686, 51328, 58970 |
| anti-influenza_Chain | 5477 | 13119, 20761, 28403, 36045, 43687, 51329, 58971 |
| anti-influenza_Chain | 5478 | 13120, 20762, 28404, 36046, 43688, 51330, 58972 |
| anti-influenza_Chain | 5479 | 13121, 20763, 28405, 36047, 43689, 51331, 58973 |
| anti-influenza_Chain | 5480 | 13122, 20764, 28406, 36048, 43690, 51332, 58974 |
| anti-influenza_Chain | 5481 | 13123, 20765, 28407, 36049, 43691, 51333, 58975 |
| anti-influenza_Chain | 5482 | 13124, 20766, 28408, 36050, 43692, 51334, 58976 |
| anti-influenza_Chain | 5483 | 13125, 20767, 28409, 36051, 43693, 51335, 58977 |
| anti-influenza_Chain | 5484 | 13126, 20768, 28410, 36052, 43694, 51336, 58978 |
| anti-influenza_Chain | 5485 | 13127, 20769, 28411, 36053, 43695, 51337, 58979 |
| anti-influenza_Chain | 5486 | 13128, 20770, 28412, 36054, 43696, 51338, 58980 |
| anti-influenza_Chain | 5487 | 13129, 20771, 28413, 36055, 43697, 51339, 58981 |
| anti-influenza_Chain | 5488 | 13130, 20772, 28414, 36056, 43698, 51340, 58982 |
| anti-influenza_Chain | 5489 | 13131, 20773, 28415, 36057, 43699, 51341, 58983 |
| anti-influenza_Chain | 5490 | 13132, 20774, 28416, 36058, 43700, 51342, 58984 |
| anti-influenza_Chain | 5491 | 13133, 20775, 28417, 36059, 43701, 51343, 58985 |
| anti-influenza_Chain | 5492 | 13134, 20776, 28418, 36060, 43702, 51344, 58986 |
| anti-influenza_Chain | 5493 | 13135, 20777, 28419, 36061, 43703, 51345, 58987 |
| anti-influenza_Chain | 5494 | 13136, 20778, 28420, 36062, 43704, 51346, 58988 |
| anti-influenza_Chain | 5495 | 13137, 20779, 28421, 36063, 43705, 51347, 58989 |
| anti-influenza_Chain | 5496 | 13138, 20780, 28422, 36064, 43706, 51348, 58990 |
| anti-influenza_Chain | 5497 | 13139, 20781, 28423, 36065, 43707, 51349, 58991 |
| anti-influenza_Chain | 5498 | 13140, 20782, 28424, 36066, 43708, 51350, 58992 |
| anti-influenza_Chain | 5499 | 13141, 20783, 28425, 36067, 43709, 51351, 58993 |
| anti-influenza_Chain | 5500 | 13142, 20784, 28426, 36068, 43710, 51352, 58994 |
| anti-influenza_Chain | 5501 | 13143, 20785, 28427, 36069, 43711, 51353, 58995 |
| anti-influenza_Chain | 5502 | 13144, 20786, 28428, 36070, 43712, 51354, 58996 |
| anti-influenza_Chain | 5503 | 13145, 20787, 28429, 36071, 43713, 51355, 58997 |
| anti-influenza_Chain | 5504 | 13146, 20788, 28430, 36072, 43714, 51356, 58998 |
| anti-influenza_Chain | 5505 | 13147, 20789, 28431, 36073, 43715, 51357, 58999 |
| anti-influenza_Chain | 5506 | 13148, 20790, 28432, 36074, 43716, 51358, 59000 |
| anti-influenza_Chain | 5507 | 13149, 20791, 28433, 36075, 43717, 51359, 59001 |
| anti-influenza_Chain | 5508 | 13150, 20792, 28434, 36076, 43718, 51360, 59002 |
| anti-influenza_Chain | 5509 | 13151, 20793, 28435, 36077, 43719, 51361, 59003 |
| anti-influenza_Chain | 5510 | 13152, 20794, 28436, 36078, 43720, 51362, 59004 |
| anti-influenza_Chain | 5511 | 13153, 20795, 28437, 36079, 43721, 51363, 59005 |
| anti-influenza_Chain | 5512 | 13154, 20796, 28438, 36080, 43722, 51364, 59006 |
| anti-influenza_Chain | 5513 | 13155, 20797, 28439, 36081, 43723, 51365, 59007 |
| anti-influenza_Chain | 5514 | 13156, 20798, 28440, 36082, 43724, 51366, 59008 |
| anti-influenza_Chain | 5515 | 13157, 20799, 28441, 36083, 43725, 51367, 59009 |
| anti-influenza_Chain | 5516 | 13158, 20800, 28442, 36084, 43726, 51368, 59010 |
| anti-influenza_Chain | 5517 | 13159, 20801, 28443, 36085, 43727, 51369, 59011 |
| anti-influenza_Chain | 5518 | 13160, 20802, 28444, 36086, 43728, 51370, 59012 |
| anti-influenza_Chain | 5519 | 13161, 20803, 28445, 36087, 43729, 51371, 59013 |
| anti-influenza_Chain | 5520 | 13162, 20804, 28446, 36088, 43730, 51372, 59014 |
| anti-influenza_Chain | 5521 | 13163, 20805, 28447, 36089, 43731, 51373, 59015 |
| anti-influenza_Chain | 5522 | 13164, 20806, 28448, 36090, 43732, 51374, 59016 |
| anti-influenza_Chain | 5523 | 13165, 20807, 28449, 36091, 43733, 51375, 59017 |
| anti-influenza_Chain | 5524 | 13166, 20808, 28450, 36092, 43734, 51376, 59018 |
| anti-influenza_Chain | 5525 | 13167, 20809, 28451, 36093, 43735, 51377, 59019 |
| anti-influenza_Chain | 5526 | 13168, 20810, 28452, 36094, 43736, 51378, 59020 |
| anti-influenza_Chain | 5527 | 13169, 20811, 28453, 36095, 43737, 51379, 59021 |
| anti-influenza_Chain | 5528 | 13170, 20812, 28454, 36096, 43738, 51380, 59022 |
| anti-influenza_Chain | 5529 | 13171, 20813, 28455, 36097, 43739, 51381, 59023 |
| anti-influenza_Chain | 5530 | 13172, 20814, 28456, 36098, 43740, 51382, 59024 |
| anti-influenza_Chain | 5531 | 13173, 20815, 28457, 36099, 43741, 51383, 59025 |
| anti-influenza_Chain | 5532 | 13174, 20816, 28458, 36100, 43742, 51384, 59026 |
| anti-influenza_Chain | 5533 | 13175, 20817, 28459, 36101, 43743, 51385, 59027 |
| anti-influenza_Chain | 5534 | 13176, 20818, 28460, 36102, 43744, 51386, 59028 |
| anti-influenza_Chain | 5535 | 13177, 20819, 28461, 36103, 43745, 51387, 59029 |
| anti-influenza_Chain | 5536 | 13178, 20820, 28462, 36104, 43746, 51388, 59030 |
| anti-influenza_Chain | 5537 | 13179, 20821, 28463, 36105, 43747, 51389, 59031 |
| anti-influenza_Chain | 5538 | 13180, 20822, 28464, 36106, 43748, 51390, 59032 |
| anti-influenza_Chain | 5539 | 13181, 20823, 28465, 36107, 43749, 51391, 59033 |
| anti-OX40_LightChain | 5540 | 13182, 20824, 28466, 36108, 43750, 51392, 59034 |
| anti-OX40_LightChain | 5541 | 13183, 20825, 28467, 36109, 43751, 51393, 59035 |
| anti-OX40_LightChain | 5542 | 13184, 20826, 28468, 36110, 43752, 51394, 59036 |
| anti-OX40_LightChain | 5543 | 13185, 20827, 28469, 36111, 43753, 51395, 59037 |
| anti-OX40_LightChain | 5544 | 13186, 20828, 28470, 36112, 43754, 51396, 59038 |

TABLE 3-continued

RNA and amino acid sequences of exemplified antibodies

| Name | Protein SEQ ID NO | RNA SEQ ID NO |
|---|---|---|
| anti-OX40_LightChain | 5545 | 13187, 20829, 28471, 36113, 43755, 51397, 59039 |
| anti-OX40_LightChain | 5546 | 13188, 20830, 28472, 36114, 43756, 51398, 59040 |
| anti-OX40_LightChain | 5547 | 13189, 20831, 28473, 36115, 43757, 51399, 59041 |
| anti-OX40_LightChain | 5548 | 13190, 20832, 28474, 36116, 43758, 51400, 59042 |
| anti-OX40_LightChain | 5549 | 13191, 20833, 28475, 36117, 43759, 51401, 59043 |
| anti-OX40_LightChain | 5550 | 13192, 20834, 28476, 36118, 43760, 51402, 59044 |
| anti-OX40_LightChain | 5551 | 13193, 20835, 28477, 36119, 43761, 51403, 59045 |
| anti-OX40_LightChain | 5552 | 13194, 20836, 28478, 36120, 43762, 51404, 59046 |
| anti-OX40_LightChain | 5553 | 13195, 20837, 28479, 36121, 43763, 51405, 59047 |
| anti-OX40_HeavyChain | 5554 | 13196, 20838, 28480, 36122, 43764, 51406, 59048 |
| anti-OX40_HeavyChain | 5555 | 13197, 20839, 28481, 36123, 43765, 51407, 59049 |
| anti-OX40_HeavyChain | 5556 | 13198, 20840, 28482, 36124, 43766, 51408, 59050 |
| anti-OX40_HeavyChain | 5557 | 13199, 20841, 28483, 36125, 43767, 51409, 59051 |
| anti-OX40_HeavyChain | 5558 | 13200, 20842, 28484, 36126, 43768, 51410, 59052 |
| anti-OX40_HeavyChain | 5559 | 13201, 20843, 28485, 36127, 43769, 51411, 59053 |
| anti-OX40_HeavyChain | 5560 | 13202, 20844, 28486, 36128, 43770, 51412, 59054 |
| anti-OX40_HeavyChain | 5561 | 13203, 20845, 28487, 36129, 43771, 51413, 59055 |
| anti-OX40_HeavyChain | 5562 | 13204, 20846, 28488, 36130, 43772, 51414, 59056 |
| anti-OX40_HeavyChain | 5563 | 13205, 20847, 28489, 36131, 43773, 51415, 59057 |
| anti-OX40_HeavyChain | 5564 | 13206, 20848, 28490, 36132, 43774, 51416, 59058 |
| anti-OX40_HeavyChain | 5565 | 13207, 20849, 28491, 36133, 43775, 51417, 59059 |
| anti-OX40_HeavyChain | 5566 | 13208, 20850, 28492, 36134, 43776, 51418, 59060 |
| anti-OX40_HeavyChain | 5567 | 13209, 20851, 28493, 36135, 43777, 51419, 59061 |
| anti-OX40_HeavyChain | 5568 | 13210, 20852, 28494, 36136, 43778, 51420, 59062 |
| anti-OX40_HeavyChain | 5569 | 13211, 20853, 28495, 36137, 43779, 51421, 59063 |
| anti-OX40_HeavyChain | 5570 | 13212, 20854, 28496, 36138, 43780, 51422, 59064 |
| anti-OX40_HeavyChain | 5571 | 13213, 20855, 28497, 36139, 43781, 51423, 59065 |
| anti-OX40_HeavyChain | 5572 | 13214, 20856, 28498, 36140, 43782, 51424, 59066 |
| anti-OX40_HeavyChain | 5573 | 13215, 20857, 28499, 36141, 43783, 51425, 59067 |
| anti-OX40_HeavyChain | 5574 | 13216, 20858, 28500, 36142, 43784, 51426, 59068 |
| anti-OX40_HeavyChain | 5575 | 13217, 20859, 28501, 36143, 43785, 51427, 59069 |
| anti-OX40_HeavyChain | 5576 | 13218, 20860, 28502, 36144, 43786, 51428, 59070 |
| anti-OX40_HeavyChain | 5577 | 13219, 20861, 28503, 36145, 43787, 51429, 59071 |
| anti-OX40_HeavyChain | 5578 | 13220, 20862, 28504, 36146, 43788, 51430, 59072 |
| anti-OX40_HeavyChain | 5579 | 13221, 20863, 28505, 36147, 43789, 51431, 59073 |
| anti-OX40_HeavyChain | 5580 | 13222, 20864, 28506, 36148, 43790, 51432, 59074 |
| anti-OX40_HeavyChain | 5581 | 13223, 20865, 28507, 36149, 43791, 51433, 59075 |
| anti-OX40_HeavyChain | 5582 | 13224, 20866, 28508, 36150, 43792, 51434, 59076 |
| anti-OX40_HeavyChain | 5583 | 13225, 20867, 28509, 36151, 43793, 51435, 59077 |
| anti-OX40_HeavyChain | 5584 | 13226, 20868, 28510, 36152, 43794, 51436, 59078 |
| anti-OX40_HeavyChain | 5585 | 13227, 20869, 28511, 36153, 43795, 51437, 59079 |
| anti-OX40_HeavyChain | 5586 | 13228, 20870, 28512, 36154, 43796, 51438, 59080 |
| anti-OX40_HeavyChain | 5587 | 13229, 20871, 28513, 36155, 43797, 51439, 59081 |
| anti-OX40_HeavyChain | 5588 | 13230, 20872, 28514, 36156, 43798, 51440, 59082 |
| anti-OX40_LightChain | 5589 | 13231, 20873, 28515, 36157, 43799, 51441, 59083 |
| anti-OX40_LightChain | 5590 | 13232, 20874, 28516, 36158, 43800, 51442, 59084 |
| anti-OX40_LightChain | 5591 | 13233, 20875, 28517, 36159, 43801, 51443, 59085 |
| anti-OX40_LightChain | 5592 | 13234, 20876, 28518, 36160, 43802, 51444, 59086 |
| anti-OX40_LightChain | 5593 | 13235, 20877, 28519, 36161, 43803, 51445, 59087 |
| anti-OX40_HeavyChain | 5594 | 13236, 20878, 28520, 36162, 43804, 51446, 59088 |
| anti-OX40_HeavyChain | 5595 | 13237, 20879, 28521, 36163, 43805, 51447, 59089 |
| anti-OX40_HeavyChain | 5596 | 13238, 20880, 28522, 36164, 43806, 51448, 59090 |
| anti-OX40_HeavyChain | 5597 | 13239, 20881, 28523, 36165, 43807, 51449, 59091 |
| anti-OX40_HeavyChain | 5598 | 13240, 20882, 28524, 36166, 43808, 51450, 59092 |
| anti-OX40_LightChain | 5599 | 13241, 20883, 28525, 36167, 43809, 51451, 59093 |
| anti-OX40_HeavyChain | 5600 | 13242, 20884, 28526, 36168, 43810, 51452, 59094 |

In a preferred embodiment the at least one coding sequence of the RNA according to the present invention encodes an antibody, i.e. in particular a full length ("complete") antibody. In other words, it is preferred that a full length ("complete") antibody is encoded by a single RNA (molecule). This may be realized by a monocistronic RNA (wherein heavy and light chain or fragments thereof such as the respective variable regions may, for example, be connected via a peptidic linker) or by a bi- or multicistronic RNA, wherein different fragments of the antibody, such as the heavy chain (or a fragment thereof, e.g. the heavy chain variable region) and the light chain (or a fragment thereof, e.g. the light chain variable region), are encoded in separate cistrons as described herein. It is also preferred that the at least one coding sequence of the RNA according to the present invention encodes a fragment of an antibody only, such as the heavy chain (or a fragment thereof, e.g. the heavy chain variable region) or the light chain (or a fragment thereof, e.g. the light chain variable region), with the corresponding fragment(s) required for a functional antibody being encoded by another RNA (molecule) according to the present invention.

For example, for the antibody abagovomab, the RNA according to the present invention may encode (i) the heavy chain (amino acid sequence according to SEQ ID NO: 2), for example by an RNA sequence according to any of SEQ ID NOs: 7644, 15286, 22928, 30570, 38212, 45854, 53496, or a fragment or variant thereof; and (ii) the light chain (amino acid sequence according to SEQ ID NO: 3), for example by an RNA sequence according to any of SEQ ID NOs: 7645, 15287, 22929, 30571, 38213, 45855, 53497, or a fragment or variant thereof in a monocistronic (e.g., connected by a peptide linker) or in a multicistronic, in particular bicistronic, manner as described herein. Alternatively, the RNA according to the present invention may encode the heavy chain (amino acid sequence according to SEQ ID NO: 2), for example by an RNA sequence according to any of SEQ ID NOs: 7644, 15286, 22928, 30570, 38212, 45854, 53496, or a fragment or variant thereof, only and the corresponding light chain (amino acid sequence according to SEQ ID NO: 3), for example by an RNA sequence according to any of SEQ ID NOs: 7645, 15287, 22929, 30571, 38213, 45855, 53497, ora fragment or variant thereof, may be encoded by a separate RNA (molecule). The latter option applies in particular in the context of a combination according to the present invention as described herein and of certain embodiments of the composition and of the kit as described herein. In summary, by all of the above options RNA encoding a (functional) antibody abagovomab can be provided. Other antibodies may be provided in a similar manner based on the information, which can be retrieved from Table 3.

Preferably, the at least one coding sequence of the RNA according to the present invention encodes an antibody or a fragment or variant thereof, in particular an antigen-binding fragment or variant thereof, as described above.

More preferably, the at least one coding sequence of the RNA according to the present invention encodes a heavy chain and/or a light chain of an antibody, or a fragment or variant of a heavy chain and/or of a light chain of an antibody, in particular an antigen-binding fragment or variant of a heavy chain and/or of a light chain of an antibody.

Even more preferably, the at least one coding sequence of the RNA according to the present invention encodes a heavy chain variable region and/or a light chain variable region of an antibody, or an antigen-binding fragment or variant of a heavy chain variable region and/or a light chain variable region of an antibody.

Table 4 below shows the amino acid positions of the heavy chain variable region and of the light chain variable region as well as of the heavy chain constant region and of the light chain constant region in the heavy chain and light chain amino acid sequences of exemplified antibodies, respectively. Those sequences of the heavy chain variable region and of the light chain variable region as well as of the heavy chain constant region and of the light chain constant region are preferably encoded by the RNA according to the present invention as described herein. In Table 4 a variable region of, for example, "1-119" means that amino acids 1-119 of the respective amino acid sequence ("Protein SEQ ID NO") form the variable region. The first column identifies whether the amino acid sequence ("Protein SEQ ID NO") is of the heavy chain or of the light chain. Accordingly, the skilled person can easily identify the heavy chain variable region, the light chain variable region as well as the heavy chain constant region and the light chain constant region of the exemplified antibodies based on the information in Table 4. Moreover, on basis of that information on amino acid sequence level, the skilled person can easily identify the corresponding RNA sequence fragments (i.e. the RNA sequences encoding the heavy chain/light chain constant region/variable region respectively), in particular by using the RNA sequences shown in Table 3 corresponding to the antibody of interest's amino acid sequence.

TABLE 4

Variable regions and constant regions of exemplified antibodies

| Name | Protein SEQ ID NO | Variable Region | Constant Region |
| --- | --- | --- | --- |
| AAB-003_gamma1-Chain | 1 | 1-119 | 120-449 |
| Abagovomab_HeavyChain | 2 | 1-119 | 120-443 |
| Abagovomab_LightChain | 3 | 1-107 | 108-214 |
| Abciximab_HeavyChain | 4 | 1-119 | 120-450 |
| Abciximab_LightChain | 5 | 1-107 | 108-214 |
| Abituzumab_HeavyChain1 | 6 | 1-118 | 119-447 |
| Abituzumab_LightChain1 | 7 | 1-107 | 108-214 |
| Abrilumab_HeavyChain1 | 8 | 1-118 | 119-444 |
| Abrilumab_LightChain1 | 9 | 1-107 | 108-214 |
| Abrilumab_LightChain1_variant2 | 10 | 1-106 | 107-213 |
| Actoxumab_HeavyChain1 | 11 | 1-119 | 120-449 |
| Actoxumab_LightChain1 | 12 | 1-108 | 109-215 |
| Adalimumab_HeavyChain | 13 | 1-121 | 122-224 |
| Adalimumab_LightChain | 14 | 1-107 | 108-214 |
| Aducanumab_HeavyChain1 | 15 | 1-124 | 125-453 |
| Aducanumab_LightChain1 | 16 | 1-107 | 108-214 |
| Afasevikumab_HeavyChain1 | 17 | 1-123 | 124-453 |
| Afasevikumab_LightChain1 | 18 | 1-108 | 109-215 |
| Aflibercept_Fusion_protein1 | 19 | 1-120 | 121-431 |
| Afutuzuab_HeavyChain1 | 20 | 1-117 | 118-444 |
| Afutuzuab_LightChain1 | 21 | 1-110 | 111-217 |
| Afutuzumab_HeavyChain1 | 22 | 1-119 | 120-449 |
| Afutuzumab_LightChain1 | 23 | 1-112 | 113-219 |
| Alacizumab_pegal_HeavyChain1 | 24 | 1-115 | 116-228 |
| Alacizumab_pegal_LightChain1 | 25 | 1-107 | 108-214 |
| Alemtuzumab_HeavyChain | 26 | 1-121 | 122-451 |
| Alemtuzumab_HeavyChain_variant_Ibey_H | 27 | 1-121 | 122-219 |
| Alemtuzumab_HeavyChain_variant_Icel_H | 28 | 1-121 | 122-220 |
| Alemtuzumab_HeavyChain_variant_8005_H | 29 | 1-121 | 122-437 |
| Alemtuzumab_LightChain | 30 | 1-107 | 108-211 |
| Alemtuzumab_LightChain_variant_8005_L | 31 | 1-107 | 108-214 |
| Alirucumab_HeavyChain1 | 32 | 1-118 | 119-447 |
| Alirucumab_LightChain1 | 33 | 1-113 | 114-220 |

TABLE 4-continued

Variable regions and constant regions of exemplified antibodies

| Name | Protein SEQ ID NO | Variable Region | Constant Region |
|---|---|---|---|
| ALX-0061_HeavyChain1 | 34 | 1-121 | 122-245 |
| Amatuximab_HeavyChain1 | 35 | 1-119 | 120-449 |
| Amatuximab_LightChain1 | 36 | 1-106 | 107-213 |
| Anetumab_ravtansine_HeavyChain1 | 37 | 1-120 | 121-450 |
| Anetumab_ravtansine_LightChain1 | 38 | 1-111 | 112-217 |
| Anifrolumab_HeavyChain1 | 39 | 1-117 | 118-447 |
| Anifrolumab_LightChain1 | 40 | 1-108 | 109-215 |
| Anrukinzumab_HeavyChain1 | 41 | 1-118 | 119-448 |
| Anrukinzumab_LightChain1 | 42 | 1-111 | 112-218 |
| Apolizumab_HeavyChain1 | 43 | 1-107 | 108-214 |
| Apolizumab_LightChain1 | 44 | 1-116 | 117-446 |
| Apomab_HeavyChain | 45 | 1-120 | 121-126 |
| Apomab_LightChain | 46 | 1-108 | 109-108 |
| Aquaporumab_LightChain | 47 | 1-108 | 109-215 |
| Arcitumomab_99tc_HeavyChain | 48 | 1-121 | 122-442 |
| Arcitumomab_99tc_LightChain | 49 | 1-106 | 107-213 |
| Ascrinvacumab_HeavyChain1 | 50 | 1-118 | 119-443 |
| Ascrinvacumab_LightChain1 | 51 | 1-108 | 109-215 |
| Aselizuab_HeavyChain1 | 52 | 1-114 | 115-438 |
| Aselizuab_HeavyChain2 | 53 | 1-114 | 115-437 |
| Aselizuab_LightChain1 | 54 | 1-109 | 110-216 |
| Atezolizumab_HeavyChain1 | 55 | 1-118 | 119-448 |
| Atezolizumab_LightChain1 | 56 | 1-107 | 108-214 |
| Atinumab_HeavyChain1 | 57 | 1-114 | 115-441 |
| Atinumab_LightChain1 | 58 | 1-107 | 108-214 |
| Atlizuab_HeavyChain1 | 59 | 1-116 | 117-443 |
| Atlizuab_LightChain1 | 60 | 1-106 | 107-213 |
| Aurograb_SingleChain | 61 | 1-123 | 124-264 |
| Avelumab_HeavyChain1 | 62 | 1-120 | 121-450 |
| Avelumab_LightChain1 | 63 | 1-110 | 111-216 |
| Bapineuzumab_HeavyChain1 | 64 | 1-112 | 113-219 |
| Bapineuzumab_LightChain1 | 65 | 1-119 | 120-448 |
| Basiliximab_HeavyChain | 66 | 1-115 | 116-446 |
| Basiliximab_LightChain | 67 | 1-104 | 105-210 |
| Bavituximab_HeavyChain | 68 | 1-120 | 121-456 |
| Bavituximab_LightChain | 69 | 1-107 | 108-214 |
| Bavituximab_LightChain_variant_8734_L | 70 | 1-107 | 108-208 |
| Begelomab_HeavyChain1 | 71 | 1-120 | 121-459 |
| Begelomab_LightChain1 | 72 | 1-106 | 107-213 |
| Benralizumab_HeavyChain1 | 73 | 1-121 | 122-451 |
| Benralizumab_LightChain1 | 74 | 1-107 | 108-214 |
| Betalutin_HeavyChain1 | 75 | 1-107 | 108-214 |
| Betalutin_LightChain1 | 76 | 1-119 | 120-443 |
| Bevacituzuab_HeavyChain1 | 77 | 1-121 | 122-448 |
| Bevacituzuab_LightChain1 | 78 | 1-106 | 107-213 |
| Bevacizumab_154-aspartin_acid_LightChain | 79 | 1-107 | 108-213 |
| Bevacizumab_154-substitution_deriv_LightChain | 80 | 1-107 | 108-213 |
| Bevacizumab_180-serine_HeavyChain | 81 | 1-123 | 124-224 |
| Bevacizumab_180-substitution_deriv_HeavyChain | 82 | 1-123 | 124-224 |
| Bevacizumab_beta_HeavyChain1 | 83 | 1-123 | 124-453 |
| Bevacizumab_beta_LightChain1 | 84 | 1-107 | 108-214 |
| Bevacizumab_FcDomain | 85 | 1-120 | 121-229 |
| Bevacizumab_HeavyChain | 86 | 1-123 | 124-224 |
| Bevacizumab_HeavyChain_variant1 | 87 | 1-112 | 113-476 |
| Bevacizumab_HeavyChain_V-Region | 88 | 1-123 | 124-123 |
| Bevacizumab_LightChain1 | 89 | 1-132 | 133-239 |
| Bevacizumab_LightChain2 | 90 | 1-130 | 131-237 |
| Bevacizumab_LightChain | 91 | 1-107 | 108-214 |
| Bevacizumab_LightChain_VJ-Region | 92 | 1-107 | 108-108 |
| Bevacizumab_LightChain_V-Region | 93 | 1-107 | 108-107 |
| Bevacizumab-rhuMAb-VEGF_HeavyChain_gamma1-Chain_VDJ-Region | 94 | 1-123 | 124-123 |
| Bevacizumab-rhuMAb-VEGF_LightChain_VJ-Region | 95 | 1-107 | 108-107 |
| Bevacizumab_gamma1-Chain | 96 | 1-123 | 124-447 |
| Bevacizumab_gamma1-Chain_CH3-Region_mutein | 97 | 1-123 | 124-453 |
| Bezlotuxumab_HeavyChain1 | 98 | 1-119 | 120-449 |
| Bezlotuxumab_LightChain1 | 99 | 1-108 | 109-215 |
| Bimagrumab_HeavyChain1 | 100 | 1-115 | 116-445 |
| Bimagrumab_HeavyChain | 101 | 1-115 | 116-444 |
| Bimagrumab_LightChain1 | 102 | 1-111 | 112-217 |
| Bimekizumab_HeavyChain1 | 103 | 1-125 | 126-455 |
| Bimekizumab_LightChain1 | 104 | 1-107 | 108-214 |
| Bleselumab_HeavyChain1 | 105 | 1-121 | 122-448 |
| Bleselumab_LightChain1 | 106 | 1-106 | 107-213 |
| Blinatumomab_HeavyChain1 | 107 | 1-111 | 112-504 |

TABLE 4-continued

Variable regions and constant regions of exemplified antibodies

| Name | Protein SEQ ID NO | Variable Region | Constant Region |
|---|---|---|---|
| Blinatumomab_SingleChain | 108 | 1-111 | 112-505 |
| Blinatumomab_SingleChain_variable_fragment_fusion_protein_(bite) | 109 | 1-111 | 112-504 |
| Blontuvetmab_HeavyChain | 110 | 1-113 | 114-448 |
| Blontuvetmab_LightChain | 111 | 1-113 | 114-219 |
| Blosozumab_HeavyChain1 | 112 | 1-118 | 119-444 |
| Blosozumab_LightChain1 | 113 | 1-107 | 108-214 |
| Bococizumab_HeavyChain1 | 114 | 1-118 | 119-444 |
| Bococizumab_LightChain1 | 115 | 1-107 | 108-214 |
| Brentuximab_vedutin_HeavyChain1 | 116 | 1-117 | 118-446 |
| Brentuximab_vedutin_LightChain1 | 117 | 1-111 | 112-218 |
| Briakinumab_HeavyChain1 | 118 | 1-115 | 116-445 |
| Briakinumab_LightChain1 | 119 | 1-111 | 112-217 |
| Brodalumab_HeavyChain1 | 120 | 1-116 | 117-442 |
| Brodalumab_LightChain1 | 121 | 1-107 | 108-214 |
| Brolucizumab_HeavyChain1 | 122 | 1-110 | 111-252 |
| Brolucizumab_scfv_fragment | 123 | 1-110 | 111-252 |
| Bruntictuzumab_HeavyChain1 | 124 | 1-121 | 122-447 |
| Bruntictuzumab_LightChain1 | 125 | 1-109 | 110-215 |
| BTT-1023_HeavyChain1 | 126 | 1-117 | 118-444 |
| BTT-1023_LightChain1 | 127 | 1-107 | 108-214 |
| Burosumab_HeavyChain1 | 128 | 1-106 | 107-213 |
| Burosumab_LightChain1 | 129 | 1-117 | 118-447 |
| Canakinumab_HeavyChain1 | 130 | 1-119 | 120-455 |
| Canakinumab_HeavyChain | 131 | 1-118 | 119-448 |
| Canakinumab_LightChain1 | 132 | 1-108 | 109-217 |
| Canakinumab_LightChain | 133 | 1-107 | 108-214 |
| Canakinumab_LightChain_variant_8836_L | 134 | 1-118 | 119-394 |
| Cantuzumab_HeavyChain1 | 135 | 1-69 | 70-399 |
| Cantuzumab_HeavyChain | 136 | 1-119 | 120-449 |
| Cantuzumab_LightChain1 | 137 | 1-112 | 113-219 |
| Cantuzumab_mertansine_HeavyChain1 | 138 | 1-112 | 113-219 |
| Cantuzumab_mertansine_LightChain1 | 139 | 1-119 | 120-448 |
| Cantuzumab_ravtansine_HeavyChain1 | 140 | 1-119 | 120-449 |
| Cantuzumab_ravtansine_LightChain1 | 141 | 1-112 | 113-219 |
| Caplacizumab | 142 | 1-120 | 121-259 |
| Caplacizumab_HeavyChain1 | 143 | 1-120 | 121-259 |
| Caplacizumab_HeavyChain1 | 144 | 1-120 | 121-259 |
| Carlumab_HeavyChain1 | 145 | 1-119 | 120-449 |
| Carlumab_LightChain1 | 146 | 1-109 | 110-216 |
| Cergutuzumab_amunaleukin_HeavyChain1 | 147 | 1-121 | 122-451 |
| Cergutuzumab_amunaleukin_HeavyChain2 | 148 | 1-121 | 122-599 |
| Cergutuzumab_amunaleukin_LightChain1 | 149 | 1-108 | 109-215 |
| Certolizumab_pegol_HeavyChain1 | 150 | 1-118 | 119-229 |
| Certolizumab_pegol_HeavyChain | 151 | 1-107 | 108-214 |
| Certolizumab_pegol_LightChain1 | 152 | 1-107 | 108-214 |
| Certolizumab_pegol_LightChain | 153 | 1-118 | 119-229 |
| Cetuximab_HeavyChain | 154 | 1-119 | 120-452 |
| Cetuximab_HeavyChain_variant | 155 | 1-119 | 120-449 |
| Cetuximab_LightChain | 156 | 1-107 | 108-213 |
| Cetuximab_LightChain_variant | 157 | 1-107 | 108-214 |
| Citatuzumab_bogatox_HeavyChain1 | 158 | 1-122 | 123-225 |
| Citatuzumab_bogatox_LightChain1 | 159 | 1-112 | 113-481 |
| Cixutumumab_HeavyChain1 | 160 | 1-130 | 131-460 |
| Cixutumumab_LightChain1 | 161 | 1-108 | 109-214 |
| Clazakizumab_HeavyChain1 | 162 | 1-120 | 121-450 |
| Clazakizumab_LightChain1 | 163 | 1-110 | 111-217 |
| Clivatuzumab_tetraxetan_HeavyChain1 | 164 | 1-119 | 120-449 |
| Clivatuzumab_tetraxetan_LightChain1 | 165 | 1-108 | 108-215 |
| Codrituzumab_HeavyChain1 | 166 | 1-115 | 116-445 |
| Codrituzumab_LightChain1 | 167 | 1-112 | 113-216 |
| Coltuximab_ravtansine_HeavyChain1 | 168 | 1-120 | 121-450 |
| Coltuximab_ravtansine_LightChain1 | 169 | 1-104 | 105-211 |
| Conatumumab_CV_HeavyChain | 170 | 1-123 | 124-458 |
| Conatumumab_CV_LightChain | 171 | 1-109 | 110-218 |
| Conatumumab_HeavyChain1 | 172 | 1-122 | 123-452 |
| Conatumumab_HeavyChain | 173 | 1-122 | 123-452 |
| Conatumumab_LightChain1 | 174 | 1-108 | 109-215 |
| Conatumumab_LightChain | 175 | 1-108 | 109-215 |
| Concizumab_HeavyChain1 | 176 | 1-121 | 122-448 |
| Concizumab_LightChain1 | 177 | 1-112 | 113-219 |
| Crenezumab_HeavyChain1 | 178 | 1-112 | 113-438 |
| Crenezumab_LightChain1 | 179 | 1-112 | 113-219 |
| Crotedumab_HeavyChain1 | 180 | 1-107 | 108-214 |
| Crotedumab_HeavyChain2 | 181 | 1-107 | 109-214 |
| Crotedumab_LightChain1 | 182 | 1-128 | 129-455 |

TABLE 4-continued

Variable regions and constant regions of exemplified antibodies

| Name | Protein SEQ ID NO | Variable Region | Constant Region |
|---|---|---|---|
| Crotedumab_LightChain2 | 183 | 1-128 | 129-455 |
| Dacetuzumab_HeavyChain1 | 184 | 1-114 | 115-444 |
| Dacetuzumab_LightChain1 | 185 | 1-112 | 113-219 |
| Dacliximab_LightChain_VJ-Region | 186 | 1-106 | 107-106 |
| Dacliximab_gamma2-Chain_VDJ-Region | 187 | 1-116 | 117-116 |
| Daclizumab_HeavyChain | 188 | 1-116 | 117-442 |
| Daclizumab_LightChain | 189 | 1-106 | 107-210 |
| Dalotuzumab_HeavyChain1 | 190 | 1-117 | 118-447 |
| Dalotuzumab_LightChain1 | 191 | 1-112 | 113-219 |
| Dapirolizumab_pegol_HeavyChain1 | 192 | 1-118 | 119-229 |
| Dapirolizumab_pegol_LightChain1 | 193 | 1-107 | 108-214 |
| Daratumumab_HeavyChain1 | 194 | 1-122 | 123-452 |
| Daratumumab_LightChain1 | 195 | 1-107 | 108-214 |
| Dectrekumab_HeavyChain1 | 196 | 1-120 | 121-450 |
| Dectrekumab_LightChain1 | 197 | 1-109 | 110-216 |
| Demcizumab_HeavyChain1 | 198 | 1-119 | 120-444 |
| Demcizumab_LightChain1 | 199 | 1-111 | 112-218 |
| Denintuzumab_mafodotin_HeavyChain1 | 200 | 1-120 | 121-450 |
| Denintuzumab_mafodotin_LightChain1 | 201 | 1-106 | 107-213 |
| Denosumab_HeavyChain | 202 | 1-122 | 123-452 |
| Denosumab_LightChain | 203 | 1-108 | 109-215 |
| Depatuxizumab_HeavyChain1 | 204 | 1-107 | 108-214 |
| Depatuxizumab_LightChain1 | 205 | 1-116 | 117-446 |
| Depatuxizumab_mafodotin_HeavyChain1 | 206 | 1-107 | 108-214 |
| Depatuxizumab_mafodotin_LightChain1 | 207 | 1-116 | 117-446 |
| Dinutuximab_beta_HeavyChain1 | 208 | 1-113 | 114-443 |
| Dinutuximab_beta_LightChain1 | 209 | 1-113 | 114-221 |
| Dinutuximab_HeavyChain1 | 210 | 1-113 | 114-443 |
| Dinutuximab_LightChain1 | 211 | 1-113 | 114-221 |
| Dinutuximab_LightChain | 212 | 1-113 | 114-220 |
| Diridavumab_HeavyChain1 | 213 | 1-121 | 122-450 |
| Diridavumab_LightChain1 | 214 | 1-111 | 112-217 |
| Domagrozumab_HeavyChain1 | 215 | 1-116 | 117-446 |
| Domagrozumab_HeavyChain | 216 | 1-116 | 117-445 |
| Domagrozumab_LightChain1 | 217 | 1-107 | 108-214 |
| Drozituab_HeavyChain1 | 218 | 1-119 | 120-445 |
| Drozituab_LightChain1 | 219 | 1-107 | 108-213 |
| Drozitumab_HeavyChain1 | 220 | 1-121 | 122-451 |
| Drozitumab_LightChain1 | 221 | 1-107 | 108-213 |
| Duligotumab_HeavyChain1 | 222 | 1-121 | 122-451 |
| Duligotumab_LightChain1 | 223 | 1-107 | 108-214 |
| Duligotuzumab_HeavyChain1 | 224 | 1-121 | 122-451 |
| Duligotuzumab_LightChain1 | 225 | 1-107 | 108-214 |
| Dupilumab_HeavyChain1 | 226 | 1-125 | 126-451 |
| Dupilumab_LightChain1 | 227 | 1-112 | 113-219 |
| Durvalumab_HeavyChain1 | 228 | 1-121 | 122-451 |
| Durvalumab_LightChain1 | 229 | 1-108 | 109-215 |
| Dusigitumab_HeavyChain1 | 230 | 1-120 | 121-446 |
| Dusigitumab_LightChain1 | 231 | 1-111 | 112-217 |
| Ecromeximab_HeavyChain1 | 232 | 1-107 | 108-214 |
| Ecromeximab_LightChain1 | 233 | 1-119 | 120-449 |
| Eculizumab_HeavyChain1 | 234 | 1-107 | 108-214 |
| Eculizumab_LightChain1 | 235 | 1-121 | 122-447 |
| Efalizumab_HeavyChain | 236 | 1-125 | 126-125 |
| Efalizumab_LightChain | 237 | 1-108 | 109-108 |
| Efungumab_SingleChain_variable_fragment | 238 | 1-122 | 123-256 |
| Eldelumab_HeavyChain1 | 239 | 1-124 | 125-454 |
| Eldelumab_LightChain1 | 240 | 1-109 | 110-216 |
| Elgemtumab_HeavyChain1 | 241 | 1-117 | 118-447 |
| Elgemtumab_LightChain1 | 242 | 1-107 | 108-214 |
| Elotuzumab_HeavyChain1 | 243 | 1-119 | 120-449 |
| Elotuzumab_LightChain1 | 244 | 1-107 | 108-214 |
| Emactuzumab_HeavyChain1 | 245 | 1-116 | 117-446 |
| Emactuzumab_LightChain1 | 246 | 1-106 | 107-213 |
| Emibetuzumab_HeavyChain1 | 247 | 1-115 | 116-441 |
| Emibetuzumab_LightChain1 | 248 | 1-108 | 109-215 |
| Emicizumab_HeavyChain1 | 249 | 1-123 | 124-448 |
| Emicizumab_HeavyChain2 | 250 | 1-119 | 120-444 |
| Emicizumab_LightChain1 | 251 | 1-107 | 108-214 |
| Enavatuzumab_HeavyChain1 | 252 | 1-119 | 120-449 |
| Enavatuzumab_LightChain1 | 253 | 1-111 | 112-218 |
| Enfortumab_HeavyChain | 254 | 1-117 | 118-447 |
| Enfortumab_LightChain | 255 | 1-107 | 108-214 |
| Enfortumab_vedotin_HeavyChain1 | 256 | 1-117 | 118-447 |
| Enfortumab_vedotin_LightChain1 | 257 | 1-107 | 108-214 |

TABLE 4-continued

Variable regions and constant regions of exemplified antibodies

| Name | Protein SEQ ID NO | Variable Region | Constant Region |
|---|---|---|---|
| Enoblituzumab_HeavyChain | 258 | 1-122 | 123-452 |
| Enoblituzumab_LightChain | 259 | 1-107 | 108-214 |
| Enokizumab_HeavyChain1 | 260 | 1-122 | 123-452 |
| Enokizumab_LightChain1 | 261 | 1-107 | 108-214 |
| Enokizumab_LightChain | 262 | 1-107 | 108-204 |
| Enoticumab_HeavyChain1 | 263 | 1-123 | 124-452 |
| Enoticumab_LightChain1 | 264 | 1-107 | 108-214 |
| Ensituximab_HeavyChain1 | 265 | 1-113 | 114-443 |
| Ensituximab_LightChain1 | 266 | 1-166 | 107-213 |
| Ensituximab_SingleChain_variable_fragment | 267 | 1-122 | 123-256 |
| Entolimod_chain1 | 268 | 1-120 | 121-329 |
| Epratuzumab_HeavyChain | 269 | 1-116 | 117-446 |
| Epratuzumab_LightChain | 270 | 1-112 | 113-219 |
| Eptacog_beta_HeavyChain1 | 271 | 1-120 | 121-255 |
| Eptacog_beta_LightChain1 | 272 | 1-107 | 108-152 |
| Erlizuab_HeavyChain1 | 273 | 1-119 | 120-236 |
| Erlizuab_LightChain1 | 274 | 1-106 | 107-213 |
| Etaracizumab_HeavyChain1 | 275 | 1-117 | 118-447 |
| Etaracizumab_LightChain1 | 276 | 1-107 | 108-214 |
| Etrolizuab_HeavyChain1 | 277 | 1-116 | 117-442 |
| Etrolizuab_HeavyChain2 | 278 | 1-116 | 117-442 |
| Etrolizuab_LightChain1 | 279 | 1-106 | 107-213 |
| Etrolizumab_HeavyChain1 | 280 | 1-117 | 118-446 |
| Etrolizumab_LightChain1 | 281 | 1-107 | 108-214 |
| Evinacumab_HeavyChain1 | 282 | 1-126 | 127-453 |
| Evinacumab_LightChain1 | 283 | 1-107 | 108-214 |
| Evolocumab_HeavyChain1 | 284 | 1-115 | 116-441 |
| Evolocumab_LightChain1 | 285 | 1-109 | 110-215 |
| Exbivirumab_HeavyChain1 | 286 | 1-121 | 122-451 |
| Exbivirumab_LightChain1 | 287 | 1-108 | 109-214 |
| Farletuzumab_HeavyChain1 | 288 | 1-119 | 120-449 |
| Farletuzumab_LightChain1 | 289 | 1-110 | 111-217 |
| Fasinumab_HeavyChain1 | 290 | 1-119 | 120-446 |
| Fasinumab_LightChain1 | 291 | 1-107 | 108-214 |
| Fezakinumab_HeavyChain1 | 292 | 1-121 | 122-450 |
| Fezakinumab_LightChain1 | 293 | 1-111 | 112-217 |
| FG-3019_HeavyChain1 | 294 | 1-107 | 108-214 |
| FG-3019_LightChain1 | 295 | 1-120 | 121-449 |
| Fibatuzumab_HeavyChain1 | 296 | 1-118 | 119-448 |
| Fibatuzumab_LightChain1 | 297 | 1-107 | 108-214 |
| Ficlatuzumab_HeavyChain1 | 298 | 1-118 | 119-448 |
| Ficlatuzumab_HeavyChain | 299 | 1-117 | 118-447 |
| Ficlatuzumab_LightChain1 | 300 | 1-107 | 108-214 |
| Figitumumab_HeavyChain1 | 301 | 1-125 | 126-450 |
| Figitumumab_LightChain1 | 302 | 1-107 | 108-214 |
| Firivumab_HeavyChain1 | 303 | 1-123 | 124-453 |
| Firivumab_LightChain1 | 304 | 1-107 | 108-214 |
| Flanvotumab_HeavyChain1 | 305 | 1-119 | 120-449 |
| Flanvotumab_LightChain1 | 306 | 1-108 | 109-215 |
| Fletikumab_HeavyChain1 | 307 | 1-127 | 128-454 |
| Fletikumab_LightChain1 | 308 | 1-107 | 108-214 |
| Fontolizumab_HeavyChain1 | 309 | 1-107 | 108-214 |
| Fontolizumab_LightChain1 | 310 | 1-117 | 118-447 |
| Foralumab_HeavyChain1 | 311 | 1-118 | 119-448 |
| Foralumab_LightChain1 | 312 | 1-108 | 109-215 |
| Foravirumab_HeavyChain1 | 313 | 1-119 | 120-448 |
| Foravirumab_HeavyChain | 314 | 1-119 | 120-448 |
| Foravirumab_LightChain1 | 315 | 1-107 | 108-214 |
| Fresolimumab_HeavyChain1 | 316 | 1-120 | 121-447 |
| Fresolimumab_LightChain1 | 317 | 1-108 | 109-215 |
| Fulranumab_HeavyChain1 | 318 | 1-123 | 124-449 |
| Fulranumab_LightChain1 | 319 | 1-107 | 108-214 |
| Futuximab_HeavyChain1 | 320 | 1-123 | 124-452 |
| Futuximab_LightChain1 | 321 | 1-107 | 108-214 |
| Galcanezumab_HeavyChain1 | 322 | 1-119 | 120-445 |
| Galcanezumab_LightChain1 | 323 | 1-107 | 108-214 |
| Galiximab_HeavyChain1 | 324 | 1-110 | 111-216 |
| Galiximab_LightChain1 | 325 | 1-127 | 128-457 |
| Ganitumab_HeavyChain1 | 326 | 1-119 | 120-449 |
| Ganitumab_LightChain1 | 327 | 1-112 | 113-219 |
| Gantenerumab_HeavyChain1 | 328 | 1-126 | 127-456 |
| Gantenerumab_LightChain1 | 329 | 1-108 | 109-215 |
| Gemtuzumab_HeavyChain1 | 330 | 1-116 | 117-116 |
| Gemtuzumab_HeavyChain2 | 331 | 1-117 | 118-117 |
| Gemtuzumab_LightChain2 | 332 | 1-107 | 108-107 |

TABLE 4-continued

Variable regions and constant regions of exemplified antibodies

| Name | Protein SEQ ID NO | Variable Region | Constant Region |
|---|---|---|---|
| Gemtuzumab_ozogamicin_LightChain1 | 333 | 1-106 | 107-106 |
| Gevokizumab_HeavyChain1 | 334 | 1-120 | 121-445 |
| Gevokizumab_LightChain1 | 335 | 1-107 | 108-214 |
| Girentuximab_HeavyChain1 | 336 | 1-119 | 120-449 |
| Girentuximab_LightChain1 | 337 | 1-107 | 108-214 |
| Glembatumumab_HeavyChain1 | 338 | 1-119 | 120-445 |
| Glembatumumab_LightChain1 | 339 | 1-108 | 109-215 |
| Goilixiab_HeavyChain1 | 340 | 1-116 | 117-444 |
| Goilixiab_LightChain1 | 341 | 1-106 | 107-213 |
| Guselkumab_HeavyChain1 | 342 | 1-117 | 118-446 |
| Guselkumab_LightChain1 | 343 | 1-111 | 112-217 |
| HuMab-001_HeavyChain_VDJ-Region | 344 | 1-120 | 121-120 |
| HuMab-001_LightChain_VJ-Region | 345 | 1-107 | 108-107 |
| HuMab-005_HeavyChain_gamma-Chain_VDJ-Region | 346 | 1-122 | 123-122 |
| HuMab-005_LightChain_VJ-Region | 347 | 1-107 | 108-107 |
| HuMab-006_HeavyChain_VDJ-Region | 348 | 1-119 | 120-119 |
| HuMab-006_LightChain_VJ-Region | 349 | 1-108 | 109-108 |
| HuMab-019_HeavyChain_VDJ-Region | 350 | 1-120 | 121-120 |
| HuMab-021_HeavyChain_VDJ-Region | 351 | 1-120 | 121-120 |
| HuMab-021_LightChain_VJ-Region | 352 | 1-107 | 108-107 |
| HuMab-025_HeavyChain_VDJ-Region | 353 | 1-120 | 121-120 |
| HuMab-025_LightChain_VJ-Region | 354 | 1-107 | 108-107 |
| HuMab-027_HeavyChain_VDJ-Region | 355 | 1-120 | 121-120 |
| HuMab-032_HeavyChain_VDJ-Region | 356 | 1-120 | 121-120 |
| HuMab-032_LightChain_VJ-Region | 357 | 1-107 | 108-107 |
| HuMab-033_HeavyChain_VDJ-Region | 358 | 1-121 | 122-121 |
| HuMab-035_HeavyChain_VDJ-Region | 359 | 1-120 | 121-120 |
| HuMab-036_HeavyChain_VDJ-Region | 360 | 1-120 | 121-120 |
| HuMab-036_LightChain_VJ-Region | 361 | 1-107 | 108-107 |
| HuMab-041_HeavyChain_VDJ-Region | 362 | 1-122 | 123-122 |
| HuMab-044_HeavyChain_VDJ-Region | 363 | 1-122 | 123-122 |
| HuMab-049_HeavyChain_VDJ-Region | 364 | 1-119 | 120-119 |
| HuMab-049_LightChain_VJ-Region | 365 | 1-107 | 108-107 |
| HuMab-050_HeavyChain_VDJ-Region | 366 | 1-119 | 120-119 |
| HuMab-050_LightChain_VJ-Region | 367 | 1-107 | 108-107 |
| HuMab-054_HeavyChain_VDJ-Region | 368 | 1-120 | 121-120 |
| HuMab-054_LightChain_VJ-Region | 369 | 1-107 | 108-107 |
| HuMab-055_HeavyChain_VDJ-Region | 370 | 1-119 | 120-119 |
| HuMab-059_HeavyChain_VDJ-Region | 371 | 1-122 | 123-122 |
| HuMab-059_LightChain_VJ-Region | 372 | 1-108 | 109-108 |
| HuMab-060_HeavyChain_VDJ-Region | 373 | 1-122 | 123-122 |
| HuMab-060_LightChain_VJ-Region | 374 | 1-109 | 110-109 |
| HuMab-067_HeavyChain_VDJ-Region | 375 | 1-122 | 123-122 |
| HuMab-072_HeavyChain_VDJ-Region | 376 | 1-122 | 123-122 |
| HuMab-072_LightChain_VJ-Region | 377 | 1-109 | 110-109 |
| HuMab-084_HeavyChain_VDJ-Region | 378 | 1-121 | 122-121 |
| HuMab-084_LightChain_VJ-Region | 379 | 1-107 | 108-107 |
| HuMab-091_HeavyChain_VDJ-Region | 380 | 1-120 | 121-120 |
| HuMab-091_LightChain_VJ-Region | 381 | 1-107 | 108-107 |
| HuMab-093_HeavyChain_VDJ-Region | 382 | 1-122 | 123-122 |
| HuMab-098_HeavyChain_VDJ-Region | 383 | 1-124 | 125-124 |
| HuMab-098_LightChain_VJ-Region | 384 | 1-107 | 108-107 |
| HuMab-100_HeavyChain_VDJ-Region | 385 | 1-124 | 125-124 |
| HuMab-106_HeavyChain_VDJ-Region | 386 | 1-124 | 125-124 |
| HuMab-106_LightChain_VJ-Region | 387 | 1-107 | 108-107 |
| HuMab_10F8_HeavyChain_V-Region | 388 | 1-117 | 118-117 |
| HuMab_10F8_HeavyChain_V-Region_Precursor | 389 | 1-136 | 137-136 |
| HuMab_10F8_LightChain_V-Region | 390 | 1-107 | 108-107 |
| HuMab_10F8_LightChain_V-Region_Precursor | 391 | 1-127 | 128-127 |
| HuMab-111_HeavyChain_VDJ-Region | 392 | 1-119 | 120-119 |
| HuMab-111_LightChain_VJ-Region | 393 | 1-107 | 108-107 |
| HuMab-123_HeavyChain_VDJ-Region | 394 | 1-121 | 122-121 |
| HuMab-123_LightChain_VJ-Region | 395 | 1-107 | 108-107 |
| HuMab-124_HeavyChain_VDJ-Region | 396 | 1-121 | 122-121 |
| HuMab-125_HeavyChain_VDJ-Region | 397 | 1-124 | 125-124 |
| HuMab-125_LightChain_VJ-Region | 398 | 1-107 | 108-107 |
| HuMab-127_HeavyChain_VDJ-Region | 399 | 1-123 | 124-123 |
| HuMab-127_LightChain_VJ-Region | 400 | 1-107 | 108-107 |
| HuMab-129_HeavyChain_VDJ-Region | 401 | 1-119 | 120-119 |
| HuMab-129_LightChain_VJ-Region | 402 | 1-106 | 107-106 |
| HuMab-132_HeavyChain_VDJ-Region | 403 | 1-125 | 126-125 |
| HuMab-132_LightChain_VJ-Region | 404 | 1-108 | 109-108 |
| HuMab-143_HeavyChain_VDJ-Region | 405 | 1-120 | 121-120 |
| HuMab-143_LightChain_VJ-Region | 406 | 1-107 | 108-107 |
| HuMab-150_HeavyChain_VDJ-Region | 407 | 1-122 | 123-122 |

TABLE 4-continued

Variable regions and constant regions of exemplified antibodies

| Name | Protein SEQ ID NO | Variable Region | Constant Region |
|---|---|---|---|
| HuMab-150__LightChain__VJ-Region | 408 | 1-107 | 108-107 |
| HuMab-152__HeavyChain__VDJ-Region | 409 | 1-121 | 122-121 |
| HuMab-152__LightChain__VJ-Region | 410 | 1-107 | 108-107 |
| HuMab-153__HeavyChain__VDJ-Region | 411 | 1-121 | 122-121 |
| HuMab-153__LightChain__VJ-Region | 412 | 1-107 | 108-107 |
| HuMab-159__HeavyChain__VDJ-Region | 413 | 1-126 | 127-126 |
| HuMab-159__LightChain__VJ-Region | 414 | 1-107 | 108-107 |
| HuMab-160__HeavyChain__VDJ-Region | 415 | 1-121 | 122-121 |
| HuMab-160__LightChain__VJ-Region | 416 | 1-107 | 108-107 |
| HuMab-162__HeavyChain__VDJ-Region | 417 | 1-124 | 125-124 |
| HuMab-162__LightChain__VJ-Region | 418 | 1-107 | 108-107 |
| HuMab-163__HeavyChain__VDJ-Region | 419 | 1-122 | 123-122 |
| HuMab-163__LightChain__VJ-Region | 420 | 1-107 | 108-107 |
| HuMab-166__HeavyChain__VDJ-Region | 421 | 1-121 | 122-121 |
| HuMab-166__LightChain__VJ-Region | 422 | 1-107 | 108-107 |
| HuMab-167__HeavyChain__VDJ-Region | 423 | 1-121 | 122-121 |
| HuMab-169__HeavyChain__VDJ-Region | 424 | 1-121 | 122-121 |
| HuMab-169__LightChain__VJ-Region | 425 | 1-107 | 108-107 |
| HuMab-708__HeavyChain__VH-Region | 426 | 1-122 | 123-122 |
| HuMab-708__HeavyChain__V-Region | 427 | 1-122 | 123-122 |
| HuMab-708__LightChain__VL-Region | 428 | 1-107 | 108-107 |
| HuMab-708__LightChain__V-Region | 429 | 1-107 | 108-107 |
| huMAb-anti-MSP10.1__LightChain__VJ-Region | 430 | 1-108 | 109-108 |
| huMAb-anti-MSP10.2__LightChain__VJ-Region | 431 | 1-108 | 109-108 |
| HUMAB-Clone__18__VJ-Region | 432 | 1-108 | 109-108 |
| HUMAB-Clone__22__VJ-Region | 433 | 1-108 | 109-108 |
| HuMab-LG12__µChain__VDJ-Region__Precursor | 434 | 1-139 | 140-144 |
| HuMab__LC5002-002__LightChain__V-Region | 435 | 1-107 | 108-107 |
| HuMab__LC5002-002__gamma1-Chain__V-Region | 436 | 1-119 | 120-119 |
| HuMab__LC5002-003__LightChain__V-Region | 437 | 1-107 | 108-107 |
| HuMab__LC5002-003__gamma1-Chain__V-Region | 438 | 1-119 | 120-119 |
| HuMab__LC5002-005__LightChain__V-Region | 439 | 1-107 | 108-107 |
| HuMab__LC5002-005__gamma1-Chain__V-Region | 440 | 1-118 | 119-118 |
| HuMab__LC5002-007__LightChain__V-Region | 441 | 1-107 | 108-107 |
| HuMab__LC5002-007__gamma1-Chain__V-Region | 442 | 1-123 | 124-123 |
| HuMab__LC5002-018__gamma1-Chain__V-Region | 443 | 1-119 | 120-119 |
| Ibalizumab__HeavyChain1 | 444 | 1-122 | 123-449 |
| Ibalizumab__LightChain1 | 445 | 1-112 | 113-219 |
| Ibritumomab_tiuxetan__HeavyChain | 446 | 1-122 | 123-443 |
| Ibritumomab_tiuxetan__LightChain | 447 | 1-106 | 107-209 |
| Icrunumab__HeavyChain1 | 448 | 1-126 | 127-456 |
| Icrunumab__LightChain1 | 449 | 1-108 | 109-215 |
| Idarucizumab__HeavyChain1 | 450 | 1-122 | 123-225 |
| Idarucizumab__LightChain1 | 451 | 1-112 | 113-219 |
| Igatuzuab__HeavyChain1 | 452 | 1-120 | 121-444 |
| Igatuzuab__LightChain1 | 453 | 1-105 | 106-212 |
| IGF-IR__HUMAB-1A__HeavyChain | 454 | 1-119 | 120-119 |
| IGF-IR__HUMAB-23__HeavyChain | 455 | 1-119 | 120-119 |
| IGF-IR__HUMAB-23__LightChain | 456 | 1-107 | 108-107 |
| IGF-IR__HUMAB-8__HeavyChain | 457 | 1-119 | 120-119 |
| IGF-IR__HUMAB-8__LightChain | 458 | 1-107 | 108-107 |
| ImAb1__LightChain | 459 | 1-129 | 130-236 |
| ImAb1__gamma1-Chain | 460 | 1-133 | 134-227 |
| Imalumab__HeavyChain1 | 461 | 1-118 | 119-448 |
| Imalumab__LightChain1 | 462 | 1-107 | 108-214 |
| Imgatuzumab__HeavyChain1 | 463 | 1-120 | 121-449 |
| Imgatuzumab__LightChain1 | 464 | 1-106 | 107-213 |
| Inclacumab__HeavyChain1 | 465 | 1-124 | 125-451 |
| Inclacumab__LightChain1 | 466 | 1-107 | 108-214 |
| Indatuximab_ravtansine__HeavyChain1 | 467 | 1-122 | 123-449 |
| Indatuximab_ravtansine__LightChain1 | 468 | 1-107 | 108-214 |
| Indusatumab_vedotin__HeavyChain1 | 469 | 1-119 | 120-449 |
| Indusatumab_vedotin__LightChain1 | 470 | 1-107 | 108-214 |
| Inebilizumab__HeavyChain1 | 471 | 1-121 | 122-451 |
| Inebilizumab__LightChain1 | 472 | 1-111 | 112-218 |
| Insulin_peglispro_Fragment1 | 473 | 1-30 | 31-30 |
| Insulin_peglispro_Fragment2 | 474 | 1-21 | 22-21 |
| Interferon_beta-1b__chain1 | 475 | 1-120 | 121-165 |
| Intetumumab__HeavyChain1 | 476 | 1-119 | 120-449 |
| Intetumumab__LightChain1 | 477 | 1-108 | 109-215 |
| Iodine__(1241)__Girentuximab__HeavyChain1 | 478 | 1-119 | 120-449 |
| Iodine__(1241)__Girentuximab__LightChain1 | 479 | 1-107 | 108-214 |
| Iodine__(1311)__Derlotuxiab_biotin__HeavyChain1 | 480 | 1-117 | 118-445 |
| Iodine__(1311)__Derlotuxiab_biotin__LightChain1 | 481 | 1-106 | 107-213 |
| Iodine__(1311)__Derlotuximab_biotin__HeavyChain1 | 482 | 1-120 | 121-450 |

TABLE 4-continued

Variable regions and constant regions of exemplified antibodies

| Name | Protein SEQ ID NO | Variable Region | Constant Region |
|---|---|---|---|
| Iodine__(1311)__Derlotuximab__biotin__LightChain1 | 483 | 1-108 | 109-215 |
| Ipilimumab__HeavyChain | 484 | 1-118 | 119-448 |
| Ipilimumab__LightChain | 485 | 1-108 | 109-215 |
| Iratumumab__HeavyChain1 | 486 | 1-107 | 108-107 |
| Iratumumab__LightChain1 | 487 | 1-62 | 63-62 |
| Isatuximab__HeavyChain1 | 488 | 1-120 | 121-450 |
| Isatuximab__LightChain1 | 489 | 1-107 | 108-214 |
| Itolizumab__HeavyChain1 | 490 | 1-119 | 120-449 |
| Itolizumab__LightChain1 | 491 | 1-107 | 108-214 |
| Ixekizumab__HeavyChain1 | 492 | 1-119 | 120-445 |
| Ixekizumab__LightChain1 | 493 | 1-112 | 113-219 |
| Labetuzumab__govitecan__HeavyChain1 | 494 | 1-119 | 120-449 |
| Labetuzumab__govitecan__LightChain1 | 495 | 1-106 | 107-213 |
| Lambrolizumab__HeavyChain1 | 496 | 1-120 | 121-447 |
| Lambrolizumab__LightChain1 | 497 | 1-111 | 112-218 |
| Lampalizumab__HeavyChain1 | 498 | 1-115 | 116-223 |
| Lampalizumab__LightChain1 | 499 | 1-107 | 108-214 |
| Lanadelumab__HeavyChain1 | 500 | 1-122 | 123-451 |
| Lanadelumab__LightChain1 | 501 | 1-106 | 107-213 |
| Landogrozumab__HeavyChain1 | 502 | 1-113 | 114-439 |
| Landogrozumab__LightChain1 | 503 | 1-108 | 109-215 |
| Laprituximab__emtansine__HeavyChain1 | 504 | 1-119 | 120-448 |
| Laprituximab__emtansine__LightChain1 | 505 | 1-107 | 108-214 |
| Lealesoab__HeavyChain1 | 506 | 1-119 | 120-438 |
| Lealesoab__LightChain1 | 507 | 1-112 | 113-218 |
| Lebrikizumab__HeavyChain1 | 508 | 1-120 | 121-445 |
| Lebrikizumab__LightChain1 | 509 | 1-111 | 112-218 |
| Lenercept__chain1 | 510 | 1-120 | 121-409 |
| Lenzilumab__HeavyChain1 | 511 | 1-119 | 120-449 |
| Lenzilumab__LightChain1 | 512 | 1-107 | 108-214 |
| Lerdelimumab__HeavyChain1 | 513 | 1-115 | 116-442 |
| Lerdelimumab__LightChain1 | 514 | 1-109 | 110-215 |
| Lexatumumab__HeavyChain1 | 515 | 1-122 | 123-457 |
| Lexatumumab__HeavyChain | 516 | 1-121 | 122-451 |
| Lexatumumab__LightChain1 | 517 | 1-109 | 110-217 |
| Lexatumumab__LightChain | 518 | 1-108 | 109-214 |
| Libivirumab__HeavyChain1 | 519 | 1-112 | 113-219 |
| Libivirumab__LightChain1 | 520 | 1-129 | 130-459 |
| Lifastuzumab__HeavyChain | 521 | 1-120 | 121-450 |
| Lifastuzumab__LightChain | 522 | 1-112 | 113-219 |
| Lifastuzumab__vedotin__HeavyChain1 | 523 | 1-119 | 120-449 |
| Lifastuzumab__vedotin__LightChain1 | 524 | 1-112 | 113-219 |
| Ligelizumab__HeavyChain1 | 525 | 1-123 | 124-453 |
| Ligelizumab__LightChain1 | 526 | 1-107 | 108-214 |
| Lilotomab__HeavyChain1 | 527 | 1-119 | 120-443 |
| Lilotomab__LightChain1 | 528 | 1-107 | 108-214 |
| Lintuzumab__HeavyChain1 | 529 | 1-111 | 112-218 |
| Lintuzumab__LightChain1 | 530 | 1-116 | 117-446 |
| Lirilumab__HeavyChain1 | 531 | 1-123 | 124-450 |
| Lirilumab__LightChain1 | 532 | 1-107 | 108-214 |
| Lodelcizumab__HeavyChain1 | 533 | 1-118 | 119-448 |
| Lodelcizumab__LightChain1 | 534 | 1-106 | 107-213 |
| Lokivetmab__HeavyChain1 | 535 | 1-118 | 119-452 |
| Lokivetmab__LightChain1 | 536 | 1-111 | 112-217 |
| Lorvotuzumab__mertansine__HeavyChain1 | 537 | 1-118 | 119-448 |
| Lorvotuzumab__mertansine__LightChain1 | 538 | 1-112 | 113-219 |
| Lpathomab__VL | 539 | 1-112 | 113-112 |
| Lpathomab__gamma1-Chain__VDJ-Region | 540 | 1-122 | 123-122 |
| Lucatumumab__HeavyChain1 | 541 | 1-120 | 121-450 |
| Lucatumumab__LightChain1 | 542 | 1-112 | 113-219 |
| Lulizumab__pegol__LightChain1 | 543 | 1-109 | 110-109 |
| Lulizumab__pegol__LightChain | 544 | 1-108 | 109-108 |
| Lumiliximab__HeavyChain1 | 545 | 1-107 | 108-214 |
| Lumiliximab__LightChain1 | 546 | 1-68 | 69-398 |
| Lumretuzumab__HeavyChain1 | 547 | 1-120 | 121-449 |
| Lumretuzumab__LightChain1 | 548 | 1-113 | 114-221 |
| Lutetium__(177Lu)__lilotomab__satetraxetan__HeavyChain1 | 549 | 1-119 | 120-443 |
| Lutetium__(177Lu)__lilotomab__satetraxetan__LightChain1 | 550 | 1-107 | 108-214 |
| Margetuximab__HeavyChain1 | 551 | 1-120 | 121-450 |
| Margetuximab__LightChain1 | 552 | 1-107 | 108-214 |
| Marzeptacog__alfa__HeavyChain1 | 553 | 1-120 | 121-254 |
| Marzeptacog__alfa__LightChain1 | 554 | 1-107 | 108-152 |
| Matuzumab__HeavyChain1__variant__3c08__H | 555 | 1-121 | 122-223 |
| Matuzumab__HeavyChain1__variant__3c09__C | 556 | 1-121 | 122-223 |
| Matuzumab__LightChain1__variant__3c08__L | 557 | 1-106 | 107-212 |

TABLE 4-continued

Variable regions and constant regions of exemplified antibodies

| Name | Protein SEQ ID NO | Variable Region | Constant Region |
|---|---|---|---|
| Matuzumab_LightChain1_variant_3c09_B | 558 | 1-106 | 107-212 |
| Mavrilimumab_HeavyChain1 | 559 | 1-120 | 121-447 |
| Mavrilimumab_LightChain1 | 560 | 1-111 | 112-217 |
| MDX-1303_HeavyChain1 | 561 | 1-108 | 109-215 |
| MDX-1303_LightChain1 | 562 | 1-123 | 124-453 |
| Mepolizumab_HeavyChain1 | 563 | 1-113 | 114-220 |
| Mepolizumab_LightChain1 | 564 | 1-119 | 120-449 |
| Metelimumab_HeavyChain1 | 565 | 1-107 | 108-213 |
| Metelimumab_LightChain1 | 566 | 1-123 | 124-450 |
| Milatuzumab_HeavyChain1 | 567 | 1-120 | 121-450 |
| Milatuzumab_LightChain1 | 568 | 1-112 | 113-219 |
| Mirvetuximab_HeavyChain1 | 569 | 1-118 | 119-447 |
| Mirvetuximab_LightChain1 | 570 | 1-111 | 112-218 |
| Modotuximab_HeavyChain1 | 571 | 1-119 | 120-448 |
| Modotuximab_LightChain1 | 572 | 1-112 | 113-219 |
| Mogamulizumab_HeavyChain1 | 573 | 1-119 | 120-449 |
| Mogamulizumab_LightChain1 | 574 | 1-112 | 113-219 |
| Monalizumab_HeavyChain1 | 575 | 1-125 | 129-452 |
| Monalizumab_LightChain1 | 576 | 1-107 | 108-214 |
| Motavizumab_HeavyChain | 577 | 1-120 | 121-450 |
| Motavizumab_HeavyChain_variant | 578 | 1-120 | 121-450 |
| Motavizumab_LightChain | 579 | 1-106 | 107-213 |
| Motavizumab_LightChain_variant | 580 | 1-106 | 107-213 |
| Moxetumomab_pasudotox_HeavyChain1 | 581 | 1-120 | 121-476 |
| Moxetumomab_pasudotox_LightChain1 | 582 | 1-108 | 109-108 |
| Muromonab-CD3_HeavyChain | 583 | 1-119 | 120-450 |
| Muromonab-CD3_LightChain | 584 | 1-106 | 107-213 |
| Namilumab_HeavyChain1 | 585 | 1-119 | 120-449 |
| Namilumab_LightChain1 | 586 | 1-107 | 108-214 |
| Naptumomab_estafenatox_HeavyChain | 587 | 1-120 | 121-458 |
| Naptumomab_estafenatox_LightChain | 588 | 1-107 | 108-214 |
| Narnatumab_HeavyChain1 | 589 | 1-122 | 123-452 |
| Narnatumab_LightChain1 | 590 | 1-107 | 108-214 |
| Natalizumab_HeavyChain1 | 591 | 1-106 | 107-213 |
| Natalizumab_LightChain1 | 592 | 1-123 | 124-450 |
| Navicixizumab_HeavyChain1 | 593 | 1-119 | 120-445 |
| Navicixizumab_HeavyChain2 | 594 | 1-121 | 122-447 |
| Navicixizumab_LightChain1 | 595 | 1-111 | 112-218 |
| Navivumab_HeavyChain1 | 596 | 1-126 | 127-459 |
| Navivumab_LightChain1 | 597 | 1-108 | 109-215 |
| Ndimab-varB_HeavyChain | 598 | 1-126 | 127-724 |
| Ndimab-varB_LightChain | 599 | 1-108 | 109-215 |
| Necitumumab_HeavyChain1 | 600 | 1-121 | 122-451 |
| Necitumumab_LightChain1 | 601 | 1-107 | 108-214 |
| Neliximab_HeavyChain_VH-Region | 602 | 1-124 | 125-132 |
| Neliximab_HeavyChain_VH-Region_variant1 | 603 | 1-124 | 125-124 |
| Neliximab_LightChain_VL-Region | 604 | 1-106 | 107-106 |
| Neliximab_LightChain_VL-Region_variant1 | 605 | 1-106 | 107-118 |
| Nemolizumab_HeavyChain1 | 606 | 1-121 | 122-445 |
| Nemolizumab_LightChain1 | 607 | 1-107 | 108-214 |
| Nesvacumab_HeavyChain1 | 608 | 1-122 | 123-452 |
| Nesvacumab_LightChain1 | 609 | 1-107 | 108-214 |
| Neuradiab_HeavyChain1 | 610 | 1-112 | 113-219 |
| Neuradiab_LightChain1 | 611 | 1-118 | 119-454 |
| Nimotuzumab_HeavyChain1 | 612 | 1-114 | 115-114 |
| Nimotuzumab_LightChain1 | 613 | 1-123 | 124-123 |
| Nivolumab_HeavyChain1 | 614 | 1-113 | 114-440 |
| Nivolumab_LightChain1 | 615 | 1-107 | 108-214 |
| Obiltoxaximab_HeavyChain1 | 616 | 1-119 | 120-449 |
| Obiltoxaximab_LightChain1 | 617 | 1-107 | 108-214 |
| Obinutuzumab_HeavyChain1 | 618 | 1-119 | 120-449 |
| Obinutuzumab_LightChain1 | 619 | 1-112 | 113-219 |
| Ocaratuzumab_HeavyChain1 | 620 | 1-121 | 122-450 |
| Ocaratuzumab_LightChain1 | 621 | 1-106 | 107-213 |
| Ocrelizumab_HeavyChain1 | 622 | 1-106 | 107-213 |
| Ocrelizumab_LightChain1 | 623 | 1-122 | 123-452 |
| Ofatumumab_HeavyChain1 | 624 | 1-107 | 108-214 |
| Ofatumumab_LightChain1 | 625 | 1-122 | 123-452 |
| Olaratumab_HeavyChain1 | 626 | 1-127 | 128-457 |
| Olaratumab_LightChain1 | 627 | 1-107 | 108-214 |
| Olizuab_HeavyChain1 | 628 | 1-120 | 121-447 |
| Olizuab_LightChain1 | 629 | 1-110 | 111-217 |
| Olokizumab_HeavyChain1 | 630 | 1-120 | 121-447 |
| Olokizumab_LightChain1 | 631 | 1-107 | 108-214 |
| Omalizumab_HeavyChain | 632 | 1-121 | 122-447 |

TABLE 4-continued

Variable regions and constant regions of exemplified antibodies

| Name | Protein SEQ ID NO | Variable Region | Constant Region |
|---|---|---|---|
| Omalizumab_LightChain | 633 | 1-111 | 112-215 |
| Onartuzumab_HeavyChain1 | 634 | 1-119 | 120-449 |
| Onartuzumab_HeavyChain2 | 635 | 1-120 | 121-227 |
| Onartuzumab_LightChain1 | 636 | 1-113 | 114-220 |
| Ontuxizumab_HeavyChain1 | 637 | 1-124 | 125-454 |
| Ontuxizumab_LightChain1 | 638 | 1-108 | 109-215 |
| Opicinumab_HeavyChain1 | 639 | 1-118 | 119-447 |
| Opicinumab_LightChain1 | 640 | 1-108 | 109-215 |
| Oportuzumab_monatox_HeavyChain1 | 641 | 1-118 | 119-648 |
| Oportuzumab_monatox_SingleChain_variable_fragment | 642 | 1-118 | 119-647 |
| Oreptacog_alfa_HeavyChain1 | 643 | 1-120 | 121-254 |
| Oreptacog_alfa_LightChain1 | 644 | 1-107 | 108-152 |
| Orticumab_HeavyChain1 | 645 | 1-121 | 122-451 |
| Orticumab_LightChain1 | 646 | 1-110 | 111-216 |
| Otelixizumab_HeavyChain1 | 647 | 1-119 | 120-449 |
| Otelixizumab_LightChain1 | 648 | 1-110 | 111-216 |
| Otlertuzumab_HeavyChain1 | 649 | 1-116 | 117-483 |
| Oxelumab_HeavyChain1 | 650 | 1-120 | 121-449 |
| Oxelumab_LightChain1 | 651 | 1-107 | 108-214 |
| Ozanezumab_HeavyChain1 | 652 | 1-113 | 114-443 |
| Ozanezumab_LightChain1 | 653 | 1-112 | 113-219 |
| Ozoralizumab_HeavyChain1 | 654 | 1-115 | 116-363 |
| Palivizumab_HeavyChain | 655 | 1-120 | 121-450 |
| Palivizumab_LightChain | 656 | 1-106 | 107-213 |
| Palivizumab_VH-Region | 657 | 1-120 | 121-120 |
| Pamrevlumab_HeavyChain1 | 658 | 1-120 | 121-449 |
| Pamrevlumab_LightChain1 | 659 | 1-107 | 108-214 |
| Panitumumab_HeavyChain1 | 660 | 1-107 | 108-214 |
| Panitumumab_LightChain1 | 661 | 1-119 | 120-435 |
| Pankoab_HeavyChain1 | 662 | 1-114 | 115-442 |
| Pankoab_LightChain1 | 663 | 1-110 | 111-217 |
| Pankoab_LightChain2 | 664 | 1-110 | 111-217 |
| PankoMab_HeavyChain_VDJ-Region | 665 | 1-117 | 118-117 |
| PankoMab_LightChain_VJ-Region | 666 | 1-112 | 113-113 |
| Panobacumab_HeavyChain1 | 667 | 1-116 | 117-570 |
| Panobacumab_LightChain1 | 668 | 1-112 | 113-219 |
| Panobacumab_LightChain2 | 669 | 1-120 | 121-138 |
| Parsatuzumab_HeavyChain1 | 670 | 1-123 | 124-453 |
| Parsatuzumab_LightChain1 | 671 | 1-112 | 113-219 |
| Pascolizumab_HeavyChain1 | 672 | 1-111 | 112-218 |
| Pascolizumab_LightChain1 | 673 | 1-121 | 122-451 |
| Pasotuxizumab_HeavyChain1 | 674 | 1-121 | 122-504 |
| Pasotuxizumab_SingleChain | 675 | 1-121 | 122-505 |
| Pateclizumab_HeavyChain1 | 676 | 1-118 | 119-447 |
| Pateclizumab_LightChain1 | 677 | 1-107 | 108-214 |
| Patritumab_HeavyChain1 | 678 | 1-117 | 118-447 |
| Patritumab_hinge-CH2—CH3 | 679 | 1-120 | 121-227 |
| Patritumab_LightChain1 | 680 | 1-113 | 114-220 |
| Pembrolizumab_HeavyChain1 | 681 | 1-120 | 121-447 |
| Pembrolizumab_LightChain1 | 682 | 1-111 | 112-218 |
| Perakizumab_HeavyChain1 | 683 | 1-122 | 123-452 |
| Perakizumab_LightChain1 | 684 | 1-108 | 109-215 |
| Pertuzuab_HeavyChain1 | 685 | 1-117 | 118-444 |
| Pertuzuab_LightChain1 | 686 | 1-106 | 107-213 |
| Pertuzumab_HeavyChain | 687 | 1-107 | 108-214 |
| Pertuzumab_LightChain | 688 | 1-119 | 120-448 |
| Pexelizumab_h5g1.1-scFv | 689 | 1-111 | 112-250 |
| Pexelizumab_h5g1.1VHC_+_F_Heavy_Chain_V-Region | 690 | 1-115 | 116-115 |
| Pexelizumab_h5g1.1VHC_+_F_Light_Chain_V-Region | 691 | 1-106 | 107-106 |
| PF-05082566_HeavyChain1 | 692 | 1-116 | 117-442 |
| PF-05082568_LightChain1 | 693 | 1-108 | 109-214 |
| Pidilizumab_HeavyChain1 | 694 | 1-117 | 118-447 |
| Pidilizumab_LightChain1 | 695 | 1-106 | 107-213 |
| Pinatuzumab_vedotin_HeavyChain1 | 696 | 1-120 | 121-450 |
| Pinatuzumab_vedotin_LightChain1 | 697 | 1-112 | 113-219 |
| Placulumab_chain1 | 698 | 1-107 | 108-341 |
| Placulumab_HeavyChain1 | 699 | 1-107 | 108-341 |
| Plozalizumab_HeavyChain1 | 700 | 1-117 | 118-447 |
| Plozalizumab_LightChain1 | 701 | 1-112 | 113-219 |
| Pogalizumab_HeavyChain1 | 702 | 1-117 | 118-447 |
| Pogalizumab_LightChain1 | 703 | 1-107 | 108-214 |
| Polatuzumab_vedotin_HeavyChain1 | 704 | 1-117 | 118-447 |
| Polatuzumab_vedotin_LightChain1 | 705 | 1-111 | 112-218 |
| Ponezumab_HeavyChain1 | 706 | 1-116 | 117-442 |
| Ponezumab_LightChain1 | 707 | 1-112 | 113-219 |

TABLE 4-continued

Variable regions and constant regions of exemplified antibodies

| Name | Protein SEQ ID NO | Variable Region | Constant Region |
|---|---|---|---|
| Pritoxaximab_HeavyChain1 | 708 | 1-122 | 123-454 |
| Pritoxaximab_LightChain1 | 709 | 1-107 | 108-214 |
| Pritumumab_HeavyChain1 | 710 | 1-107 | 108-214 |
| Pritumumab_LightChain1 | 711 | 1-120 | 121-450 |
| Quilizumab_HeavyChain1 | 712 | 1-117 | 118-447 |
| Quilizumab_LightChain1 | 713 | 1-112 | 113-219 |
| Racotumomab_HeavyChain1 | 714 | 1-121 | 122-445 |
| Racotumomab_LightChain1 | 715 | 1-107 | 108-214 |
| Racotumomab_scVH-VH'-VH_chain | 716 | 1-115 | 116-363 |
| Radretumab_HeavyChain1 | 717 | 1-116 | 117-357 |
| Radretumab_j_chain | 718 | 1-120 | 121-138 |
| Rafivirumab_HeavyChain1 | 719 | 1-127 | 128-456 |
| Rafivirumab_HeavyChain | 720 | 1-127 | 128-456 |
| Rafivirumab_LightChain1 | 721 | 1-112 | 113-218 |
| Rafivirumab_LightChain | 722 | 1-112 | 113-218 |
| Ralpancizumab_HeavyChain1 | 723 | 1-118 | 119-444 |
| Ralpancizumab_LightChain1 | 724 | 1-107 | 108-214 |
| Ramucirumab_HeavyChain1 | 725 | 1-116 | 117-446 |
| Ramucirumab_LightChain1 | 726 | 1-107 | 108-214 |
| Ranibiziuab_HeavyChain1 | 727 | 1-121 | 122-229 |
| Ranibiziuab_LightChain1 | 728 | 1-107 | 108-214 |
| Ranibizumab_fab_fragment | 729 | 1-107 | 108-213 |
| Ranibizumab_HeavyChain | 730 | 1-123 | 124-231 |
| Ranibizumab_LightChain | 731 | 1-123 | 124-218 |
| Ranibizumab_LightChain_variant | 732 | 1-107 | 108-214 |
| Refanezumab_HeavyChain1 | 733 | 1-126 | 127-456 |
| Refanezumab_LightChain1 | 734 | 1-112 | 113-219 |
| REGN2810_HeavyChain1 | 735 | 1-115 | 116-438 |
| REGN2810_LightChain1 | 736 | 1-106 | 107-213 |
| rhuMab_HER2(9CI)_LightChain | 737 | 1-110 | 111-217 |
| rhuMab_HER2_HeavyChain | 738 | 1-74 | 75-405 |
| rhuMab_HER2_LightChain | 739 | 1-107 | 108-214 |
| rhuMab_HER2_LightChain_variant1 | 740 | 1-106 | 107-106 |
| rhuMab_HER2_LightChain_variant2 | 741 | 1-107 | 108-214 |
| rhuMab_HER2_LightChain_variant3 | 742 | 1-107 | 108-214 |
| rhuMab_HER2_LightChain_variant4 | 743 | 1-108 | 109-215 |
| rhuMab_HER2_LightChain_V-Region | 744 | 1-107 | 108-107 |
| rhuMab_HER2_gamma1-Chain | 745 | 1-120 | 121-450 |
| rhuMab_HER2_gamma1-Chain | 746 | 1-120 | 121-450 |
| rhuMab_HER2_gamma1-Chain_rhuMab_HER2_LightChain_sc405 | 747 | 1-120 | 121-243 |
| rhuMab_HER2_gamma1-Chain_variant1 | 748 | 1-120 | 121-450 |
| rhuMab_HER2_gamma1-Chain_variant2 | 749 | 1-120 | 121-450 |
| rhuMab_HER2_gamma1-Chain_variant3 | 750 | 1-120 | 121-450 |
| rhuMab_HER2_gamma1-Chain_V-Region | 751 | 1-120 | 121-120 |
| rhuMAb-VEGF_HeavyChain1 | 752 | 1-123 | 124-453 |
| rhuMAb-VEGF_LightChain1 | 753 | 1-107 | 108-214 |
| rhuMAb-VEGF_LightChain | 754 | 1-107 | 108-214 |
| rhuMAb-VEGF_LightChain_VG-Region | 755 | 1-107 | 108-107 |
| rhuMAb-VEGF_gamma1-Chain | 756 | 1-123 | 124-453 |
| rhuMAb-VEGF_gamma1-Chain_VDG-Region | 757 | 1-123 | 124-123 |
| Rilotumumab_HeavyChain1 | 758 | 1-120 | 121-446 |
| Rilotumumab_LightChain1 | 759 | 1-108 | 109-215 |
| Rilotumumab_scFv-CH_chain | 760 | 1-116 | 117-357 |
| Rinucumab_HeavyChain1 | 761 | 1-122 | 123-449 |
| Rinucumab_HeavyChain | 762 | 1-122 | 123-448 |
| Rinucumab_LightChain1 | 763 | 1-108 | 109-215 |
| Risankizumab_HeavyChain1 | 764 | 1-120 | 121-449 |
| Risankizumab_LightChain1 | 765 | 1-107 | 108-214 |
| Rituximab_HeavyChain | 766 | 1-121 | 122-451 |
| Rituximab_HeavyChain_variant | 767 | 1-121 | 122-451 |
| Rituximab_LightChain | 768 | 1-106 | 107-213 |
| Rivabazumab_pegol_HeavyChain1 | 769 | 1-124 | 125-238 |
| Rivabazumab_pegol_LightChain1 | 770 | 1-107 | 108-214 |
| Robatumumab_HeavyChain1 | 771 | 1-118 | 119-448 |
| Robatumumab_LightChain1 | 772 | 1-107 | 108-214 |
| Roledumab_HeavyChain1 | 773 | 1-126 | 127-456 |
| Roledumab_LightChain1 | 774 | 1-107 | 108-214 |
| Romosozumab_fab_fragment | 775 | 1-107 | 108-213 |
| Romosozumab_HeavyChain1 | 776 | 1-123 | 124-449 |
| Romosozumab_LightChain1 | 777 | 1-107 | 108-214 |
| Rontaliuzab_HeavyChain1 | 778 | 1-116 | 117-442 |
| Rontaliuzab_LightChain1 | 779 | 1-109 | 110-216 |
| Rontalizumab_HeavyChain1 | 780 | 1-117 | 118-447 |
| Rontalizumab_LightChain1 | 781 | 1-111 | 112-218 |
| Rovalpituzumab_tesirine_HeavyChain1 | 782 | 1-118 | 119-447 |

TABLE 4-continued

Variable regions and constant regions of exemplified antibodies

| Name | Protein SEQ ID NO | Variable Region | Constant Region |
|---|---|---|---|
| Rovalpituzumab_tesirine_LightChain1 | 783 | 1-107 | 108-214 |
| Rovelizumab_HeavyChain1 | 784 | 1-111 | 112-218 |
| Rovelizumab_LightChain1 | 785 | 1-120 | 121-447 |
| Ruplizumab_HeavyChain1 | 786 | 1-111 | 112-218 |
| Ruplizumab_LightChain1 | 787 | 1-118 | 119-447 |
| Sacituzumab_govitecan_HeavyChain1 | 788 | 1-121 | 122-451 |
| Sacituzumab_govitecan_LightChain1 | 789 | 1-107 | 108-214 |
| Samalizumab_HeavyChain1 | 790 | 1-117 | 118-442 |
| Samalizumab_LightChain1 | 791 | 1-107 | 108-214 |
| Sarilumab_HeavyChain1 | 792 | 1-116 | 117-446 |
| Sarilumab_LightChain1 | 793 | 1-107 | 108-214 |
| Satumomab_pendetide_HeavyChain | 794 | 1-114 | 115-432 |
| Satumomab_pendetide_LightChain | 795 | 1-107 | 108-210 |
| Secukinumab_HeavyChain1 | 796 | 1-127 | 128-457 |
| Secukinumab_LightChain1 | 797 | 1-108 | 109-215 |
| Seribantumab_HeavyChain1 | 798 | 1-119 | 120-445 |
| Seribantumab_LightChain1 | 799 | 1-111 | 112-217 |
| Setoxaximab_HeavyChain1 | 800 | 1-121 | 122-451 |
| Setoxaximab_LightChain1 | 801 | 1-113 | 114-220 |
| Sifalimumab_HeavyChain1 | 802 | 1-116 | 117-446 |
| Sifalimumab_LightChain1 | 803 | 1-108 | 109-215 |
| Siltuximab_HeavyChain1 | 804 | 1-119 | 120-449 |
| Siltuximab_LightChain1 | 805 | 1-106 | 107-213 |
| Simtuzumab_HeavyChain1 | 806 | 1-116 | 117-443 |
| Simtuzumab_LightChain1 | 807 | 1-112 | 113-219 |
| Sirukumab_HeavyChain1 | 808 | 1-119 | 120-449 |
| Sirukumab_LightChain1 | 809 | 1-106 | 107-213 |
| Sofituzumab_vedotin_HeavyChain1 | 810 | 1-116 | 117-446 |
| Sofituzumab_vedotin_LightChain1 | 811 | 1-107 | 108-214 |
| Solanezumab_HeavyChain1 | 812 | 1-112 | 113-441 |
| Solanezumab_HeavyChain | 813 | 1-112 | 113-442 |
| Solanezumab_LightChain1 | 814 | 1-112 | 113-219 |
| Solitomab_HeavyChain1 | 815 | 1-113 | 114-502 |
| Solitomab_SingleChain | 816 | 1-113 | 114-503 |
| Sonepcizumab_LightChain_Precursor | 817 | 1-127 | 128-234 |
| Sonepcizumab_gamma1-Chain_Precursor | 818 | 1-140 | 141-455 |
| Stamulumab_HeavyChain1 | 819 | 1-105 | 106-211 |
| Stamulumab_LightChain1 | 820 | 1-117 | 118-446 |
| Suptavumab_HeavyChain1 | 821 | 1-107 | 108-214 |
| Suptavumab_LightChain1 | 822 | 1-123 | 124-452 |
| Suvizumab_HeavyChain1 | 823 | 1-118 | 119-448 |
| Suvizumab_LightChain1 | 824 | 1-113 | 114-220 |
| Tabalumab_HeavyChain1 | 825 | 1-123 | 124-450 |
| Tabalumab_LightChain1 | 826 | 1-107 | 108-214 |
| Tacatuzuab_HeavyChain1 | 827 | 1-117 | 118-444 |
| Tacatuzuab_LightChain1 | 828 | 1-105 | 106-212 |
| Tadocizumab_fab_fragment_HeavyChain | 829 | 1-119 | 120-226 |
| Tadocizumab_fab_fragment_LightChain | 830 | 1-107 | 108-194 |
| Talizumab_HeavyChain1 | 831 | 1-107 | 108-214 |
| Talizumab_LightChain1 | 832 | 1-123 | 124-453 |
| Tamtuvetmab_HeavyChain1 | 833 | 1-107 | 108-213 |
| Tamtuvetmab_LightChain1 | 834 | 1-121 | 122-456 |
| Tanezumab_HeavyChain | 835 | 1-120 | 121-120 |
| Tanezumab_LightChain | 836 | 1-107 | 108-109 |
| Tarextumab_HeavyChain1 | 837 | 1-115 | 116-441 |
| Tarextumab_LightChain1 | 838 | 1-108 | 109-215 |
| Tefibazumab_HeavyChain1 | 839 | 1-112 | 113-112 |
| Tefibazumab_LightChain1 | 840 | 1-121 | 122-121 |
| Tenatumomab_HeavyChain1 | 841 | 1-120 | 121-456 |
| Tenatumomab_LightChain1 | 842 | 1-112 | 113-219 |
| Teneliximab_HeavyChain1 | 843 | 1-107 | 108-214 |
| Teneliximab_LightChain1 | 844 | 1-122 | 123-452 |
| Teplizumab_HeavyChain1 | 845 | 1-119 | 120-449 |
| Teplizumab_LightChain1 | 846 | 1-106 | 107-213 |
| Teprotumumab_HeavyChain1 | 847 | 1-118 | 119-448 |
| Teprotumumab_LightChain1 | 848 | 1-108 | 109-215 |
| Tesidolumab_HeavyChain1 | 849 | 1-116 | 117-446 |
| Tesidolumab_LightChain1 | 850 | 1-108 | 109-214 |
| Tezepelumab_HeavyChain1 | 851 | 1-122 | 123-448 |
| Tezepelumab_LightChain1 | 852 | 1-108 | 109-214 |
| ThioMAb-chMA79b-HC(A118C)_HeavyChain | 853 | 1-117 | 118-446 |
| ThioMab-hu10A8.v1-HC(A118C)_HeavyChain | 854 | 1-119 | 120-449 |
| ThioMab-hu10A8.v1-HC(V205C)_HeavyChain | 855 | 1-119 | 120-449 |
| ThioMab-hu10A8.v1-LC(A118C)_LightChain | 856 | 1-107 | 108-214 |
| ThioMab-hu10A8.v1-LC(V205C)_LightChain | 857 | 1-107 | 108-214 |

TABLE 4-continued

Variable regions and constant regions of exemplified antibodies

| Name | Protein SEQ ID NO | Variable Region | Constant Region |
|---|---|---|---|
| ThioMAb-huMA79b.v17-HC(A118C)_HeavyChain | 858 | 1-117 | 118-446 |
| ThioMAb-huMA79b.v17-HC(A118C)_LightChain | 859 | 1-111 | 112-218 |
| ThioMAb-huMA79b.v18-HC(A118C)_HeavyChain | 860 | 1-117 | 118-446 |
| ThioMAb-huMA79b.v28-HC(A118C)_LightChain | 861 | 1-111 | 112-218 |
| ThioMAb-huMA79b.v28-LC(V205C)_LightChain | 862 | 1-111 | 112-218 |
| Ticiliuab_HeavyChain1 | 863 | 1-122 | 123-444 |
| Ticiliuab_LightChain1 | 864 | 1-106 | 107-213 |
| Tigatuzumab_HeavyChain1 | 865 | 1-119 | 120-449 |
| Tigatuzumab_HeavyChain | 866 | | |
| Tigatuzumab_LightChain1 | 867 | 1-106 | 107-213 |
| Tigatuzumab_LightChain | 868 | 1-107 | 108-216 |
| Tildrakizumab_HeavyChain1 | 869 | 1-116 | 117-446 |
| Tildrakizumab_LightChain1 | 870 | 1-107 | 108-214 |
| Tisotumab_vedotin_HeavyChain1 | 871 | 1-118 | 119-448 |
| Tisotumab_vedotin_LightChain1 | 872 | 1-107 | 108-214 |
| Tocilizumab_HeavyChain1 | 873 | 1-107 | 108-214 |
| Tocilizumab_LightChain1 | 874 | 1-119 | 120-447 |
| Tosatoxumab_HeavyChain1 | 875 | 1-121 | 122-451 |
| Tosatoxumab_LightChain1 | 876 | 1-111 | 112-217 |
| Tositumomab_HeavyChain | 877 | 1-123 | 124-447 |
| Tositumomab_LightChain | 878 | 1-106 | 107-210 |
| Tovetumab_HeavyChain1 | 879 | 1-120 | 121-446 |
| Tovetumab_LightChain1 | 880 | 1-108 | 109-215 |
| Tralokinumab_HeavyChain1 | 881 | 1-122 | 123-449 |
| Tralokinumab_LightChain1 | 882 | 1-108 | 109-214 |
| Trastuzuab_HeavyChain1 | 883 | 1-118 | 119-444 |
| Trastuzuab_LightChain1 | 884 | | |
| Trastuzumab_emtansine_HeavyChain1 | 885 | 1-120 | 121-449 |
| Trastuzumab_emtansine_LightChain1 | 886 | 1-107 | 108-214 |
| Trastuzumab_HeavyChain1 | 887 | | |
| Trastuzumab_HeavyChain | 888 | 1-120 | 121-451 |
| Trastuzumab_HeavyChain_variant_In8z_B | 889 | 1-120 | 121-220 |
| Trastuzumab_HeavyChain_variant_7637_H | 890 | 1-15 | |
| Trastuzumab_LightChain1 | 891 | 1-107 | 108-214 |
| Trastuzumab_LightChain_variant_In8z_A | 892 | 1-107 | 108-214 |
| Trastuzumab_LightChain_variant_7637_L | 893 | 1-107 | 108-214 |
| TRC-105_HeavyChain1 | 894 | 1-118 | 119-448 |
| TRC-105_LightChain1 | 895 | 1-106 | 107-213 |
| Tregalizumab_HeavyChain1 | 896 | 1-124 | 125-454 |
| Tregalizumab_LightChain1 | 897 | 1-111 | 112-218 |
| Tremelimumab_HeavyChain1 | 898 | 1-107 | 108-214 |
| Tremelimumab_LightChain1 | 899 | 1-125 | 126-451 |
| Trevogrumab_HeavyChain1 | 900 | 1-120 | 121-447 |
| Trevogrumab_LightChain1 | 901 | 1-107 | 108-214 |
| Tucotuzumab_celmoleukin_HeavyChain1 | 902 | 1-106 | 107-213 |
| Tucotuzumab_celmoleukin_LightChain1 | 903 | 1-116 | 117-579 |
| Ublituximab_HeavyChain1 | 904 | 1-118 | 119-448 |
| Ublituximab_LightChain1 | 905 | 1-106 | 107-213 |
| Ulocuplumab_HeavyChain1 | 906 | 1-125 | 126-451 |
| Ulocuplumab_LightChain1 | 907 | 1-107 | 108-214 |
| Urelumab_HeavyChain1 | 908 | 1-121 | 122-448 |
| Urelumab_LightChain1 | 909 | 1-107 | 108-216 |
| Urtoxazumab_HeavyChain1 | 910 | 1-107 | 108-214 |
| Urtoxazumab_LightChain1 | 911 | 1-119 | 120-449 |
| Ustekinumab_HeavyChain1 | 912 | 1-107 | 108-214 |
| Ustekinumab_LightChain1 | 913 | 1-119 | 120-449 |
| Vadastuximab_talirine_HeavyChain1 | 914 | 1-117 | 118-447 |
| Vadastuximab_talirine_LightChain1 | 915 | 1-107 | 108-214 |
| Vandortuzumab_vedotin_HeavyChain1 | 916 | 1-124 | 125-454 |
| Vandortuzumab_vedotin_LightChain1 | 917 | 1-113 | 114-221 |
| Vantictumab_HeavyChain1 | 918 | 1-118 | 119-443 |
| Vantictumab_LightChain1 | 919 | 1-107 | 108-213 |
| Vanucizumab_HeavyChain1 | 920 | 1-129 | 130-463 |
| Vanucizumab_HeavyChain2 | 921 | 1-123 | 124-453 |
| Vanucizumab_LightChain1 | 922 | 1-110 | 111-213 |
| Vanucizumab_LightChain2 | 923 | 1-107 | 108-214 |
| Varlilumab_HeavyChain1 | 924 | 1-119 | 120-452 |
| Varlilumab_LightChain1 | 925 | 1-107 | 108-214 |
| Vatelizumab_HeavyChain1 | 926 | 1-119 | 120-446 |
| Vatelizumab_LightChain1 | 927 | 1-106 | 107-213 |
| Vedolizumab_HeavyChain1 | 928 | 1-121 | 122-451 |
| Vedolizumab_LightChain1 | 929 | 1-112 | 113-219 |
| Veltuzumab_HeavyChain1 | 930 | 1-121 | 122-451 |
| Veltuzumab_LightChain1 | 931 | 1-106 | 107-213 |
| Vesencumab_HeavyChain1 | 932 | 1-123 | 124-453 |

TABLE 4-continued

Variable regions and constant regions of exemplified antibodies

| Name | Protein SEQ ID NO | Variable Region | Constant Region |
|---|---|---|---|
| Vesencumab_LightChain1 | 933 | 1-107 | 108-214 |
| Visilizumab_HeavyChain1 | 934 | 1-106 | 107-213 |
| Visilizumab_LightChain1 | 935 | 1-120 | 121-446 |
| Volociximab_HeavyChain | 936 | 1-124 | 125-451 |
| Volociximab_LightChain | 937 | 1-108 | 109-215 |
| Vorsetuzumab_HeavyChain1 | 939 | 1-118 | 119-448 |
| Vorsetuzumab_LightChain1 | 939 | 1-111 | 112-218 |
| Vorsetuzumab_mafodotin_HeavyChain1 | 940 | 1-118 | 119-448 |
| Vorsetuzumab_mafodotin_LightChain1 | 941 | 1-111 | 112-218 |
| Yttrium_(90Y)_clivatuzumab_tetraxetan_HeavyChain1 | 942 | 1-119 | 120-449 |
| Yttrium_(90Y)_clivatuzumab_tetraxetan_LightChain1 | 943 | 1-108 | 109-215 |
| Yttrium_Y_90_epratuzumab_tetraxetan_HeavyChain1 | 944 | 1-112 | 113-219 |
| Yttrium_Y_90_epratuzumab_tetraxetan_LightChain1 | 945 | 1-116 | 117-446 |
| Yttrium_Y_90_epratuzumab_HeavyChain1 | 946 | 1-115 | 116-442 |
| Yttrium_Y_90_epratuzumab_LightChain1 | 947 | 1-111 | 112-218 |
| Zalutumumab_HeavyChain1 | 948 | 1-107 | 108-214 |
| Zalutumumab_LightChain1 | 949 | 1-125 | 126-455 |
| Zanolimumab_HO_HeavyChain | 950 | 1-115 | 116-444 |
| Zanolimumab_LO_LightChain | 951 | 1-108 | 109-214 |
| Zatuximab_HeavyChain1 | 952 | 1-119 | 120-448 |
| Zatuximab_LightChain1 | 953 | 1-112 | 113-219 |

Accordingly, it is preferred that the at least one coding sequence of the RNA according to the present invention encodes a heavy chain variable region and/or a light chain variable region of an antibody, or an antigen-binding fragment or variant of a heavy chain variable region and/or a light chain variable region of an antibody. Preferably, the heavy chain variable region and/or the light chain variable region encoded by the at least one coding sequence comprises or consists of an amino acid sequence as described in Table 4 above.

Table 5 below shows the amino acid positions of the heavy chain and light chain CDRs in the heavy chain and light chain amino acid sequences of exemplified antibodies, which are preferably encoded by the RNA according to the present invention as described herein. Thereby, a CDR of, for example, "22-41" means that amino acids 22-41 of the respective amino acid sequence ("Protein SEQ ID NO") form the respective CDR. The first column identifies whether the amino acid sequence ("Protein SEQ ID NO") is of the heavy chain or of the light chain. Similarly to the variable regions/constant regions shown in Table 4, the skilled person can easily identify the heavy chain CDR's (CDRH1, CDRH2, CDRH3) and the light chain CDR's (CDRL1, CDRL2, CDRL3) of the exemplified antibodies based on the information in Table 5. Moreover, on basis of that information on amino acid sequence level, the skilled person can easily identify the corresponding RNA sequence fragments (i.e. the RNA sequences encoding the heavy chain/light chain CDR's, respectively), in particular by using the RNA sequences shown in Table 3 corresponding to the antibody of interest's amino acid sequence.

TABLE 5

CDRs of exemplified antibodies

| Name | Protein SEQ ID NO | CDR1 | CDR2 | CDR3 |
|---|---|---|---|---|
| AAB-003_gamma1-Chain | 1 | 22-41 | | 94-113 |
| Abagovomab_HeavyChain | 2 | 22-41 | 51-60 | 94-113 |
| Abagovomab_LightChain | 3 | 22-41 | 29-38 | 86-105 |
| Abciximab_HeavyChain | 4 | 22-41 | | 94-113 |
| Abciximab_LightChain | 5 | 22-41 | 48-57 | 86-105 |
| Abituzumab_HeavyChain1 | 6 | 22-41 | | 94-113 |
| Abituzumab_LightChain1 | 7 | 22-41 | 48-57 | 86-105 |
| Abrilumab_HeavyChain1 | 8 | 22-41 | 59-68 | 94-113 |
| Abrilumab_LightChain1 | 9 | 22-41 | 48-57 | 86-105 |
| Abrilumab_LightChain1_variant2 | 10 | 22-41 | 47-56 | 85-104 |
| Actoxumab_HeavyChain1 | 11 | 22-41 | | 94-113 |
| Actoxumab_LightChain1 | 12 | 22-41 | 49-58 | 87-106 |
| Adalimumab_HeavyChain | 13 | 22-41 | | 94-113 |
| Adalimumab_LightChain | 14 | 22-41 | 48-57 | 86-105 |
| Aducanumab_HeavyChain1 | 15 | 22-41 | | 94-113 |
| Aducanumab_LightChain1 | 16 | 22-41 | 48-57 | 86-105 |
| Afasevikumab_HeavyChain1 | 17 | 22-41 | | 94-113 |
| Afasevikumab_LightChain1 | 18 | 22-41 | 48-57 | 86-105 |
| Aflibercept_Fusion_protein1 | 19 | 22-41 | | |
| Afutuzuab_HeavyChain1 | 20 | 22-41 | | 92-111 |
| Afutuzuab_LightChain1 | 21 | 22-41 | 52-61 | 89-108 |
| Afutuzumab_HeavyChain1 | 22 | 22-41 | | 94-113 |
| Afutuzumab_LightChain1 | 23 | 22-41 | 53-62 | 91-110 |
| Alacizumab_pegol_HeavyChain1 | 24 | 22-41 | | 94-113 |

TABLE 5-continued

CDRs of exemplified antibodies

| Name | Protein SEQ ID NO | CDR1 | CDR2 | CDR3 |
|---|---|---|---|---|
| Alacizumab_pegol_LightChain1 | 25 | 22-41 | 48-57 | 86-105 |
| Alemtuzumab_HeavyChain | 26 | 22-41 | | 96-115 |
| Alemtuzumab_HeavyChain_variant_Ibey_H | 27 | 22-41 | | 96-115 |
| Alemtuzumab_HeavyChain_variant_Icel_H | 28 | 22-41 | | 96-115 |
| Alemtuzumab_HeavyChain_variant_8005_H | 29 | 22-41 | | 96-115 |
| Alemtuzumab_LightChain | 30 | 22-41 | 48-57 | 86-105 |
| Alemtuzumab_LightChain_variant_8005_L | 31 | 22-41 | 48-57 | 86-105 |
| Alirocumab_HeavyChain1 | 32 | 22-41 | | 94-113 |
| Alirocumab_LightChain1 | 33 | 22-41 | 54-63 | 92-111 |
| ALX-0061_HeavyChain1 | 34 | 22-41 | | 93-112 |
| Amatuximab_HeavyChain1 | 35 | 22-41 | | |
| Amatuximab_LightChain1 | 36 | 22-41 | 47-56 | 85-104 |
| Anetumab_ravtansine_HeavyChain1 | 37 | 22-41 | | 94-113 |
| Anetumab_ravtansine_LightChain1 | 38 | 22-41 | 50-59 | 88-107 |
| Anifrolumab_HeavyChain1 | 39 | 22-41 | 51-60 | 94-113 |
| Anifrolumab_LightChain1 | 40 | 22-41 | 49-58 | 87-106 |
| Anrukinzumab_HeavyChain1 | 41 | 22-41 | | 93-112 |
| Anrukinzumab_LightChain1 | 42 | 22-41 | 52-61 | 90-109 |
| Apolizumab_HeavyChain1 | 43 | 22-41 | | 93-112 |
| Apolizumab_LightChain1 | 44 | 22-41 | 29-38 | 86-105 |
| Apomab_HeavyChain | 45 | 22-41 | | 93-112 |
| Apomab_LightChain | 46 | 22-41 | 46-55 | 84-103 |
| Aquaporumab_LightChain | 47 | 22-41 | | 87-106 |
| Arcitumomab_99tc_HeavyChain | 48 | 22-41 | 376-385 | 96-115 |
| Arcitumomab_99tc_LightChain | 49 | 22-41 | 47-56 | 85-104 |
| Ascrinvacumab_HeavyChain1 | 50 | 22-41 | 53-62 | 95-114 |
| Ascrinvacumab_LightChain1 | 51 | 22-41 | 49-58 | 87-106 |
| Aselizub_HeavyChain1 | 52 | 22-41 | | 91-110 |
| Aselizub_HeavyChain2 | 53 | 22-41 | | 91-110 |
| Aselizuab_LightChain1 | 54 | 22-41 | 50-59 | 88-107 |
| Atezolizumab_HeavyChain1 | 55 | 22-41 | | 94-113 |
| Atezolizumab_LightChain1 | 56 | 22-41 | 48-57 | 86-105 |
| Atinumab_HeavyChain1 | 57 | 22-41 | | 94-113 |
| Atinumab_LightChain1 | 58 | 22-41 | 48-57 | 86-105 |
| Atlizuab_HeavyChain1 | 59 | 22-41 | | 92-111 |
| Atlizuab_LightChain1 | 60 | 22-41 | 47-56 | 85-104 |
| Aurograb_SingleChain | 61 | 22-41 | 192-201 | 230-249 |
| Avelumab_HeavyChain1 | 62 | 22-41 | 51-60 | 94-113 |
| Avelumab_LightChain1 | 63 | 22-41 | 50-59 | 88-107 |
| Bapineuzumab_HeavyChain1 | 64 | 22-41 | | 94-113 |
| Bapineuzumab_LightChain1 | 65 | 22-41 | 53-62 | 91-110 |
| Basiliximab_HeavyChain | 66 | 22-41 | 49-58 | 92-111 |
| Basiliximab_LightChain | 67 | 22-41 | 47-56 | 85-104 |
| Bavituximab_HeavyChain | 68 | 22-41 | | 94-113 |
| Bavituximab_LightChain | 69 | 22-41 | 48-57 | 86-105 |
| Bavituximab_LightChain_variant_8734_L | 70 | 22-41 | 48-57 | 86-105 |
| Begelomab_HeavyChain1 | 71 | 22-41 | 415-424 | |
| Begelomab_LightChain1 | 72 | 22-41 | 47-56 | 85-104 |
| Benralizumab_HeavyChain1 | 73 | 22-41 | | |
| Benralizumab_LightChain1 | 74 | 22-41 | 48-57 | 86-105 |
| Betalutin_HeavyChain1 | 75 | 22-41 | | 94-113 |
| Betalutin_LightChain1 | 76 | 22-41 | | 86-105 |
| Bevacituzuab_HeavyChain1 | 77 | 22-41 | | 92-111 |
| Bevacituzuab_LightChain1 | 78 | 22-41 | 47-56 | 85-104 |
| Bevacizumab_154-aspartic_acid_LightChain | 79 | 22-41 | 48-57 | 86-105 |
| Bevacizumab_154-substitution_deriv_LightChain | 80 | 22-41 | 48-57 | 86-105 |
| Bevacizumab_180-serine_HeavyChain | 81 | 22-41 | | 94-113 |
| Bevacizumab_180-substitution_deriv_HeavyCahin | 82 | 22-41 | | 94-113 |
| Bevacizumab_beta_HeavyChain1 | 83 | 22-41 | | 94-113 |
| Bevacizumab_beta_LightChain1 | 84 | 22-41 | 48-57 | 86-105 |
| Bevacizumab_LcDomain | 85 | 22-41 | | |
| Bevacizumab_HeavyChain | 86 | 22-41 | | 94-113 |
| Bevacizumab_HeavyChain_variant1 | 87 | 22-41 | | 117-136 |
| Bevacizumab_HeavyChain_V-Region | 88 | 22-41 | | 94-113 |
| Bevacizumab_LightChain1 | 89 | 22-41 | 73-82 | 111-130 |
| Bevacizumab_LightChain2 | 90 | 22-41 | 71-80 | 109-128 |
| Bevacizumab_LightChain | 91 | 22-41 | 48-57 | 86-105 |
| Bevacizumab_LightChain_VJ-Region | 92 | 22-41 | 48-57 | 86-105 |
| Bevacizumab_LightChain_V-Region | 93 | 22-41 | 48-57 | 86-105 |
| Bevacizumab-rhuMAb-VEGF_HeavyChain_gamma1-Chain_VDJ-Region | 94 | 22-41 | | 94-113 |
| Bevacizumab-rhuMAb-VEGF_LightChain_VJ-Region | 95 | 22-41 | 48-57 | 86-105 |
| Bevacizumab_gamma1-Chain | 96 | 22-41 | | 94-113 |
| Bevacizumab_gamma1-Chain_CH3-Region_mutein | 97 | 22-41 | | 94-113 |
| Bezlotoxumab_HeavyChain1 | 98 | 22-41 | | 94-113 |
| Bezlotoxumab_LightChain1 | 99 | 22-41 | 49-58 | 87-106 |
| Bimagrumab_HeavyChain1 | 100 | 22-41 | | 94-113 |

TABLE 5-continued

CDRs of exemplified antibodies

| Name | Protein SEQ ID NO | CDR1 | CDR2 | CDR3 |
|---|---|---|---|---|
| Bimagrumab_HeavyChain | 101 | 22-41 | | 94-113 |
| Bimagrumab_LightChain1 | 102 | 22-41 | 50-59 | 88-107 |
| Bimekizumab_HeavyChain1 | 103 | 22-41 | 107-116 | 94-113 |
| Bimekizumab_LightChain1 | 104 | 22-41 | 48-57 | 86-105 |
| Bleselumab_HeavyChain1 | 105 | 22-41 | 53-62 | 95-114 |
| Bleselumab_LightChain1 | 106 | 22-41 | 49-57 | 86-105 |
| Blinatumomab_HeavyChain1 | 107 | 22-41 | 52-61 | 349-368 |
| Blinatumomab_SingleChain | 108 | 22-41 | 52-61 | 349-368 |
| Blinatumomab_SingleChain_variable_fragment_fusion_protein_(bite) | 109 | 22-41 | 52-61 | 349-368 |
| Blontuvetmab_HeavyChain | 110 | 22-41 | | 94-113 |
| Blontuvetmab_LightChain | 111 | 22-41 | 54-63 | |
| Blosozumab_HeavyChain1 | 112 | 22-41 | | 94-113 |
| Blosozumab_LightChain1 | 113 | 22-41 | 48-57 | 86-105 |
| Bococizumab_HeavyChain1 | 114 | 22-41 | | 94-113 |
| Bococizumab_LightChain1 | 115 | 22-41 | 48-57 | 86-105 |
| Brentuximab_vedotin_HeavyChain1 | 116 | 22-41 | 51-60 | |
| Brentuximab_vedotin_LightChain1 | 117 | 22-41 | 52-61 | 90-109 |
| Briakinumab_HeavyChain1 | 118 | 22-41 | | 94-113 |
| Briakinumab_LightChain1 | 119 | 22-41 | 49-58 | 87-106 |
| Brodalumab_HeavyChain1 | 120 | 22-41 | | 94-113 |
| Brodalumab_LightChain1 | 121 | 22-41 | 48-57 | 86-105 |
| Brolucizumab_HeavyChain1 | 122 | 22-41 | 49-58 | 87-106 |
| Brolucizumab_scfv_fragment | 123 | 22-41 | 49-58 | 87-106 |
| Brontictuzumab_HeavyChain1 | 124 | 22-41 | | 94-113 |
| Brontictuzumab_LightChain1 | 125 | 22-41 | | 88-107 |
| BTT-1023_HeavyChain1 | 126 | 22-41 | | 94-113 |
| BTT-1023_LightChain1 | 127 | 22-41 | 48-57 | 86-105 |
| Burosumab_HeavyChain1 | 128 | 22-41 | | 94-113 |
| Burosumab_LightChain1 | 129 | 22-41 | 48-57 | 86-105 |
| Canakinumab_HeavyChain1 | 130 | 22-41 | | 94-113 |
| Canakinumab_HeavyChain | 131 | 22-41 | | 94-113 |
| Canakinumab_LightChain1 | 132 | 22-41 | | 86-105 |
| Canakinumab_LightChain | 133 | 22-41 | | 86-105 |
| Canakinumab_LightChain_variant_8836_L | 134 | 22-41 | | 94-113 |
| Cantuzumab_HeavyChain1 | 135 | 22-41 | | |
| Cantuzumab_HeavyChain | 136 | 22-41 | | |
| Cantuzumab_LightChain1 | 137 | 22-41 | 53-62 | 91-110 |
| Cantuzumab_mertansine_HeavyChain1 | 138 | 22-41 | | |
| Cantuzumab_mertansine_LightChain1 | 139 | 22-41 | 53-62 | 91-110 |
| Cantuzumab_ravtansine_HeavyChain1 | 140 | 22-41 | | |
| Cantuzumab_ravtansine_LightChain1 | 141 | 22-41 | 53-62 | 91-110 |
| Caplacizumab | 142 | 22-41 | | 94-113 |
| Caplacizumab_HeavyChain1 | 143 | 22-41 | | 94-113 |
| Caplacizumab_HeavyChain1 | 144 | 22-41 | | 94-113 |
| Carlumab_HeavyChain1 | 145 | 22-41 | 102-111 | 94-113 |
| Carlumab_LightChain1 | 146 | 22-41 | 49-58 | 87-106 |
| Cergutuzumab_amunaleukin_HeavyChain1 | 147 | 22-41 | | 94-113 |
| Cergutuzumab_amunaleukin_HeavyChain2 | 148 | 22-41 | | 94-113 |
| Cergutuzumab_amunaleukin_LightChain1 | 149 | 22-41 | 48-57 | 86-105 |
| Certolizumab_pegol_HeavyChain1 | 150 | 22-41 | 59-68 | 94-113 |
| Certolizumab_pegol_HeavyChain | 151 | 22-41 | 59-68 | 94-113 |
| Certolizumab_pegol_LightChain1 | 152 | 22-41 | 48-57 | 86-105 |
| Certolizumab_pegol_LightChain | 153 | 22-41 | 48-57 | 86-105 |
| Cetuximab_HeavyChain | 154 | 22-41 | 92-101 | 93-112 |
| Cetuximab_HeavyChain_variant | 155 | 22-41 | 92-101 | 93-112 |
| Cetuximab_LightChain | 156 | 22-41 | | 86-105 |
| Cetuximab_LightChain_variant | 157 | 22-41 | | 86-105 |
| Citatuzumab_bogatox_HeavyChain1 | 158 | 22-41 | | 100-119 |
| Citatuzumab_bogatox_LightChain1 | 159 | 22-41 | 53-62 | 91-110 |
| Cixutumumab_HeavyChain1 | 160 | 22-41 | | 94-113 |
| Cixutumumab_LightChain1 | 161 | 22-41 | 47-56 | 85-104 |
| Clazakizumab_HeavyChain1 | 162 | 22-41 | 51-60 | 93-112 |
| Clazakizumab_LightChain1 | 163 | 22-41 | 48-57 | 86-105 |
| Clivatuzumab_tetraxetan_HeavyChain1 | 164 | 22-41 | | 94-113 |
| Clivatuzumab_tetraxetan_LightChain1 | 165 | 22-41 | 49-58 | |
| Codrituzumab_HeavyChain1 | 166 | 22-41 | | 94-113 |
| Codrituzumab_LightChain1 | 167 | 22-41 | 53-62 | 91-110 |
| Coltuximab_ravtansine_HeavyChain1 | 168 | 22-41 | | 94-113 |
| Coltuximab_ravtansine_LightChain1 | 169 | 22-41 | 47-56 | 85-104 |
| Conatumumab_CV_HeavyChain | 170 | 22-41 | | 95-114 |
| Conatumumab_CV_LightChain | 171 | 22-41 | 49-58 | 87-106 |
| Conatumumab_HeavyChain1 | 172 | 22-41 | | 95-114 |
| Conatumumab_HeavyChain | 173 | 22-41 | | 95-114 |
| Conatumumab_LightChain1 | 174 | 22-41 | 49-58 | 87-106 |
| Conatumumab_LightChain | 175 | 22-41 | 49-58 | 87-106 |
| Concizumab_HeavyChain1 | 176 | 22-41 | | 94-113 |

TABLE 5-continued

CDRs of exemplified antibodies

| Name | Protein SEQ ID NO | CDR1 | CDR2 | CDR3 |
|---|---|---|---|---|
| Concizumab_LightChain1 | 177 | 22-41 | 53-62 | 91-110 |
| Crenezumab_HeavyChain1 | 178 | 22-41 | | 94-113 |
| Crenezumab_LightChain1 | 179 | 22-41 | 53-62 | 91-110 |
| Crotedumab_HeavyChain1 | 180 | 22-41 | | 94-113 |
| Crotedumab_HeavyChain2 | 181 | 22-41 | | 94-113 |
| Crotedumab_LightChain1 | 182 | 22-41 | 48-57 | 86-105 |
| Crotedumab_LightChain2 | 183 | 22-41 | 48-57 | 86-105 |
| Dacetuzumab_HeavyChain1 | 184 | 22-41 | 101-110 | 94-113 |
| Dacetuzumab_LightChain1 | 185 | 22-41 | 53-62 | |
| Dacliximab_LightChain_VJ-Region | 186 | 22-41 | 47-56 | 85-104 |
| Dacliximab_gamma2-Chain_VDJ-Region | 187 | 22-41 | | 94-113 |
| Daclizumab_HeavyChain | 188 | 22-41 | | 94-113 |
| Daclizumab_LightChain | 189 | 22-41 | 47-56 | 85-104 |
| Dalotuzumab_HeavyChain1 | 190 | 22-41 | | |
| Dalotuzumab_LightChain1 | 191 | 22-41 | | |
| Dapirolizumab_pegol_HeavyChain1 | 192 | 22-41 | | 93-112 |
| Dapirolizumab_pegol_LightChain1 | 193 | 22-41 | 48-57 | 86-105 |
| Daratumumab_HeavyChain1 | 194 | 22-41 | | |
| Daratumumab_LightChain1 | 195 | 22-41 | 48-57 | 86-105 |
| Dectrekumab_HeavyChain1 | 196 | 22-41 | | 94-113 |
| Dectrekumab_LightChain1 | 197 | 22-41 | 48-57 | 86-105 |
| Demcizumab_HeavyChain1 | 198 | 22-41 | | 94-113 |
| Demcizumab_LightChain1 | 199 | 22-41 | 52-61 | 90-109 |
| Denintuzumab_mafodotin_HeavyChain1 | 200 | 22-41 | | 95-114 |
| Denintuzumab_mafodotin_LightChain1 | 201 | 22-41 | 47-56 | 85-104 |
| Denosumab_HeavyChain | 202 | 22-41 | | 94-113 |
| Denosumab_LightChain | 203 | 22-41 | 49-58 | |
| Depatuxizumab_HeavyChain1 | 204 | 22-41 | | 94-113 |
| Depatuxizumab_LightChain1 | 205 | 22-41 | 48-57 | 86-105 |
| Depatuxizumab_mafodotin_HeavyChain1 | 206 | 22-41 | | 94-113 |
| Depatuxizumab_mafodotin_LightChain1 | 207 | 22-41 | 48-57 | 86-105 |
| Dinutuximab_beta_HeavyChain1 | 208 | 22-41 | | 94-113 |
| Dinutuximab_beta_LightChain1 | 209 | 22-41 | | |
| Dinutuximab_HeavyChain1 | 210 | 22-41 | | 94-113 |
| Dinutuximab_LightChain1 | 211 | 22-41 | | |
| Dinutuximab_LightChain | 212 | 22-41 | | |
| Diridavumab_HeavyChain1 | 213 | 22-41 | | 94-113 |
| Diridavumab_LightChain1 | 214 | 22-41 | 49-58 | 87-106 |
| Domagrozumab_HeavyChain1 | 215 | 22-41 | | 94-113 |
| Domagrozumab_HeavyChain | 216 | 22-41 | | 94-113 |
| Domagrozumab_LightChain1 | 217 | 22-41 | 48-57 | 86-105 |
| Drozituab_HeavyChain1 | 218 | 22-41 | | 92-111 |
| Drozituab_LightChain1 | 219 | 22-41 | 46-55 | 84-103 |
| Drozitumab_HeavyChain1 | 220 | 22-41 | | 94-113 |
| Drozitumab_LightChain1 | 221 | 22-41 | 46-55 | 84-103 |
| Duligotumab_HeavyChain1 | 222 | 22-41 | | 94-113 |
| Duligotumab_LightChain1 | 223 | 22-41 | 48-57 | 86-105 |
| Duligotuzumab_HeavyChain1 | 224 | 22-41 | | 94-113 |
| Duligotuzumab_LightChain1 | 225 | 22-41 | 48-57 | 86-105 |
| Dupilumab_HeavyChain1 | 226 | 22-41 | | 94-113 |
| Dupilumab_LightChain1 | 227 | 22-41 | 53-62 | 91-110 |
| Durvalumab_HeavyChain1 | 228 | 22-41 | | 94-113 |
| Durvalumab_LightChain1 | 229 | 22-41 | 49-58 | 87-106 |
| Dusigitumab_HeavyChain1 | 230 | 22-41 | | 94-113 |
| Dusigitumab_LightChain1 | 231 | 22-41 | 49-58 | 87-106 |
| Ecromeximab_HeavyChain1 | 232 | 22-41 | | |
| Ecromeximab_LightChain1 | 233 | 22-41 | | |
| Eculizumab_HeavyChain1 | 234 | 22-41 | | 93-112 |
| Eculizumab_LightChain1 | 235 | 22-41 | 29-38 | 86-105 |
| Efalizumab_HeavyChain | 236 | 22-41 | 103-112 | 96-115 |
| Efalizumab_LightChain | 237 | 22-41 | 48-57 | 86-105 |
| Efungumab_SingleChain_variable_fragment | 238 | 22-41 | 185-194 | 96-115 |
| Eldelumab_HeavyChain1 | 239 | 22-41 | 93-102 | 94-113 |
| Eldelumab_LightChain1 | 240 | 22-41 | 49-58 | 87-106 |
| Elgemtumab_HeavyChain1 | 241 | 22-41 | | 94-113 |
| Elgemtumab_LightChain1 | 242 | 22-41 | 48-57 | 86-105 |
| Elotuzumab_HeavyChain1 | 243 | 22-41 | | 94-113 |
| Elotuzumab_LightChain1 | 244 | 22-41 | 48-57 | 86-105 |
| Emactuzumab_HeavyChain1 | 245 | 22-41 | | 93-112 |
| Emactuzumab_LightChain1 | 246 | 22-41 | 48-57 | 86-105 |
| Emibetuzumab_HeavyChain1 | 247 | 22-41 | | 94-113 |
| Emibetuzumab_LightChain1 | 248 | 22-41 | 32-41 | 87-106 |
| Emicizumab_HeavyChain1 | 249 | 22-41 | | 94-113 |
| Emicizumab_HeavyChain2 | 250 | 22-41 | 59-68 | |
| Emicizumab_LightChain1 | 251 | 22-41 | 48-57 | 86-105 |
| Enavatuzumab_HeavyChain1 | 252 | 22-41 | | 96-115 |

TABLE 5-continued

CDRs of exemplified antibodies

| Name | Protein SEQ ID NO | CDR1 | CDR2 | CDR3 |
|---|---|---|---|---|
| Enavatuzumab_LightChain1 | 253 | 22-41 | | 90-109 |
| Enfortumab_HeavyChain | 254 | 22-41 | 58-67 | 94-113 |
| Enfortumab_LightChain | 255 | 22-41 | 48-57 | 86-105 |
| Enfortumab_vedotin_HeavyChain1 | 256 | 22-41 | 58-67 | 94-113 |
| Enfortumab_vedotin_LightChain1 | 257 | 22-41 | 48-57 | 86-105 |
| Enoblituzumab_HeavyChain | 258 | 22-41 | 58-67 | 94-113 |
| Enoblituzumab_LightChain | 259 | 22-41 | 48-57 | 86-105 |
| Enokizumab_HeavyChain1 | 260 | 22-41 | | 94-113 |
| Enokizumab_LightChain1 | 261 | 22-41 | 48-57 | 86-105 |
| Enokizumab_LightChain | 262 | 22-41 | 48-57 | 86-105 |
| Enoticumab_HeavyChain1 | 263 | 22-41 | | 94-113 |
| Enoticumab_LightChain1 | 264 | 22-41 | 48-57 | 86-105 |
| Ensituximab_HeavyChain1 | 265 | 22-41 | | 93-112 |
| Ensituximab_LightChain1 | 266 | 22-41 | 47-56 | 85-104 |
| Ensituximab_SingleChain_variable_fragment | 267 | 22-41 | 185-194 | 96-115 |
| Entolimod_chain1 | 268 | 22-41 | | |
| Epratuzumab_HeavyChain | 269 | 22-41 | | |
| Epratuzumab_LightChain | 270 | 22-41 | 54-63 | 92-111 |
| Eptacog_beta_HeavyChain1 | 271 | 22-41 | | |
| Eptacog_beta_LightChain1 | 272 | 22-41 | | |
| Erlizuab_HeavyChain1 | 273 | 22-41 | | 89-108 |
| Erlizuab_LightChain1 | 274 | 22-41 | 47-56 | 85-104 |
| Etaracizumab_HeavyChain1 | 275 | 22-41 | | 94-113 |
| Etaracizumab_LightChain1 | 276 | 22-41 | | 86-105 |
| Etrolizuab_HeavyChain1 | 277 | 22-41 | | 92-111 |
| Etrolizuab_HeavyChain2 | 278 | 22-41 | | 92-111 |
| Etrolizuab_LightChain1 | 279 | 22-41 | | 85-104 |
| Etrolizumab_HeavyChain1 | 280 | 22-41 | | 93-112 |
| Etrolizumab_LightChain1 | 281 | 22-41 | | 86-105 |
| Evinacumab_HeavyChain1 | 282 | 22-41 | | |
| Evinacumab_LightChain1 | 283 | 22-41 | 48-57 | 86-105 |
| Evolocumab_HeavyChain1 | 284 | 22-41 | | 94-113 |
| Evolocumab_LightChain1 | 285 | 22-41 | 50-59 | 88-107 |
| Exbivirumab_HeavyChain1 | 286 | 22-41 | | |
| Exbivirumab_LightChain1 | 287 | 22-41 | | 85-104 |
| Farletuzumab_HeavyChain1 | 288 | 22-41 | | |
| Farletuzumab_LightChain1 | 289 | 22-41 | 49-58 | 87-106 |
| Fasinumab_HeavyChain1 | 290 | 22-41 | 59-68 | 94-113 |
| Fasinumab_LightChain1 | 291 | 22-41 | 48-57 | 86-105 |
| Fezakinumab_HeavyChain1 | 292 | 22-41 | | 94-113 |
| Fezakinumab_LightChain1 | 293 | 22-41 | 50-59 | 88-107 |
| FG-3019_HeavyChain1 | 294 | 22-41 | | 93-112 |
| FG-3019_LightChain1 | 295 | 22-41 | 48-57 | 86-105 |
| Fibatuzumab_HeavyChain1 | 296 | 22-41 | 51-60 | 94-113 |
| Fibatuzumab_LightChain1 | 297 | 22-41 | 48-57 | 86-105 |
| Ficlatuzumab_HeavyChain1 | 298 | 22-41 | | 94-113 |
| Ficlatuzumab_HeavyChain | 299 | 22-41 | | 93-112 |
| Ficlatuzumab_LightChain1 | 300 | 22-41 | 48-57 | |
| Figitumumab_HeavyChain1 | 301 | 22-41 | | 94-113 |
| Figitumumab_LightChain1 | 302 | 22-41 | 48-57 | 86-105 |
| Firivumab_HeavyChain1 | 303 | 22-41 | | 94-113 |
| Firivumab_LightChain1 | 304 | 22-41 | 85-94 | |
| Flanvotumab_HeavyChain1 | 305 | 22-41 | 93-102 | 94-113 |
| Flanvotumab_LightChain1 | 306 | 22-41 | 48-57 | 86-105 |
| Fletikumab_HeavyChain1 | 307 | 22-41 | | 94-113 |
| Fletikumab_LightChain1 | 308 | 22-41 | 48-57 | 86-105 |
| Fontolizumab_HeavyChain1 | 309 | 22-41 | | 94-113 |
| Fontolizumab_LightChain1 | 310 | 22-41 | 48-57 | 86-105 |
| Foralumab_HeavyChain1 | 311 | 22-41 | | 94-113 |
| Foralumab_LightChain1 | 312 | 22-41 | 48-57 | 86-105 |
| Foravirumab_HeavyChain1 | 313 | 22-41 | | 94-113 |
| Foravirumab_HeavyChain | 314 | 22-41 | | 94-113 |
| Foravirumab_LightChain1 | 315 | 22-41 | 48-57 | 86-105 |
| Fresolimumab_HeavyChain1 | 316 | 22-41 | | 94-113 |
| Fresolimumab_LightChain1 | 317 | 22-41 | 49-58 | 87-106 |
| Fulranumab_HeavyChain1 | 318 | 22-41 | | 94-113 |
| Fulranumab_LightChain1 | 319 | 22-41 | 48-57 | 86-105 |
| Futuximab_HeavyChain1 | 320 | 22-41 | 51-60 | 94-113 |
| Futuximab_LightChain1 | 321 | 22-41 | 48-57 | |
| Galcanezumab_HeavyChain1 | 322 | 22-41 | 51-60 | 94-113 |
| Galcanezumab_LightChain1 | 323 | 22-41 | 48-57 | 86-105 |
| Galiximab_HeavyChain1 | 324 | 22-41 | | 95-114 |
| Galiximab_LightChain1 | 325 | 22-41 | 49-58 | 87-106 |
| Ganitumab_HeavyChain1 | 326 | 22-41 | 52-61 | 94-113 |
| Ganitumab_LightChain1 | 327 | 22-41 | 53-62 | 91-110 |
| Gantenerumab_HeavyChain1 | 328 | 22-41 | | 94-113 |

TABLE 5-continued

CDRs of exemplified antibodies

| Name | Protein SEQ ID NO | CDR1 | CDR2 | CDR3 |
| --- | --- | --- | --- | --- |
| Gantenerumab_LightChain1 | 329 | 22-41 | 49-58 | 87-106 |
| Gemtuzumab_HeavyChain1 | 330 | 22-41 | | 94-113 |
| Gemtuzumab_HeavyChain2 | 331 | 22-41 | 102-111 | |
| Gemtuzumab_LightChain2 | 332 | 22-41 | | 86-105 |
| Gemtuzumab_ozogamicin_LightChain1 | 333 | 22-41 | 47-56 | 85-104 |
| Gevokizumab_HeavyChain1 | 334 | 22-41 | | |
| Gevokizumab_LightChain1 | 335 | 22-41 | 48-57 | |
| Girentuximab_HeavyChain1 | 336 | 22-41 | | |
| Girentuximab_LightChain1 | 337 | 22-41 | 48-57 | |
| Glembatumumab_HeavyChain1 | 338 | 22-41 | 53-62 | 95-114 |
| Glembatumumab_LightChain1 | 339 | 22-41 | 48-57 | 86-105 |
| Goilixiab_HeavyChain1 | 340 | 22-41 | | 94-113 |
| Goilixiab_LightChain1 | 341 | 22-41 | 47-56 | 85-104 |
| Guselkumab_HeavyChain1 | 342 | 22-41 | | 94-113 |
| Guselkumab_LightChain1 | 343 | 22-41 | 50-59 | 88-107 |
| HuMab-001_HeavyChain_VDJ-Region | 344 | 22-41 | | 93-112 |
| HuMab-001_LightChain_VJ-Region | 345 | 22-41 | | 86-105 |
| HuMab-005_HeavyChain_gamma-Chain_VDJ-Region | 346 | 22-41 | 51-60 | 94-113 |
| HuMab-005_LightChain_VJ-Region | 347 | 22-41 | 49-58 | 87-106 |
| HuMab-006_HeavyChain_VDJ-Region | 348 | 22-41 | | 94-113 |
| HuMab-006_LightChain_VJ-Region | 349 | 22-41 | 48-57 | 86-105 |
| HuMab-019_HeavyChain_VDJ-Region | 350 | 22-41 | | 93-112 |
| HuMab-021_HeavyChain_VDJ-Region | 351 | 22-41 | | 93-112 |
| HuMab-021_LightChain_VJ-Region | 352 | 22-41 | 48-57 | 86-105 |
| HuMab-025_HeavyChain_VDJ-Region | 353 | 22-41 | | 93-112 |
| HuMab-025_LightChain_VJ-Region | 354 | 22-41 | 48-57 | 86-105 |
| HuMab-027_HeavyChain_VDJ-Region | 355 | 22-41 | | 93-112 |
| HuMab-032_HeavyChain_VDJ-Region | 356 | 22-41 | 104-113 | 93-112 |
| HuMab-032_LightChain_VJ-Region | 357 | 22-41 | 48-57 | 86-105 |
| HuMab-033_HeavyChain_VDJ-Region | 358 | 22-41 | | 94-113 |
| HuMab-035_HeavyChain_VDJ-Region | 359 | 22-41 | 24-33 | 93-112 |
| HuMab-036_HeavyChain_VDJ-Region | 360 | 22-41 | | 93-112 |
| HuMab-036_LightChain_VJ-Region | 361 | 22-41 | 48-57 | 86-105 |
| HuMab-041_HeavyChain_VDJ-Region | 362 | 22-41 | 51-60 | 94-113 |
| HuMab-044_HeavyChain_VDJ-Region | 363 | 22-41 | | 94-113 |
| HuMab-049_HeavyChain_VDJ-Region | 364 | 22-41 | | 94-113 |
| HuMab-049_LightChain_VJ-Region | 365 | 22-41 | 48-57 | 86-105 |
| HuMab-050_HeavyChain_VDJ-Region | 366 | 22-41 | | 94-113 |
| HuMab-050_LightChain_VJ-Region | 367 | 22-41 | 48-57 | 86-105 |
| HuMab-054_HeavyChain_VDJ-Region | 368 | 22-41 | | 93-112 |
| HuMab-054_LightChain_VJ-Region | 369 | 22-41 | 48-57 | 86-105 |
| HuMab-055_HeavyChain_VDJ-Region | 370 | 22-41 | | 94-113 |
| HuMab-059_HeavyChain_VDJ-Region | 371 | 22-41 | | 94-113 |
| HuMab-059_LightChain_VJ-Region | 372 | 22-41 | 49-58 | 87-106 |
| HuMab-060_HeavyChain_VDJ-Region | 373 | 22-41 | 51-60 | 94-113 |
| HuMab-060_LightChain_VJ-Region | 374 | 22-41 | 49-58 | 87-106 |
| HuMab-067_HeavyChain_VDJ-Region | 375 | 22-41 | 51-60 | 94-113 |
| HuMab-072_HeavyChain_VDJ-Region | 376 | 22-41 | 51-60 | 94-113 |
| HuMab-072_LightChain_VJ-Region | 377 | 22-41 | 49-58 | 87-106 |
| HuMab-084_HeavyChain_VDJ-Region | 378 | 22-41 | | 94-113 |
| HuMab-084_LightChain_VJ-Region | 379 | 22-41 | 48-57 | 86-105 |
| HuMab-091_HeavyChain_VDJ-Region | 380 | 22-41 | 51-60 | 93-112 |
| HuMab-091_LightChain_VJ-Region | 381 | 22-41 | 48-57 | 86-105 |
| HuMab-093_HeavyChain_VDJ-Region | 382 | 22-41 | 51-60 | 94-113 |
| HuMab-098_HeavyChain_VDJ-Region | 383 | 22-41 | | 94-113 |
| HuMab-098_LightChain_VJ-Region | 384 | 22-41 | 48-57 | 86-105 |
| HuMab-100_HeavyChain_VDJ-Region | 385 | 22-41 | | 94-113 |
| HuMab-106_HeavyChain_VDJ-Region | 386 | 22-41 | 51-60 | 94-113 |
| HuMab-106_LightChain_VJ-Region | 387 | 22-41 | 49-58 | 87-106 |
| HuMab_10F8_HeavyChain_V-Region | 388 | 22-41 | | 94-113 |
| HuMab_10F8_HeavyChain_V-Region_Precursor | 389 | 22-41 | | 113-132 |
| HuMab_10F8_LightChain_V-Region | 390 | 22-41 | 49-58 | 87-106 |
| HuMab_10F8_LightChain_V-Region_Precursor | 391 | 22-41 | 69-78 | 107-126 |
| HuMab-111_HeavyChain_VDJ-Region | 392 | 22-41 | | 94-113 |
| HuMab-111_LightChain_VJ-Region | 393 | 22-41 | 49-58 | 87-106 |
| HuMab-123_HeavyChain_VDJ-Region | 394 | 22-41 | 59-68 | 94-113 |
| HuMab-123_LightChain_VJ-Region | 395 | 22-41 | 48-57 | 86-105 |
| HuMab-124_HeavyChain_VDJ-Region | 396 | 22-41 | 59-68 | 94-113 |
| HuMab-125_HeavyChain_VDJ-Region | 397 | 22-41 | | 94-113 |
| HuMab-125_LightChain_VJ-Region | 398 | 22-41 | 48-57 | 86-105 |
| HuMab-127_HeavyChain_VDJ-Region | 399 | 22-41 | 31-40 | 94-113 |
| HuMab-127_LightChain_VJ-Region | 400 | 22-41 | 48-57 | 86-105 |
| HuMab-129_HeavyChain_VDJ-Region | 401 | 22-41 | | 94-113 |
| HuMab-129_LightChain_VJ-Region | 402 | 22-41 | 48-57 | 86-105 |
| HuMab-132_HeavyChain_VDJ-Region | 403 | 22-41 | | 94-113 |
| HuMab-132_LightChain_VJ-Region | 404 | 22-41 | 48-57 | 86-105 |

TABLE 5-continued

CDRs of exemplified antibodies

| Name | Protein SEQ ID NO | CDR1 | CDR2 | CDR3 |
|---|---|---|---|---|
| HuMab-143_HeavyChain_VDJ-Region | 405 | 22-41 | | 93-112 |
| HuMab-143_LightChain_VJ-Region | 406 | 22-41 | 48-57 | 86-105 |
| HuMab-150_HeavyChain_VDJ-Region | 407 | 22-41 | 51-60 | 94-113 |
| HuMab-150_LightChain_VJ-Region | 408 | 22-41 | 49-58 | 87-106 |
| HuMab-152_HeavyChain_VDJ-Region | 409 | 22-41 | | 94-113 |
| HuMab-152_LightChain_VJ-Region | 410 | 22-41 | 48-57 | 86-105 |
| HuMab-153_HeavyChain_VDJ-Region | 411 | 22-41 | | 94-113 |
| HuMab-153_LightChain_VJ-Region | 412 | 22-41 | 48-57 | 86-105 |
| HuMab-159_HeavyChain_VDJ-Region | 413 | 22-41 | 51-60 | 94-113 |
| HuMab-159_LightChain_VJ-Region | 414 | 22-41 | 48-57 | 86-105 |
| HuMab-160_HeavyChain_VDJ-Region | 415 | 22-41 | | |
| HuMab-160_LightChain_VJ-Region | 416 | 22-41 | 48-57 | 86-105 |
| HuMab-162_HeavyChain_VDJ-Region | 417 | 22-41 | | 94-113 |
| HuMab-162_LightChain_VJ-Region | 418 | 22-41 | 48-57 | 86-105 |
| HuMab-163_HeavyChain_VDJ-Region | 419 | 22-41 | 51-60 | 94-113 |
| HuMab-163_LightChain_VJ-Region | 420 | 22-41 | 49-58 | 87-106 |
| HuMab-166_HeavyChain_VDJ-Region | 421 | 22-41 | | 94-113 |
| HuMab-166_LightChain_VJ-Region | 422 | 22-41 | 48-57 | 86-105 |
| HuMab-167_HeavyChain_VDJ-Region | 423 | 22-41 | | 94-113 |
| HuMab-169_HeavyChain_VDJ-Region | 424 | 22-41 | 59-68 | 94-113 |
| HuMab-169_LightChain_VJ-Region | 425 | 22-41 | 48-57 | 86-105 |
| HuMab-708_HeavyChain_VH-Region | 426 | 22-41 | | 94-113 |
| HuMab-708_HeavyChain_V-Region | 427 | 22-41 | | 94-113 |
| HuMab-708_LightChain_VL-Region | 428 | 22-41 | 48-57 | 86-105 |
| HuMab-708_LightChain_V-Region | 429 | 22-41 | 48-57 | 86-105 |
| huMab-anti-MSP10.1_LightChain_VJ-Region | 430 | 22-41 | 49-58 | 87-106 |
| huMab-anti-MSP10.2_LightChain_VJ-Region | 431 | 22-41 | 49-58 | 87-106 |
| HUMAB-Clone_18_VJ-Region | 432 | 22-41 | 48-57 | 86-105 |
| HUMAB-Clone_22_VJ-Region | 433 | 22-41 | 48-57 | 86-105 |
| HuMab-L612_μChain_VDJ-Region_Precursor | 434 | 22-41 | | 113-132 |
| HuMab_LC5002-002_LightChain_V-Region | 435 | 22-41 | 48-57 | 86-105 |
| HuMab_LC5002-002_gamma1-Chain_V-Region | 436 | 22-41 | 31-40 | 94-113 |
| HuMab_LC5002-003_LightChain_V-Region | 437 | 22-41 | 48-57 | 86-105 |
| HuMab_LC5002-003_gamma1-Chain_V-Region | 438 | 22-41 | 31-40 | 94-113 |
| HuMab_LC5002-005_LightChain_V-Region | 439 | 22-41 | 48-57 | 86-105 |
| HuMab_LC5002-005_gamma1-Chain_V-Region | 440 | 22-41 | 103-112 | 94-113 |
| HuMab_LC5002-007_LightChain_V-Region | 441 | 22-41 | 49-58 | 87-106 |
| HuMab_LC5002-007_gamma1-Chain_V-Region | 442 | 22-41 | | 94-113 |
| HuMab_LC5002-018_gamma1-Chain_V-Region | 443 | 22-41 | 31-40 | 94-113 |
| Ibalizumab_HeavyChain1 | 444 | 22-41 | | 94-113 |
| Ibalizumab_LightChain1 | 445 | 22-41 | 54-63 | 92-111 |
| Ibritumomab_tiuxetan_HeavyChain | 446 | 22-41 | 51-60 | |
| Ibritumomab_tiuxetan_LightChain | 447 | 22-41 | 47-56 | 85-104 |
| Icrucumab_HeavyChain1 | 448 | 22-41 | | 94-113 |
| Icrucumab_LightChain1 | 449 | 22-41 | 49-58 | 87-106 |
| Idarucizumab_HeavyChain1 | 450 | 22-41 | | 93-112 |
| Idarucizumab_LightChain1 | 451 | 22-41 | 53-62 | 91-110 |
| Igatuzuab_HeavyChain1 | 452 | 22-41 | | 92-111 |
| Igatuzuab_LightChain1 | 453 | 22-41 | 47-56 | 85-104 |
| IGF-IR_HUMAB-1A_HeavyChain | 454 | 22-41 | | 93-112 |
| IGF-IR_HUMAB-23_HeavyChain | 455 | 22-41 | | |
| IGF-IR_HUMAB-23_LightChain | 456 | 22-41 | 48-57 | 86-105 |
| IGF-IR_HUMAB-8_HeavyChain | 457 | 22-41 | | 93-112 |
| IGF-IR_HUMAB-8_LightChain | 458 | 22-41 | 48-57 | 86-105 |
| ImAb1_LightChain | 459 | 22-41 | 70-79 | 108-127 |
| ImAb1_gamma1-Chain | 460 | 22-41 | | 112-131 |
| Imalumab_HeavyChain1 | 461 | 22-41 | 31-40 | 94-113 |
| Imalumab_LightChain1 | 462 | 22-41 | | 86-105 |
| Imgatuzumab_HeavyChain1 | 463 | 22-41 | | 94-113 |
| Imgatuzumab_LightChain1 | 464 | 22-41 | 48-57 | 86-105 |
| Inclacumab_HeavyChain1 | 465 | 22-41 | 57-66 | 93-112 |
| Inclacumab_LightChain1 | 466 | 22-41 | 48-57 | 86-105 |
| Indatuximab_ravtansine_HeavyChain1 | 467 | 22-41 | 59-68 | 94-113 |
| Indatuximab_ravtansine_LightChain1 | 468 | 22-41 | 48-57 | 86-105 |
| Indusatumab_vedotin_HeavyChain1 | 469 | 22-41 | | 93-112 |
| Indusatumab_vedotin_LightChain1 | 470 | 22-41 | 48-57 | 86-105 |
| Inebilizumab_HeavyChain1 | 471 | 22-41 | 51-60 | 94-113 |
| Inebilizumab_LightChain1 | 472 | 22-41 | | 90-109 |
| Insulin_peglispro_Fragment1 | 473 | 22-30 | | |
| Insulin_peglispro_Fragment2 | 474 | 22-21 | | |
| Interferon_beta-Ib_chain1 | 475 | 22-41 | 58-67 | |
| Intetumumab_HeavyChain1 | 476 | 22-41 | | 94-113 |
| Intetumumab_LightChain1 | 477 | 22-41 | 48-57 | 86-105 |
| Iodine_(I241)_Girentuximab_HeavyChain1 | 478 | 22-41 | | |
| Iodine_(I241)_Girentuximab_LightChain1 | 479 | 22-41 | 48-57 | |
| Iodine_(I311)_Derlotuxiab_biotin_HeavyChain1 | 480 | 22-41 | | 91-110 |

TABLE 5-continued

CDRs of exemplified antibodies

| Name | Protein SEQ ID NO | CDR1 | CDR2 | CDR3 |
|---|---|---|---|---|
| Iodine_(I311)_Derlotuxiab_biotin_LightChain1 | 481 | 22-41 | 47-56 | 85-104 |
| Iodine_(I311)_Derlotuximab_biotin_HeavyChain1 | 482 | 22-41 | | 93-112 |
| Iodine_(I311)_Derlotuximab_biotin_LightChain1 | 483 | 22-41 | 49-58 | 87-106 |
| Ipilimumab_HeavyChain | 484 | 22-41 | 93-102 | 94-113 |
| Ipilimumab_LightChain | 485 | 22-41 | 49-58 | 87-106 |
| Iratumumab_HeavyChain1 | 486 | 22-41 | | |
| Iratumumab_LightChain1 | 487 | 22-41 | 48-57 | 86-105 |
| Isatuximab_HeavyChain1 | 488 | 22-41 | 51-60 | 94-113 |
| Isatuximab_LightChain1 | 489 | 22-41 | 48-57 | 86-105 |
| Itolizumab_HeavyChain1 | 490 | 22-41 | 58-67 | 94-113 |
| Itolizumab_LightChain1 | 491 | 22-41 | 48-57 | 86-105 |
| Ixekizumab_HeavyChain1 | 492 | 22-41 | | 94-113 |
| Ixekizumab_LightChain1 | 493 | 22-41 | 53-62 | 91-110 |
| Labetuzumab_govitecan_HeavyChain1 | 494 | 22-41 | | |
| Labetuzumab_govitecan_LightChain1 | 495 | 22-41 | 48-57 | 86-105 |
| Lambrolizumab_HeavyChain1 | 496 | 22-41 | | 94-113 |
| Lambrolizumab_LightChain1 | 497 | 22-41 | 52-61 | 90-109 |
| Lampalizumab_HeavyChain1 | 498 | 22-41 | | 94-113 |
| Lampalizumab_LightChain1 | 499 | 22-41 | | 86-105 |
| Lanadelumab_HeavyChain1 | 500 | 22-41 | 51-60 | 94-113 |
| Lanadelumab_LightChain1 | 501 | 22-41 | 48-57 | 86-105 |
| Landogrozumab_HeavyChain1 | 502 | 22-41 | | 94-113 |
| Landogrozumab_LightChain1 | 503 | 22-41 | 49-58 | 87-106 |
| Laprituximab_emtansine_HeavyChain1 | 504 | 22-41 | 51-60 | 94-113 |
| Laprituximab_emtansine_LightChain1 | 505 | 22-41 | | 86-105 |
| Lealesoab_HeavyChain1 | 506 | 22-41 | | |
| Lealesoab_LightChain1 | 507 | 22-41 | 53-62 | 91-110 |
| Lebrikizumab_HeavyChain1 | 508 | 22-41 | | 93-112 |
| Lebrikizumab_LightChain1 | 509 | 22-41 | 52-61 | 90-109 |
| Lenercept_chain1 | 510 | 22-41 | | |
| Lenzilumab_HeavyChain1 | 511 | 22-41 | | 94-113 |
| Lenzilumab_LightChain1 | 512 | 22-41 | 48-57 | 86-105 |
| Lerdelimumab_HeavyChain1 | 513 | 22-41 | | 94-113 |
| Lerdelimumab_LightChain1 | 514 | 22-41 | 47-56 | 85-104 |
| Lexatumumab_HeavyChain1 | 515 | 22-41 | | 94-113 |
| Lexatumumab_HeavyChain | 516 | 22-41 | | 94-113 |
| Lexatumumab_LightChain1 | 517 | 22-41 | 47-56 | 85-104 |
| Lexatumumab_LightChain | 518 | 22-41 | 47-56 | 85-104 |
| Libivirumab_HeavyChain1 | 519 | 22-41 | | 94-113 |
| Libivirumab_LightChain1 | 520 | 22-41 | 53-62 | 91-110 |
| Lifastuzumab_HeavyChain | 521 | 22-41 | | 94-113 |
| Lifastuzumab_LightChain | 522 | 22-41 | 53-62 | 91-110 |
| Lifastuzumab_vedotin_HeavyChain1 | 523 | 22-41 | | 93-112 |
| Lifastuzumab_vedotin_LightChain1 | 524 | 22-41 | 53-62 | 91-110 |
| Ligelizumab_HeavyChain1 | 525 | 22-41 | | 94-113 |
| Ligelizumab_LightChain1 | 526 | 22-41 | 48-57 | 86-105 |
| Lilotomab_HeavyChain1 | 527 | 22-41 | | 94-113 |
| Lilotomab_LightChain1 | 528 | 22-41 | | 86-105 |
| Lintuzumab_HeavyChain1 | 529 | 22-41 | 51-60 | 94-113 |
| Lintuzumab_LightChain1 | 530 | 22-41 | 52-61 | 90-109 |
| Lirilumab_HeavyChain1 | 531 | 22-41 | | 94-113 |
| Lirilumab_LightChain1 | 532 | 22-41 | 48-57 | 86-105 |
| Lodelcizumab_HeavyChain1 | 533 | 22-41 | | 94-113 |
| Lodelcizumab_LightChain1 | 534 | 22-41 | 47-56 | 85-104 |
| Lokivetmab_HeavyChain1 | 535 | 22-41 | | 94-113 |
| Lokivetmab_LightChain1 | 536 | 22-41 | 52-61 | 90-109 |
| Lorvotuzumab_mertansine_HeavyChain1 | 537 | 22-41 | 58-67 | 94-113 |
| Lorvotuzumab_mertansine_LightChain1 | 538 | 22-41 | 53-62 | 91-110 |
| Lpathomab_VL | 539 | 22-41 | 53-62 | |
| Lpathomab_gamma1-Chain_VDJ-Region | 540 | 22-41 | | |
| Lucatumumab_HeavyChain1 | 541 | 22-41 | | 94-113 |
| Lucatumumab_LightChain1 | 542 | 22-41 | | 91-110 |
| Lulizumab_pegol_LightChain1 | 543 | 22-41 | 48-57 | 86-105 |
| Lulizumab_pegol_LightChain | 544 | 22-41 | 48-57 | 86-105 |
| Lumiliximab_HeavyChain1 | 545 | 22-41 | | |
| Lumiliximab_LightChain1 | 546 | 22-41 | 48-57 | 86-105 |
| Lumretuzumab_HeavyChain1 | 547 | 22-41 | 51-60 | 94-113 |
| Lumretuzumab_LightChain1 | 548 | 22-41 | 54-63 | 92-111 |
| Lutetium_(l77Lu)_lilotomab_satetraxetan_HeavyChain1 | 549 | 22-41 | | 94-113 |
| Lutetium_(l77Lu)_lilotomab_satetraxetan_LightChain1 | 550 | 22-41 | | 86-105 |
| Margetuximab_HeavyChain1 | 551 | 22-41 | 51-60 | 94-113 |
| Margetuximab_LightChain1 | 552 | 22-41 | 48-57 | 86-105 |
| Marzeptacog_alfa_HeavyChain1 | 553 | 22-41 | | |
| Marzeptacog_alfa_LightChain1 | 554 | 22-41 | | |
| Matuzumab_HeavyChain1_variant_3c08_H | 555 | 22-41 | | 94-113 |
| Matuzumab_HeavyChain1_variant_3c09_C | 556 | 22-41 | | 94-113 |

TABLE 5-continued

CDRs of exemplified antibodies

| Name | Protein SEQ ID NO | CDR1 | CDR2 | CDR3 |
|---|---|---|---|---|
| Matuzumab_LightChain1_variant_3c08_L | 557 | 22-41 | 47-56 | 85-104 |
| Matuzumab_LightChain1_variant_3c09_B | 558 | 22-41 | 47-56 | 85-104 |
| Mavrilimumab_HeavyChain1 | 559 | 22-41 | | 94-113 |
| Mavrilimumab_LightChain1 | 560 | 22-41 | 50-59 | 88-107 |
| MDX-1303_HeavyChain1 | 561 | 22-41 | | 94-113 |
| MDX-1303_LightChain1 | 562 | 22-41 | 49-58 | 87-106 |
| Mepolizumab_HeavyChain1 | 563 | 22-41 | | 93-112 |
| Mepolizumab_LightChain1 | 564 | 22-41 | 54-63 | 92-111 |
| Metelimumab_HeavyChain1 | 565 | 22-41 | | 94-113 |
| Metelimumab_LightChain1 | 566 | 22-41 | 48-57 | 86-105 |
| Milatuzumab_HeavyChain1 | 567 | 22-41 | | |
| Milatuzumab_LightChain1 | 568 | 22-41 | 53-62 | |
| Mirvetuximab_HeavyChain1 | 569 | 22-41 | | 94-113 |
| Mirvetuximab_LightChain1 | 570 | 22-41 | 52-61 | 90-109 |
| Modotuximab_HeavyChain1 | 571 | 22-41 | | 94-113 |
| Modotuximab_LightChain1 | 572 | 22-41 | 53-62 | 91-110 |
| Mogamulizumab_HeavyChain1 | 573 | 22-41 | | 94-113 |
| Mogamulizumab_LightChain1 | 574 | 22-41 | 53-62 | 91-110 |
| Monalizumab_HeavyChain1 | 575 | 22-41 | | 94-113 |
| Monalizumab_LightChain1 | 576 | 22-41 | 29-38 | 86-105 |
| Motavizumab_HeavyChain | 577 | 22-41 | | 95-114 |
| Motavizumab_HeavyChain_variant | 578 | 22-41 | | 95-114 |
| Motavizumab_LightChain | 579 | 22-41 | 47-56 | 85-104 |
| Motavizumab_LightChain_variant | 580 | 22-41 | 47-56 | 85-104 |
| Moxetumomab_pasudotox_HeavyChain1 | 581 | 22-41 | 32-41 | 95-114 |
| Moxetumomab_pasudotox_LightChain1 | 582 | 22-41 | 49-58 | |
| Muromonab-CD3_HeavyChain | 583 | 22-41 | | 94-113 |
| Muromonab-CD3_LightChain | 584 | 22-41 | 47-56 | 85-104 |
| Namilumab_HeavyChain1 | 585 | 22-41 | | 94-113 |
| Namilumab_LightChain1 | 586 | 22-41 | 48-57 | 86-105 |
| Naptumomab_estafenatox_HeavyChain | 587 | 22-41 | 254-263 | 94-113 |
| Naptumomab_estafenatox_LightChain | 588 | 22-41 | | |
| Narnatumab_HeavyChain1 | 589 | 22-41 | | 94-113 |
| Narnatumab_LightChain1 | 590 | 22-41 | 48-57 | 86-105 |
| Natalizumab_HeavyChain1 | 591 | 22-41 | | 94-113 |
| Natalizumab_LightChain1 | 592 | 22-41 | | 86-105 |
| Navicixizumab_HeavyChain1 | 593 | 22-41 | | 94-113 |
| Navicixizumab_HeavyChain2 | 594 | 22-41 | | |
| Navicixizumab_LightChain1 | 595 | 22-41 | 52-61 | 90-109 |
| Navivumab_HeavyChain1 | 596 | 22-41 | | |
| Navivumab_LightChain1 | 597 | 22-41 | 49-58 | 87-106 |
| Ndimab-varB_HeavyChain | 598 | 22-41 | 568-577 | 94-113 |
| Ndimab-varB_LightChain | 599 | 22-41 | 48-57 | 86-105 |
| Necitumumab_HeavyChain1 | 600 | 22-41 | 53-62 | 95-114 |
| Necitumumab_LightChain1 | 601 | 22-41 | 48-57 | 86-105 |
| Neliximab_HeavyChain_VH-Region | 602 | 22-41 | | 94-113 |
| Neliximab_HeavyChain_VH-Region_variant1 | 603 | 22-41 | | 94-113 |
| Neliximab_LightChain_VL-Region | 604 | 22-41 | 47-56 | 85-104 |
| Neliximab_LightChain_VL-Region_variant1 | 605 | 22-41 | 47-56 | 85-104 |
| Nemolizumab_HeavyChain1 | 606 | 22-41 | | 94-113 |
| Nemolizumab_LightChain1 | 607 | 22-41 | 29-38 | 86-105 |
| Nesvacumab_HeavyChain1 | 608 | 22-41 | | 93-112 |
| Nesvacumab_LightChain1 | 609 | 22-41 | 49-58 | 87-106 |
| Neuradiab_HeavyChain1 | 610 | 22-41 | 413-422 | |
| Neuradiab_LightChain1 | 611 | 22-41 | 53-62 | 91-110 |
| Nimotuzumab_HeavyChain1 | 612 | 22-41 | 34-43 | |
| Nimotuzumab_LightChain1 | 613 | 22-41 | 53-62 | 91-110 |
| Nivolumab_HeavyChain1 | 614 | 22-41 | | 94-113 |
| Nivolumab_LightChain1 | 615 | 22-41 | 48-57 | 86-105 |
| Obiltoxaximab_HeavyChain1 | 616 | 22-41 | 51-60 | |
| Obiltoxaximab_LightChain1 | 617 | 22-41 | 48-57 | |
| Obinutuzumab_HeavyChain1 | 618 | 22-41 | | 94-113 |
| Obinutuzumab_LightChain1 | 619 | 22-41 | 53-62 | 91-110 |
| Ocaratuzumab_HeavyChain1 | 620 | 22-41 | 51-60 | 94-113 |
| Ocaratuzumab_LightChain1 | 621 | 22-41 | 47-56 | 85-104 |
| Ocrelizumab_HeavyChain1 | 622 | 22-41 | 51-60 | 94-113 |
| Ocrelizumab_LightChain1 | 623 | 22-41 | 47-56 | 85-104 |
| Ofatumumab_HeavyChain1 | 624 | 22-41 | | 94-113 |
| Ofatumumab_LightChain1 | 625 | 22-41 | 48-57 | 86-105 |
| Olaratumab_HeavyChain1 | 626 | 22-41 | | 95-114 |
| Olaratumab_LightChain1 | 627 | 22-41 | 48-57 | 86-105 |
| Olizuab_HeavyChain1 | 628 | 22-41 | | 93-112 |
| Olizuab_LightChain1 | 629 | 22-41 | 51-60 | 89-108 |
| Olokizumab_HeavyChain1 | 630 | 22-41 | | 96-115 |
| Olokizumab_LightChain1 | 631 | 22-41 | 48-57 | 86-105 |
| Omalizumab_HeavyChain | 632 | 22-41 | | 94-113 |

TABLE 5-continued

CDRs of exemplified antibodies

| Name | Protein SEQ ID NO | CDR1 | CDR2 | CDR3 |
|---|---|---|---|---|
| Omalizumab_LightChain | 633 | 22-41 | 52-61 | 90-109 |
| Onartuzumab_HeavyChain1 | 634 | 22-41 | | 94-113 |
| Onartuzumab_HeavyChain2 | 635 | 22-41 | | |
| Onartuzumab_LightChain1 | 636 | 22-41 | 54-63 | 92-111 |
| Ontuxizumab_HeavyChain1 | 637 | 22-41 | | 94-113 |
| Ontuxizumab_LightChain1 | 638 | 22-41 | 48-57 | 86-105 |
| Opicinumab_HeavyChain1 | 639 | 22-41 | | 94-113 |
| Opicinumab_LightChain1 | 640 | 22-41 | 48-57 | 86-105 |
| Oportuzumab_monatox_HeavyChain1 | 641 | 22-41 | 59-68 | 97-116 |
| Oportuzumab_monatox_SingleChain_variable_fragment | 642 | 22-41 | 59-68 | 97-116 |
| Oreptacog_alfa_HeavyChain1 | 643 | 22-41 | | |
| Oreptacog_alfa_LightChain1 | 644 | 22-41 | | |
| Orticumab_HeavyChain1 | 645 | 22-41 | | 94-113 |
| Orticumab_LightChain1 | 646 | 22-41 | 49-58 | 87-106 |
| Otelixizumab_HeavyChain1 | 647 | 22-41 | | 94-113 |
| Otelixizumab_LightChain1 | 648 | 22-41 | 49-58 | |
| Otlertuzumab_HeavyChain1 | 649 | 22-41 | 189-198 | 94-113 |
| Oxelumab_HeavyChain1 | 650 | 22-41 | | 94-113 |
| Oxelumab_LightChain1 | 651 | 22-41 | 48-57 | 86-105 |
| Ozanezumab_HeavyChain1 | 652 | 22-41 | | 94-113 |
| Ozanezumab_LightChain1 | 653 | 22-41 | 53-62 | 91-110 |
| Ozoralizumab_HeavyChain1 | 654 | 22-41 | | 94-113 |
| Palivizumab_HeavyChain | 655 | 22-41 | | 95-114 |
| Palivizumab_LightChain | 656 | 22-41 | 47-56 | 85-104 |
| Palivizumab_VH-Region | 657 | 22-41 | | 95-114 |
| Pamrevlumab_HeavyChain1 | 658 | 22-41 | | 93-112 |
| Pamrevlumab_LightChain1 | 659 | 22-41 | 48-57 | 86-105 |
| Panitumumab_HeavyChain1 | 660 | 22-41 | 53-62 | 95-114 |
| Panitumumab_LightChain1 | 661 | 22-41 | 48-57 | |
| Pankoab_HeavyChain1 | 662 | 22-41 | | 93-112 |
| Pankoab_LightChain1 | 663 | 22-41 | 52-61 | 89-108 |
| Pankoab_LightChain2 | 664 | 22-41 | 52-61 | 89-108 |
| PankoMab_HeavyChain_VDJ-Region | 665 | 22-41 | 95-104 | 96-115 |
| PankoMab_LightChain_VJ-Region | 666 | 22-41 | 53-62 | 91-110 |
| Panobacumab_HeavyChain1 | 667 | 22-41 | | 93-112 |
| Panobacumab_LightChain1 | 668 | 22-41 | 53-62 | 91-110 |
| Panobacumab_LightChain2 | 669 | 22-41 | | |
| Parsatuzumab_HeavyChain1 | 670 | 22-41 | | 94-113 |
| Parsatuzumab_LightChain1 | 671 | 22-41 | 53-62 | 91-110 |
| Pascolizumab_HeavyChain1 | 672 | 22-41 | 53-62 | 95-114 |
| Pascolizumab_LightChain1 | 673 | 22-41 | 52-61 | 90-109 |
| Pasotuxizumab_HeavyChain1 | 674 | 22-41 | 184-193 | 94-113 |
| Pasotuxizumab_SingleChain | 675 | 22-41 | 184-193 | 94-113 |
| Pateclizumab_HeavyChain1 | 676 | 22-41 | | 94-113 |
| Pateclizumab_LightChain1 | 677 | 22-41 | 48-57 | 86-105 |
| Patritumab_HeavyChain1 | 678 | 22-41 | | 93-112 |
| Patritumab_hinge-CH2—CH3 | 679 | 22-41 | | |
| Patritumab_LightChain1 | 680 | 22-41 | 54-63 | 92-111 |
| Pembrolizumab_HeavyChain1 | 681 | 22-41 | | 94-113 |
| Pembrolizumab_LightChain1 | 682 | 22-41 | 52-61 | 90-109 |
| Perakizumab_HeavyChain1 | 683 | 22-41 | | 94-113 |
| Perakizumab_LightChain1 | 684 | 22-41 | | 86-105 |
| Pertuzuab_HeavyChain1 | 685 | 22-41 | 58-67 | 92-111 |
| Pertuzuab_LightChain1 | 686 | 22-41 | 47-56 | 85-104 |
| Pertuzumab_HeavyChain | 687 | 22-41 | 48-57 | 86-105 |
| Pertuzumab_LightChain | 688 | 22-41 | 59-68 | 94-113 |
| Pexelizumab_h5g1.1-scFv | 689 | 22-41 | 31-40 | 88-107 |
| Pexelizumab_h5g1.1VHC_+_F_Heavy_Chain_V-Region | 690 | 22-41 | | 94-113 |
| Pexelizumab_h5g1.1VHC_+_F_Light_Chain_V-Region | 691 | 22-41 | 28-37 | 85-104 |
| PF-05082566_HeavyChain1 | 692 | 22-41 | 51-60 | 94-113 |
| PF-05082568_LightChain1 | 693 | 22-41 | 47-56 | 85-104 |
| Pidilizumab_HeavyChain1 | 694 | 22-41 | | |
| Pidilizumab_LightChain1 | 695 | 22-41 | 47-56 | 85-104 |
| Pinatuzumab_vedotin_HeavyChain1 | 696 | 22-41 | 51-60 | 94-113 |
| Pinatuzumab_vedotin_LightChain1 | 697 | 22-41 | 53-62 | 91-110 |
| Placulumab_Chain1 | 698 | 22-41 | 48-57 | 86-105 |
| Placulumab_HeavyChain1 | 699 | 22-41 | 48-57 | 86-105 |
| Plozalizumab_HeavyChain1 | 700 | 22-41 | | 96-115 |
| Plozalizumab_LightChain1 | 701 | 22-41 | 53-62 | 91-110 |
| Pogalizumab_HeavyChain1 | 702 | 22-41 | | 94-113 |
| Pogalizumab_LightChain1 | 703 | 22-41 | 48-57 | 86-105 |
| Polatuzumab_vedotin_HeavyChain1 | 704 | 22-41 | | 94-113 |
| Polatuzumab_vedotin_LightChain1 | 705 | 22-41 | 52-61 | 90-109 |
| Ponezumab_HeavyChain1 | 706 | 22-41 | | 94-113 |
| Ponezumab_LightChain1 | 707 | 22-41 | 53-62 | 91-110 |
| Pritoxaximab_HeavyChain1 | 708 | 22-41 | 51-60 | |

TABLE 5-continued

CDRs of exemplified antibodies

| Name | Protein SEQ ID NO | CDR1 | CDR2 | CDR3 |
|---|---|---|---|---|
| Pritoxaximab_LightChain1 | 709 | 22-41 | 48-57 | |
| Pritumumab_HeavyChain1 | 710 | 22-41 | | |
| Pritumumab_LightChain1 | 711 | 22-41 | 48-57 | 86-105 |
| Quilizumab_HeavyChain1 | 712 | 22-41 | 58-67 | 94-113 |
| Quilizumab_LightChain1 | 713 | 22-41 | 53-62 | 91-110 |
| Racotumomab_HeavyChain1 | 714 | 22-41 | | |
| Racotumomab_LightChain1 | 715 | 22-41 | 48-57 | |
| Racotumomab_scVH-VH'-VH_chain | 716 | 22-41 | | 94-113 |
| Radretumab_HeavyChain1 | 717 | 22-41 | 177-186 | 94-113 |
| Radretumab_i_chain | 718 | 22-41 | | |
| Rafivirumab_HeavyChain1 | 719 | 22-41 | | |
| Rafivirumab_HeavyChain | 720 | 22-41 | | |
| Rafivirumab_LightChain1 | 721 | 22-41 | 50-59 | 88-107 |
| Rafivirumab_LightChain | 722 | 22-41 | 50-59 | 88-107 |
| Ralpancizumab_HeavyChain1 | 723 | 22-41 | | 94-113 |
| Ralpancizumab_LightChain1 | 724 | 22-41 | 48-57 | 86-105 |
| Ramucirumab_HeavyChain1 | 725 | 22-41 | 58-67 | 94-113 |
| Ramucirumab_LightChain1 | 726 | 22-41 | 48-57 | |
| Ranibiziuab_HeavyChain1 | 727 | 22-41 | | 92-111 |
| Ranibizivab_LightChain1 | 728 | 22-41 | 48-57 | 86-105 |
| Ranibizumab_fab_fragment | 729 | 22-41 | 48-57 | 86-105 |
| Ranibizumab_HeavyChain | 730 | 22-41 | | 94-113 |
| Ranibizumab_LightChain | 731 | 22-41 | | 94-113 |
| Ranibizumab_LightChain_variant | 732 | 22-41 | 48-57 | 86-105 |
| Refanezumab_HeavyChain1 | 733 | 22-41 | | 94-113 |
| Refanezumab_LightChain1 | 734 | 22-41 | 54-63 | 92-111 |
| REGN2810_HeavyChain1 | 735 | 22-41 | 100-109 | 92-111 |
| REGN2810_LightChain1 | 736 | 22-41 | 47-56 | 85-104 |
| rhuMab_HER2(9C1)_LightChain | 737 | 22-41 | 51-60 | 89-108 |
| rhuMab_HER2_HeavyChain | 738 | 22-41 | | 49-68 |
| rhuMab_HER2_LightChain | 739 | 22-41 | 49-58 | 87-106 |
| rhuMab_HER2_LightChain_variant1 | 740 | 22-41 | | |
| rhuMab_HER2_LightChain_variant2 | 741 | 22-41 | 48-57 | 86-105 |
| rhuMab_HER2_LightChain_variant3 | 742 | 22-41 | 48-57 | 86-105 |
| rhuMab_HER2_LightChain_variant4 | 743 | 22-41 | 49-58 | 87-106 |
| rhuMab_HER2_LightChain_V-Region | 744 | 22-41 | 48-57 | 86-105 |
| rhuMab_HER2_gamma1-Chain | 745 | 22-41 | 51-60 | 94-113 |
| rhuMab_HER2_gamma1-Chain | 746 | 22-41 | 51-60 | 94-113 |
| rhuMab_HER2_gamma1-Chain_rhuMab_HER2_LightChain_sc405 | 747 | 22-41 | 51-60 | 94-113 |
| rhuMab_HER2_gamma1-Chain_variant1 | 748 | 22-41 | 51-60 | 94-113 |
| rhuMab_HER2_gamma1-Chain_variant2 | 749 | 22-41 | 51-60 | 94-113 |
| rhuMab_HER2_gamma1-Chain_variant3 | 750 | 22-41 | 51-60 | 94-113 |
| rhuMab_HER2_gamma1-Chain_V-Region | 751 | 22-41 | 51-60 | 94-113 |
| rhuMAb-VEGF_HeavyChain1 | 752 | 22-41 | | 94-113 |
| rhuMAb-VEGF_LightChain1 | 753 | 22-41 | 48-57 | 86-105 |
| rhuMAb-VEGF_LightChain | 754 | 22-41 | 48-57 | 86-105 |
| rhuMAb-VEGF_LightChain_VG-Region | 755 | 22-41 | 48-57 | 86-105 |
| rhuMAb-VEGF_gamma1-Chain | 756 | 22-41 | | 94-113 |
| rhuMAb-VEGF_gamma1-Chain_VDG-Region | 757 | 22-41 | | 94-113 |
| Rilotumumab_HeavyChain1 | 758 | 22-41 | 31-40 | 93-112 |
| Rilotumumab_LightChain1 | 759 | 22-41 | 48-57 | 86-105 |
| Rilotumumab_scFv-CH_chain | 760 | 22-41 | 177-186 | 94-113 |
| Rinucumab_HeavyChain1 | 761 | 22-41 | 53-62 | 95-114 |
| Rinucumab_HeavyChain | 762 | 22-41 | 53-62 | 95-114 |
| Rinucumab_LightChain1 | 763 | 22-41 | 32-41 | 87-106 |
| Risankizumab_HeavyChain1 | 764 | 22-41 | 51-60 | 94-113 |
| Risankizumab_LightChain1 | 765 | 22-41 | 48-57 | |
| Rituximab_HeavyChain | 766 | 22-41 | 51-60 | 94-113 |
| Rituximab_HeavyChain_variant | 767 | 22-41 | 51-60 | 94-113 |
| Rituximab_LightChain | 768 | 22-41 | 47-56 | 85-104 |
| Rivabazumab_pegol_HeavyChain1 | 769 | 22-41 | 103-112 | 94-113 |
| Rivabazumab_pegol_LightChain1 | 770 | 22-41 | 48-57 | 86-105 |
| Robatumumab_HeavyChain1 | 771 | 22-41 | | 93-112 |
| Robatumumab_LightChain1 | 772 | 22-41 | | 86-105 |
| Roledumab_HeavyChain1 | 773 | 22-41 | | 94-113 |
| Roledumab_LightChain1 | 774 | 22-41 | 48-57 | 86-105 |
| Romosozumab_fab_fragment | 775 | 22-41 | 48-57 | 86-105 |
| Romosozumab_HeavyChain1 | 776 | 22-41 | 104-113 | 94-113 |
| Romosozumab_LightChain1 | 777 | 22-41 | 48-57 | 86-105 |
| Rontalizuab_HeavyChain1 | 778 | 22-41 | | 93-112 |
| Rontalizumab_LightChain1 | 779 | 22-41 | | 88-107 |
| Rontalizumab_HeavyChain1 | 780 | 22-41 | | 94-113 |
| Rontalizumab_LightChain1 | 781 | 22-41 | | 90-109 |
| Rovalpituzumab_tesirine_HeavyChain1 | 782 | 22-41 | | 94-113 |
| Rovalpituzumab_tesirine_LightChain1 | 783 | 22-41 | 48-57 | 86-105 |
| Rovelizumab_HeavyChain1 | 784 | 22-41 | | 94-113 |

TABLE 5-continued

CDRs of exemplified antibodies

| Name | Protein SEQ ID NO | CDR1 | CDR2 | CDR3 |
|---|---|---|---|---|
| Rovelizumab_LightChain1 | 785 | 22-41 | 52-61 | 90-109 |
| Ruplizumab_HeavyChain1 | 786 | 22-41 | | 94-113 |
| Ruplizumab_LightChain1 | 787 | 22-41 | | 90-109 |
| Sacituzumab_govitecan_HeavyChain1 | 788 | 22-41 | | |
| Sacituzumab_govitecan_LightChain1 | 789 | 22-41 | 48-57 | 86-105 |
| Samalizumab_HeavyChain1 | 790 | 22-41 | | 94-113 |
| Samalizumab_LightChain1 | 791 | 22-41 | 48-57 | 86-105 |
| Sarilumab_HeavyChain1 | 792 | 22-41 | | 94-113 |
| Sarilumab_LightChain1 | 793 | 22-41 | 48-57 | 86-105 |
| Satumomab_pendetide_HeavyChain | 794 | 22-41 | 366-375 | |
| Satumomab_pendetide_LightChain | 795 | 22-41 | 29-38 | 86-105 |
| Secukinumab_HeavyChain1 | 796 | 22-41 | | 94-113 |
| Secukinumab_LightChain1 | 797 | 22-41 | 49-58 | 87-106 |
| Seribantumab_HeavyChain1 | 798 | 22-41 | | 94-113 |
| Seribantumab_LightChain1 | 799 | 22-41 | 50-59 | 88-107 |
| Setoxaximab_HeavyChain1 | 800 | 22-41 | | 94-113 |
| Setoxaximab_LightChain1 | 801 | 22-41 | 54-63 | 92-111 |
| Sifalimumab_HeavyChain1 | 802 | 22-41 | | 94-113 |
| Sifalimumab_LightChain1 | 803 | 22-41 | 49-58 | 87-106 |
| Siltuximab_HeavyChain1 | 804 | 22-41 | | 94-113 |
| Siltuximab_LightChain1 | 805 | 22-41 | 47-56 | 85-104 |
| Simtuzumab_HeavyChain1 | 806 | 22-41 | | |
| Simtuzumab_LightChain1 | 807 | 22-41 | 53-62 | 91-110 |
| Sirukumab_HeavyChain1 | 808 | 22-41 | | 94-113 |
| Sirukumab_LightChain1 | 809 | 22-41 | 47-56 | 85-104 |
| Sofituzumab_vedotin_HeavyChain1 | 810 | 22-41 | | 94-113 |
| Sofituzumab_vedotin_LightChain1 | 811 | 22-41 | 48-57 | 86-105 |
| Solanezumab_HeavyChain1 | 812 | 22-41 | | 94-113 |
| Solanezumab_HeavyChain | 813 | 22-41 | | 94-113 |
| Solanezumab_LightChain1 | 814 | 22-41 | 30-39 | 91-110 |
| Solitomab_HeavyChain1 | 815 | 22-41 | 54-63 | 92-111 |
| Solitomab_SingleChain | 816 | 22-41 | 54-63 | 92-111 |
| Sonepcizumab_LightChain_Precursor | 817 | 22-41 | | 106-125 |
| Sonepcizumab_gamma1-Chain_Precursor | 818 | 22-41 | | |
| Stamulumab_HeavyChain1 | 819 | 22-41 | | 93-112 |
| Stamulumab_LightChain1 | 820 | 22-41 | 47-56 | 85-104 |
| Suptavumab_HeavyChain1 | 821 | 22-41 | | 94-113 |
| Suptavumab_LightChain1 | 822 | 22-41 | 48-57 | 86-105 |
| Suvizumab_HeavyChain1 | 823 | 22-41 | 51-60 | 94-113 |
| Suvizumab_LightChain1 | 824 | 22-41 | 54-63 | 92-111 |
| Tabalumab_HeavyChain1 | 825 | 22-41 | | 93-112 |
| Tabalumab_LightChain1 | 826 | 22-41 | 48-57 | 86-105 |
| Tacatuzuab_HeavyChain1 | 827 | 22-41 | | |
| Tacatuzuab_LightChain1 | 828 | 22-41 | | 85-104 |
| Tadocizumab_fab_fragment_HeavyChain | 829 | 22-41 | 51-60 | |
| Tadocizumab_fab_fragment_LightChain | 830 | 22-41 | 48-57 | |
| Talizumab_HeavyChain1 | 831 | 22-41 | | 94-113 |
| Talizumab_LightChain1 | 832 | 22-41 | | 86-105 |
| Tamtuvetmab_HeavyChain1 | 833 | 22-41 | | 96-115 |
| Tamtuvetmab_LightChain1 | 834 | 22-41 | 48-57 | |
| Tanezumab_HeavyChain | 835 | 22-41 | | 93-112 |
| Tanezumab_LightChain | 836 | 22-41 | 48-57 | 86-105 |
| Tarextumab_HeavyChain1 | 837 | 22-41 | | 94-113 |
| Tarextumab_LightChain1 | 838 | 22-41 | 49-58 | 87-106 |
| Tefibazumab_HeavyChain1 | 839 | 22-41 | | 93-112 |
| Tefibazumab_LightChain1 | 840 | 22-41 | 54-63 | 92-111 |
| Tenatumomab_HeavyChain1 | 941 | 22-41 | 103-112 | 94-113 |
| Tenatumomab_LightChain1 | 842 | 22-41 | 53-62 | 91-110 |
| Teneliximab_HeavyChain1 | 843 | 22-41 | | |
| Teneliximab_LightChain1 | 844 | 22-41 | 85-94 | 86-105 |
| Teplizumab_HeavyChain1 | 845 | 22-41 | | |
| Teplizumab_LightChain1 | 846 | 22-41 | 47-56 | 85-104 |
| Teprotumumab_HeavyChain1 | 847 | 22-41 | | |
| Teprotumumab_LightChain1 | 848 | 22-41 | 48-57 | 86-105 |
| Tesidolumab_HeavyChain1 | 849 | 22-41 | | 94-113 |
| Tesidolumab_LightChain1 | 850 | 22-41 | 47-56 | 85-104 |
| Tezepelumab_HeavyChain1 | 851 | 22-41 | | 94-113 |
| Tezepelumab_LightChain1 | 852 | 22-41 | | 85-104 |
| ThioMAb-chMA79b-HC(A118C)_HeavyChain | 853 | 22-41 | | 94-113 |
| ThioMAb-hu10A8.v1-HC(A118C)_HeavyChain | 854 | 22-41 | | 94-113 |
| ThioMAb-hu10A8.v1-HC(V205C)_HeavyChain | 855 | 22-41 | | 94-113 |
| ThioMAb-hu10A8.v1-LC(A118C)_LightChain | 856 | 22-41 | 48-57 | 86-105 |
| ThioMAb-hu10A8.v1-LC(V205C)_LightChain | 857 | 22-41 | 48-57 | 86-105 |
| ThioMAb-huMA79b.v17-HC(A118C)_HeavyChain | 858 | 22-41 | | 94-113 |
| ThioMAb-huMA79b.v17-HC(A118C)_LightChain | 859 | 22-41 | 52-61 | 90-109 |
| ThioMAb-huMA79b.v18-HC(A118C)_HeavyChain | 860 | 22-41 | | 94-113 |

TABLE 5-continued

CDRs of exemplified antibodies

| Name | Protein SEQ ID NO | CDR1 | CDR2 | CDR3 |
|---|---|---|---|---|
| ThioMAb-huMA79b.v28-HC(A118C)_LightChain | 861 | 22-41 | 52-61 | 90-109 |
| ThioMAb-huMA79b.v28-LC(V205C)_LightChain | 862 | 22-41 | 52-61 | 90-109 |
| Ticiliuab_HeavyChain1 | 863 | 22-41 | | 92-111 |
| Ticiliuab_LightChain1 | 864 | 22-41 | 47-56 | 85-104 |
| Tigatuzumab_HeavyChain1 | 865 | 22-41 | | 94-113 |
| Tigatuzumab_HeavyChain | 866 | 22-41 | | 94-113 |
| Tigatuzumab_LightChain1 | 867 | 22-41 | 48-57 | 86-105 |
| Tigatuzumab_LightChain | 868 | 22-41 | 48-57 | 86-105 |
| Tildrakizumab_HeavyChain1 | 869 | 22-41 | | 94-113 |
| Tildrakizumab_LightChain1 | 870 | 22-41 | 29-38 | 86-105 |
| Tisotumab_vedotin_HeavyChain1 | 871 | 22-41 | | 94-113 |
| Tisotumab_vedotin_LightChain1 | 872 | 22-41 | 48-57 | 86-105 |
| Tocilizumab_HeavyChain1 | 873 | 22-41 | | 93-112 |
| Tocilizumab_LightChain1 | 874 | 22-41 | 48-57 | 86-105 |
| Tosatoxumab_HeavyChain1 | 875 | 22-41 | | 94-113 |
| Tosatoxumab_LightChain1 | 876 | 22-41 | 49-58 | 87-109 |
| Tositumomab_HeavyChain | 877 | 22-41 | 51-90 | |
| Tositumomab_LightChain | 878 | 22-41 | 47-59 | 85-104 |
| Tovetumab_HeavyChain1 | 879 | 22-41 | 58-97 | 94-113 |
| Tovetumab_LightChain1 | 880 | 22-41 | | 86-105 |
| Tralokinumab_HeavyChain1 | 881 | 22-41 | | 94-113 |
| Tralokinumab_LightChain1 | 882 | 22-41 | 47-56 | 85-104 |
| Trastuzuab_HeavyChain1 | 883 | 22-41 | 51-90 | 93-112 |
| Trastuzuab_LightChain1 | 884 | 22-41 | 47-56 | 85-104 |
| Trastuzumab_emtansine_HeavyChain1 | 885 | 22-41 | 51-60 | 94-113 |
| Trastuzumab_emtansine_LightChain1 | 886 | 22-41 | 48-57 | 86-105 |
| Trastuzumab_HeavyChain1 | 887 | 22-41 | 51-60 | 94-113 |
| Trastuzumab_HeavyChain | 888 | 22-41 | 51-60 | 94-113 |
| Trastuzumab_HeavyChain_variant_In8z_B | 889 | 22-41 | 51-60 | 94-113 |
| Trastuzumab_HeavyChain_variant_7637_H | 890 | | | |
| Trastuzumab_LightChain1 | 891 | 22-41 | 48-57 | 86-105 |
| Trastuzumab_LightChain_variant_In8z_A | 892 | 22-41 | 48-57 | 86-105 |
| Trastuzumab_LightChain_variant_7637_L | 893 | 22-41 | 48-57 | 86-105 |
| TRC-105_HeavyChain1 | 894 | 22-41 | 95-104 | 96-115 |
| TRC-105_LightChain1 | 895 | 22-41 | 47-56 | 85-104 |
| Tregalizumab_HeavyChain1 | 896 | 22-41 | | 96-115 |
| Tregalizumab_LightChain1 | 897 | 22-41 | 37-46 | 90-109 |
| Tremelimumab_HeavyChain1 | 898 | 22-41 | | 94-113 |
| Tremelimumab_LightChain1 | 899 | 22-41 | 48-57 | 86-105 |
| Trevogrumab_HeavyChain1 | 900 | 22-41 | | 94-113 |
| Trevogrumab_LightChain1 | 901 | 22-41 | 48-57 | 86-105 |
| Tucotuzumab_celmoleukin_HeavyChain1 | 902 | 22-41 | | |
| Tucotuzumab_celmoleukin_LightChain1 | 903 | 22-41 | | 85-104 |
| Ublituximab_HeavyChain1 | 904 | 22-41 | 51-60 | |
| Ublituximab_LightChain1 | 905 | 22-41 | 47-56 | 85-104 |
| Ulocuplumab_HeavyChain1 | 906 | 22-41 | 58-67 | 94-113 |
| Ulocuplumab_LightChain1 | 907 | 22-41 | 48-57 | 86-105 |
| Urelumab_HeavyChain1 | 908 | 22-41 | | 93-112 |
| Urelumab_LightChain1 | 909 | 22-41 | 48-57 | 86-105 |
| Urtoxazumab_HeavyChain1 | 910 | 22-41 | | 94-113 |
| Urtoxazumab_LightChain1 | 911 | 22-41 | | 88-105 |
| Ustekinumab_HeavyChain1 | 912 | 22-41 | | 94-113 |
| Ustekinumab_LightChain1 | 913 | 22-41 | 48-57 | 86-105 |
| Vadastuximab_talirine_HeavyChain1 | 914 | 22-41 | 51-60 | 94-113 |
| Vadastuximab_talirine_LightChain1 | 915 | 22-41 | 48-57 | 86-105 |
| Vandortuzumab_vedotin_HeavyChain1 | 916 | 22-41 | | 94-113 |
| Vandortuzumab_vedotin_LightChain1 | 917 | 22-41 | 54-63 | 92-111 |
| Vantictumab_HeavyChain1 | 918 | 22-41 | | 94-113 |
| Vantictumab_LightChain1 | 919 | 22-41 | 47-56 | 85-104 |
| Vanucizumab_HeavyChain1 | 920 | 22-41 | | 94-113 |
| Vanucizumab_HeavyChain2 | 921 | 22-41 | | 94-113 |
| Vanucizumab_LightChain1 | 922 | 22-41 | | 85-104 |
| Vanucizumab_LightChain2 | 923 | 22-41 | 48-57 | 86-105 |
| Varlilumab_HeavyChain1 | 924 | 22-41 | | 94-113 |
| Varlilumab_LightChain1 | 925 | 22-41 | 48-57 | 86-105 |
| Vatelizumab_HeavyChain1 | 926 | 22-41 | | 93-112 |
| Vatelizumab_LightChain1 | 927 | 22-41 | 47-56 | 85-104 |
| Vedolizumab_HeavyChain1 | 928 | 22-41 | | 94-113 |
| Vedolizumab_LightChain1 | 929 | 22-41 | 53-62 | 91-110 |
| Veltuzumab_HeavyChain1 | 930 | 22-41 | 51-60 | 94-113 |
| Veltuzumab_LightChain1 | 931 | 22-41 | 47-56 | 85-104 |
| Vesencumab_HeavyChain1 | 932 | 22-41 | | 94-113 |
| Vesencumab_LightChain1 | 933 | 22-41 | 48-57 | 88-105 |
| Visilizumab_HeavyChain1 | 934 | 22-41 | | 94-113 |
| Visilizumab_LightChain1 | 935 | 22-41 | 47-56 | 85-104 |
| Voloximab_HeavyChain | 936 | 22-41 | | 93-112 |

TABLE 5-continued

CDRs of exemplified antibodies

| Name | Protein SEQ ID NO | CDR1 | CDR2 | CDR3 |
|---|---|---|---|---|
| Volociximab_LightChain | 937 | 22-41 | 49-58 | 87-106 |
| Vorsetuzumab_HeavyChain1 | 938 | 22-41 | | 94-113 |
| Vorsetuzumab_LightChain1 | 939 | 22-41 | 52-61 | 90-109 |
| Vorsetuzumab_mafodotin_HeavyChain1 | 940 | 22-41 | | 94-113 |
| Vorsetuzumab_mafodotin_LightChain1 | 941 | 22-41 | 52-61 | 90-109 |
| Yttrium_(90Y)_clivatuzumab_tetraxetan_HeavyChain1 | 942 | 22-41 | | 94-113 |
| Yttrium_(90Y)_clivatuzumab_tetraxetan_LightChain1 | 943 | 22-41 | 49-58 | |
| Yttrium_Y_90_epratuzumab_tetraxetan_HeavyChain1 | 944 | 22-41 | | |
| Yttrium_Y_90_epratuzumab_tetraxetan_LightChain1 | 945 | 22-41 | 54-63 | 92-111 |
| Yttrium_Y_90_epratuzumab_HeavyChain1 | 946 | 22-41 | | |
| Yttrium_Y_90_epratuzumab_LightChain1 | 947 | 22-41 | 53-92 | 91-110 |
| Zalutumumab_HeavyChain1 | 948 | 22-41 | | 94-113 |
| Zalutumumab_LightChain1 | 949 | 22-41 | 48-57 | 89-105 |
| Zanolimumab_H0_HeavyChain | 950 | 22-41 | | 93-112 |
| Zanolimumab_L0_LightChain | 951 | 22-41 | 49-58 | 87-109 |
| Zatuximab_HeavyChain1 | 952 | 22-41 | | 94-113 |
| Zatuximab_LightChain1 | 953 | 22-41 | 53-62 | 91-110 |
| Actoxumab_HeavyChain | 954 | 22-41 | | 94-113 |
| Actoxumab_LightChain | 955 | 22-41 | 48-57 | 89-105 |
| Andecaliximab_HeavyChain | 956 | 22-41 | 92-101 | 93-112 |
| Andecaliximab_LightChain | 957 | 22-41 | 48-57 | 86-105 |
| Aprutumab_HeavyChain | 958 | 22-41 | | 94-113 |
| Aprutumab_LightChain | 959 | 22-41 | 49-58 | 87-106 |
| Azintuxizumab_HeavyChain | 960 | 22-41 | | 94-113 |
| Azintuxizumab_LightChain | 961 | 22-41 | 53-62 | |
| Blinatumomab_HeavyChain1 | 962 | 22-41 | | |
| Blinatumomab_HeavyChain2 | 963 | 22-41 | | 94-113 |
| Blinatumomab_LightChain_HeavyChain_HeavyChain_LightChain | 964 | 22-41 | 52-61 | 349-368 |
| Blinatumomab_LightChain1 | 965 | 22-41 | 52-91 | |
| Blinatumomab_LightChain2 | 966 | 22-41 | 49-58 | 87-106 |
| Brazikumab_HeavyChain | 967 | 22-41 | | 94-113 |
| Brazikumab_LightChain | 968 | 22-41 | 50-59 | 88-107 |
| Brolucizumab_HeavyChain | 969 | 22-41 | | 95-114 |
| Brolucizumab_LightChain | 970 | 22-41 | 49-58 | 87-106 |
| Cabiralizumab_HeavyChain | 971 | 22-41 | | 94-113 |
| Cabiralizumab_LightChain | 972 | 22-41 | 52-61 | 90-109 |
| Camrelizumab_HeavyChain | 973 | 22-41 | | 94-113 |
| Camrelizumab_LightChain | 974 | 22-41 | 48-57 | 86-105 |
| Caplacizumab_HeavyChain | 975 | 22-41 | | 94-113 |
| Citatuzumab_bogatox_HeavyChain | 976 | 22-41 | | 94-113 |
| Cosfroviximab_HeavyChain | 977 | 22-41 | | 95-114 |
| Cosfroviximab_LightChain | 978 | 22-41 | 48-57 | |
| Crizanlizumab_HeavyChain | 979 | 22-41 | 51-60 | 94-113 |
| Crizanlizumab_LightChain | 980 | 22-41 | 52-61 | 90-109 |
| Crotedumab_HeavyChain | 981 | 22-41 | | 94-113 |
| Crotedumab_LightChain | 982 | 22-41 | 48-57 | 86-105 |
| Dezamizumab_HeavyChain | 983 | 22-41 | 51-60 | 94-113 |
| Dezamizumab_LightChain | 984 | 22-41 | 29-38 | 86-105 |
| Duvortuxizumab_Chain1_scfv | 985 | 22-41 | 47-56 | 85-104 |
| Duvortuxizumab_Chain2_scfv | 986 | 22-41 | | 88-107 |
| Duvortuxizumab_Chain3_h-CH2—CH3 | 987 | 22-41 | | |
| Efungumab_HeavyChain | 988 | 22-41 | | 96-115 |
| Efungumab_HeavyChain_LightChain | 989 | 22-41 | 185-194 | 96-115 |
| Efungumab_LightChain | 990 | 22-41 | 48-57 | 86-105 |
| Elezanumab_HeavyChain | 991 | 22-41 | | 94-113 |
| Elezanumab_LightChain | 992 | 22-41 | 33-42 | 88-107 |
| Emapalumab_HeavyChain | 993 | 22-41 | | 94-113 |
| Emapalumab_LightChain | 994 | 22-41 | 49-58 | 89-108 |
| Enoblituzumab_HeavyChain | 995 | 22-41 | | 94-113 |
| Enoblituzumab_LightChain | 996 | 22-41 | 49-58 | 87-106 |
| Eptinezumab_HeavyChain | 997 | 22-41 | | |
| Eptinezumab_LightChain | 998 | 22-41 | 49-58 | 87-106 |
| Erenumab_HeavyChain | 999 | 22-41 | | 94-113 |
| Erenumab_LightChain | 1000 | 22-41 | 49-58 | 87-106 |
| Fremanezumab_HeavyChain | 1001 | 22-41 | | 96-115 |
| Fremanezumab_LightChain | 1002 | 22-41 | 48-57 | 86-105 |
| Frunevetmab_HeavyChain | 1003 | 22-41 | | 93-112 |
| Frunevetmab_LightChain | 1004 | 22-41 | 29-38 | |
| Gatipotuzumab_HeavyChain | 1005 | 22-41 | | 96-115 |
| Gatipotuzumab_LightChain | 1006 | 22-41 | 53-62 | 91-110 |
| Gedivumab_HeavyChain | 1007 | 22-41 | | 94-113 |
| Gedivumab_LightChain | 1008 | 22-41 | 48-57 | 86-105 |
| Gemetuzumab_HeavyChain | 1009 | 22-41 | 51-60 | 94-113 |
| Gemetuzumab_LightChain | 1010 | 22-41 | | 90-109 |
| Gilvetmab_HeavyChain | 1011 | 22-41 | 99-108 | 94-113 |
| Gilvetmab_LightChain | 1012 | 22-41 | 48-57 | 86-105 |

TABLE 5-continued

CDRs of exemplified antibodies

| Name | Protein SEQ ID NO | CDR1 | CDR2 | CDR3 |
| --- | --- | --- | --- | --- |
| Ifabotuzumab_HeavyChain | 1013 | 22-41 | 51-60 | 94-113 |
| Ifabotuzumab_LightChain | 1014 | 22-41 | 48-57 | 86-105 |
| Iratumumab_HeavyChain | 1015 | 22-41 | | 93-112 |
| Iratumumab_LightChain | 1016 | 22-41 | 48-57 | 86-105 |
| Lacnotuzumab_HeavyChain | 1017 | 22-41 | | 94-113 |
| Lacnotuzumab_LightChain | 1018 | 22-41 | | 86-105 |
| Larcaviximab_HeavyChain | 1019 | 22-41 | | 94-113 |
| Larcaviximab_LightChain | 1020 | 22-41 | 29-38 | |
| Lendalizumab_HeavyChain | 1021 | 22-41 | | 94-113 |
| Lendalizumab_LightChain | 1022 | 22-41 | 52-61 | 90-109 |
| Lesofavumab_HeavyChain | 1023 | 22-41 | 59-68 | 94-113 |
| Lesofavumab_LightChain | 1024 | 22-41 | 53-62 | 91-110 |
| Letolizumab_HeavyChain | 1025 | 22-41 | | 94-113 |
| Losatuxizumab_HeavyChain | 1026 | 22-41 | | 94-113 |
| Losatuxizumab_LightChain | 1027 | 22-41 | 48-57 | 86-105 |
| Lupartumab_HeavyChain | 1028 | 22-41 | 58-67 | 94-113 |
| Lupartumab_LightChain | 1029 | 22-41 | 50-59 | 88-107 |
| Lutikizumab_HeavyChain | 1030 | 22-41 | | 219-238 |
| Lutikizumab_LightChain | 1031 | 22-41 | 48-57 | 86-105 |
| Oleclumab_HeavyChain | 1032 | 22-41 | | 94-113 |
| Oleclumab_LightChain | 1033 | 22-41 | 49-58 | 87-106 |
| Otlertuzumab_HeavyChain | 1034 | 22-41 | 189-198 | 94-113 |
| Ozoralizumab_HeavyChain | 1035 | 22-41 | | 94-113 |
| Ozoralizumab_HeavyChain_HeavyChain_HeavyChain | 1036 | 22-41 | | 94-113 |
| Pasotuxizumab_HeavyChain_LightChain_HeavyChain_LightChain | 1037 | 22-41 | 184-193 | 94-113 |
| Pasotuxizumab_HeavyChain1 | 1038 | 22-41 | | 94-113 |
| Pasotuxizumab_HeavyChain2 | 1039 | 22-41 | | 96-115 |
| Pasotuxizumab_LightChain1 | 1040 | 22-41 | 48-57 | 86-105 |
| Pasotuxizumab_LightChain2 | 1041 | 22-41 | | 88-107 |
| Placulumab_HeavyChain | 1042 | 22-41 | 48-57 | 86-105 |
| Porgaviximab_HeavyChain | 1043 | 22-41 | 95-104 | 96-115 |
| Porgaviximab_LightChain | 1044 | 22-41 | 29-38 | 86-105 |
| Prezalumab_HeavyChain | 1045 | 22-41 | | 94-113 |
| Prezalumab_LightChain | 1046 | 22-41 | 48-57 | 86-105 |
| Radretumab_HeavyChain | 1047 | 22-41 | | 94-113 |
| Radretumab_HeavyChain_LightChain | 1048 | 22-41 | 177-186 | 94-113 |
| Radretumab_LightChain | 1049 | 22-41 | 51-60 | 89-108 |
| Ranevetmab_HeavyChain1 | 1050 | 22-41 | | 93-112 |
| Ranevetmab_HeavyChain2 | 1051 | 22-41 | | 93-112 |
| Ranevetmab_LightChain | 1052 | 22-41 | 29-38 | 86-105 |
| Remtolumab_HeavyChain | 1053 | 22-41 | | 94-113 |
| Remtolumab_LightChain | 1054 | 22-41 | 48-57 | 86-105 |
| Rosmantuzumab_HeavyChain | 1055 | 22-41 | 51-60 | 94-113 |
| Rosmantuzumab_LightChain | 1056 | 22-41 | 52-61 | 90-109 |
| Rozanolixizumab_HeavyChain | 1057 | 22-41 | | 94-113 |
| Rozanolixizumab_LightChain | 1058 | 22-41 | 53-62 | 91-110 |
| Sapelizumab_HeavyChain | 1059 | 22-41 | | 94-113 |
| Sapelizumab_LightChain | 1060 | 22-41 | 48-57 | 86-105 |
| Selicrelumab_HeavyChain | 1061 | 22-41 | | 94-113 |
| Selicrelumab_LightChain | 1062 | 22-41 | 29-38 | 86-105 |
| Solitomab_HeavyChain1 | 1063 | 22-41 | | |
| Solitomab_HeavyChain2 | 1164 | 22-41 | | 94-113 |
| Solitomab_LightChain_HeavyChain_HeavyChain_LightChain | 1065 | 22-41 | 54-63 | 92-111 |
| Solitomab_LightChain1 | 1066 | 22-41 | 54-63 | 92-111 |
| Solitomab_LightChain2 | 1067 | 22-41 | 49-58 | 87-106 |
| Suptavumab_HeavyChain2 | 1068 | 22-41 | | 94-113 |
| Suvratoxumab_HeavyChain | 1069 | 22-41 | | 93-112 |
| Suvratoxumab_LightChain | 1070 | 22-41 | 48-57 | 86-105 |
| Tadocizumab_LightChain | 1071 | 22-41 | 48-57 | |
| Tanezumab_HeavyChain | 1072 | 22-41 | | 93-112 |
| Tanezumab_LightChain | 1073 | 22-41 | 48-57 | 86-105 |
| Tavolixizumab_HeavyChain | 1074 | 22-41 | | 93-112 |
| Tavolixizumab_LightChain | 1075 | 22-41 | 48-57 | 86-105 |
| Telisotuzumab_HeavyChain | 1076 | 22-41 | | 94-113 |
| Telisotuzumab_LightChain | 1077 | 22-41 | 52-61 | 90-109 |
| Telisotuzumab_vadotin_HeavyChain | 1078 | 22-41 | | 94-113 |
| Telisotuzumab_vadotin_LightChain | 1079 | 22-41 | 52-61 | 90-109 |
| Timigutuzumab_HeavyChain | 1080 | 22-41 | 51-60 | 94-113 |
| Timigutuzumab_LightChain | 1081 | 22-41 | 48-57 | 86-105 |
| Timolumab_HeavyChain | 1082 | 22-41 | | 94-113 |
| Timolumab_LightChain | 1083 | 22-41 | 48-57 | 86-105 |
| Tomuzotuximab_HeavyChain | 1084 | 22-41 | 92-101 | 93-112 |
| Tomuzotuximab_LightChain | 1085 | 22-41 | | 86-105 |
| Trastuzumab_duocarmazine_HeavyChain | 1086 | 22-41 | 51-60 | 94-113 |
| Trastuzumab_duocarmazine_LightChain | 1087 | 22-41 | 48-57 | 86-105 |
| Varisacumab_HeavyChain | 1088 | 22-41 | 59-68 | 94-113 |

TABLE 5-continued

CDRs of exemplified antibodies

| Name | Protein SEQ ID NO | CDR1 | CDR2 | CDR3 |
|---|---|---|---|---|
| Varisacumab_LightChain | 1089 | 22-41 | 48-57 | 86-105 |
| Vunakizumab_HeavyChain | 1090 | 22-41 | | 94-113 |
| Vunakizumab_LightChain | 1091 | 22-41 | 47-56 | 85-104 |
| Xentuzumab_HeavyChain | 1092 | 22-41 | | 94-113 |
| Xentuzumab_LightChain | 1093 | 22-41 | 49-58 | 87-106 |
| anti-rabies_S057_LightChain | 1094 | 22-41 | 74-83 | 112-131 |
| anti-rabies_S057_HeavyChain | 1095 | 22-41 | | |
| anti-rabies_S0JB_LightChain | 1096 | 22-41 | 66-75 | 104-123 |
| anti-rabies_S0JB_HeavyChain | 1097 | 22-41 | 72-81 | 114-133 |
| anti-rabies_S0JA_LightChain | 1098 | 22-41 | 68-77 | 106-125 |
| anti-rabies_S0JA_HeavyChain | 1099 | 22-41 | | 113-132 |
| anti-rabies_LightChain | 1100 | 22-41 | 46-55 | 84-103 |
| anti-rabies_HeavyChain | 1101 | 22-41 | | 84-103 |
| anti-rabies_LightChain | 1102 | 22-41 | 53-62 | 91-110 |
| anti-rabies_HeavyChain | 1103 | 22-41 | | 84-103 |
| anti-RSV_51TB_LightChain | 1104 | 22-41 | 49-58 | 87-106 |
| anti-RSV_51TB_HeavyChain | 1105 | 22-41 | 47-56 | 89-108 |
| anti-alpha-toxin_4U6V_LightChain | 1106 | 22-41 | 48-57 | 86-105 |
| anti-alpha-toxin_4U6V_HeavyChain | 1107 | 22-41 | | 93-112 |
| anti-alpha-toxin_4U6V_Chain-A | 1108 | 22-41 | 248-257 | |
| anti-alpha-toxin_4U6V_Chain-B | 1109 | 22-41 | 248-257 | |
| anti-IsdB_5D1Q_Chain-A | 1110 | 22-41 | 48-57 | 86-105 |
| anti-IsdB_5D1Q_Chain-B | 1111 | 22-41 | | 94-113 |
| anti-IsdB_5D1Q_Chain-C | 1112 | 22-41 | | 103-122 |
| anti-IsdB_5D1Q_Chain-D | 1113 | 22-41 | 49-58 | 87-106 |
| anti-IsdB_5D1Q_Chain-E | 1114 | 22-41 | | |
| anti-IsdB_5D1X_Chain-A | 1115 | 22-41 | 53-62 | 91-110 |
| anti-IsdB_5D1X_Chain-B | 1116 | 22-41 | | 94-113 |
| anti-IsdB_5D1X_Chain-C | 1117 | 22-41 | | 103-122 |
| anti-IsdB_5D1X_Chain-D | 1118 | 22-41 | 49-58 | 87-106 |
| anti-IsdB_5D1X_Chain-E | 1119 | 22-41 | | |
| anti-IsdB_5D1Z_Chain-B | 1120 | 22-41 | | 95-114 |
| anti-IsdB_5D1Z_Chain-C | 1121 | 22-41 | 48-57 | 86-105 |
| anti-IsdB_5D1Z_Chain-D | 1122 | 22-41 | 53-62 | 95-114 |
| anti-IsdB_5D1Z_Chain-F | 1123 | 22-41 | 53-62 | 95-114 |
| anti-IsdB_5D1Z_Chain-G | 1124 | 22-41 | | 95-114 |
| anti-IsdB_5D1Z_HeavyChain | 1125 | 22-41 | 48-57 | 86-105 |
| anti-IsdB_5D1Z_Chain-1 | 1126 | 22-41 | 148-157 | |
| anti-HIV_b12_LightChain | 1127 | 22-41 | | 87-106 |
| anti-HIV_b12_HeavyChain | 1128 | 22-41 | | 94-113 |
| anti-HIV_2G12_LightChain | 1129 | 22-41 | 47-56 | |
| anti-HIV_2G12_HeavyChain | 1130 | 22-41 | 93-102 | 94-113 |
| anti-HIV_4E10_LightChain | 1131 | 22-41 | 49-58 | 87-106 |
| anti-HIV_4E10_HeavyChain | 1132 | 22-41 | | 94-113 |
| anti-HIV_VRC01_LightChain | 1133 | 22-41 | 46-55 | 84-103 |
| anti-HIV_VRC01_HeavyChain | 1134 | 22-41 | | |
| anti-HIV_PG9_LightChain | 1135 | 22-41 | 50-59 | 88-107 |
| anti-HIV_PG9_HeavyChain | 1136 | 22-41 | | |
| anti-HIV_VRC07_LightChain | 1137 | 22-41 | 48-55 | 84-103 |
| anti-HIV_VRC07_HeavyChain | 1138 | 22-41 | | |
| anti-HIV_3BNC117_LightChain | 1139 | 22-41 | 44-53 | |
| anti-HIV_3BNC117_HeavyChain | 1140 | 22-41 | | |
| anti-HIV_10-1074_LightChain | 1141 | 22-41 | 43-52 | 84-103 |
| anti-HIV_10-1074_HeavyChain | 1142 | 22-41 | 104-113 | 93-112 |
| anti-HIV_PGT121_LightChain | 1143 | 22-41 | 40-49 | 81-100 |
| anti-HIV_PGT121_HeavyChain | 1144 | 22-41 | 104-113 | 93-112 |
| anti-HIV_PGDM1400_LightChain | 1145 | 22-41 | 53-62 | 91-110 |
| anti-HIV_PGDM1400_HeavyChain | 1146 | 22-41 | | 94-113 |
| anti-HIV_N6_LightChain | 1147 | 22-41 | | 86-105 |
| anti-HIV_N6_HeavyChain | 1148 | 22-41 | | 94-113 |
| anti-HIV_N6_GChain | 1149 | 22-41 | | |
| anti-HIV_10E8_LightChain | 1150 | 22-41 | | 85-104 |
| anti-HIV_10E8_HeavyChain | 1151 | 22-41 | | |
| anti-HIV_12A12_LightChain | 1152 | 22-41 | | |
| anti-HIV_12A12_HeavyChain | 1153 | 22-41 | 74-83 | |
| anti-HIV_12A21_LightChain | 1154 | 22-41 | | |
| anti-HIV_12A21_HeavyChain | 1155 | 22-41 | 74-83 | 94-113 |
| anti-HIV_35022_LightChain | 1156 | 22-41 | 50-59 | 88-107 |
| anti-HIV_35022_HeavyChain | 1157 | 22-41 | | |
| anti-HIV_38C176_LightChain | 1158 | 22-41 | 50-59 | 88-107 |
| anti-HIV_38C176_HeavyChain | 1159 | 22-41 | | |
| anti-HIV_38NC55_LightChain | 1160 | 22-41 | | 83-102 |
| anti-HIV_38NC55_HeavyChain | 1161 | 22-41 | 34-43 | |
| anti-HIV_38NC60_LightChain | 1162 | 22-41 | 44-53 | |
| anti-HIV_38NC60_HeavyChain | 1163 | 22-41 | 97-106 | |
| anti-HIV_38NC60_HeavyChain | 1164 | 22-41 | 97-106 | |

TABLE 5-continued

CDRs of exemplified antibodies

| Name | Protein SEQ ID NO | CDR1 | CDR2 | CDR3 |
| --- | --- | --- | --- | --- |
| anti-HIV__447-52D__LightChain | 1165 | 22-41 | 49-58 | |
| anti-HIV__447-52D__HeavyChain | 1166 | 22-41 | | |
| anti-HIV__447-52D__LightChain | 1167 | 22-41 | 49-58 | |
| anti-HIV__447-52D__HeavyChain | 1168 | 22-41 | | |
| anti-HIV__5H/11-BMV-D5__LightChain | 1169 | 22-41 | 29-38 | 86-105 |
| anti-HIV__5H/11-BMV-D5__HeavyChain | 1170 | 22-41 | 93-102 | 94-113 |
| anti-HIV__5H/11-BMV-D5__A-Chain | 1171 | 22-41 | | |
| anti-HIV__8ANC195__LightChain | 1172 | 22-41 | 49-58 | |
| anti-HIV__8ANC195__HeavyChain | 1173 | 22-41 | | |
| anti-HIV__CAP256-VRC26.01__LightChain | 1174 | 22-41 | 49-58 | 87-106 |
| anti-HIV__CAP256-VRC26.01__HeavyChain | 1175 | 22-41 | | 94-113 |
| anti-HIV__CAP256-VRC26.02__LightChain | 1176 | 22-41 | 49-58 | 87-106 |
| anti-HIV__CAP256-VRC26.02__HeavyChain | 1177 | 22-41 | | |
| anti-HIV__CAP256-VRC26.03__LightChain | 1178 | 22-41 | 49-58 | 87-106 |
| anti-HIV__CAP256-VRC26.03__HeavyChain | 1179 | 22-41 | | 94-113 |
| anti-HIV__CAP256-VRC26.04__LightChain | 1180 | 22-41 | 49-58 | 87-106 |
| anti-HIV__CAP256-VRC26.04__HeavyChain | 1181 | 22-41 | | 94-113 |
| anti-HIV__CAP256-VRC26.05__LightChain | 1182 | 22-41 | 46-55 | |
| anti-HIV__CAP256-VRC26.05__HeavyChain | 1183 | 22-41 | | 94-113 |
| anti-HIV__CAP256-VRC26.06__LightChain | 1184 | 22-41 | 49-58 | 87-106 |
| anti-HIV__CAP256-VRC26.06__HeavyChain | 1185 | 22-41 | | 94-113 |
| anti-HIV__CAP256-VRC26.07__LightChain | 1186 | 22-41 | 49-58 | 87-106 |
| anti-HIV__CAP256-VRC26.07__HeavyChain | 1187 | 22-41 | | 94-113 |
| anti-HIV__CAP256-VRC26.08__LightChain | 1188 | 22-41 | | 87-106 |
| anti-HIV__CAP256-VRC26.08__HeavyChain | 1189 | 22-41 | | |
| anti-HIV__CAP256-VRC26.09__LightChain | 1190 | 22-41 | 49-58 | |
| anti-HIV__CAP256-VRC26.09__HeavyChain | 1191 | 22-41 | | |
| anti-HIV__CAP256-VRC26.10__LightChain | 1192 | 22-41 | 49-58 | 87-106 |
| anti-HIV__CAP256-VRC26.10__HeavyChain | 1193 | 22-41 | | 94-113 |
| anti-HIV__CAP256-VRC26.11__LightChain | 1194 | 22-41 | 49-58 | 87-106 |
| anti-HIV__CAP256-VRC26.11__HeavyChain | 1195 | 22-41 | | |
| anti-HIV__CAP256-VRC26.12__LightChain | 1196 | 22-41 | 49-58 | 87-106 |
| anti-HIV__CAP256-VRC26.12__HeavyChain | 1197 | 22-41 | | |
| anti-HIV__CAP256-VRC26.11__LightChain | 1198 | 22-41 | 49-58 | 87-106 |
| anti-HIV__CAP256-VRC26.11__HeavyChain | 1199 | 22-41 | | 94-113 |
| anti-HIV__CAP256-VRC26.12__LightChain | 1200 | 22-41 | 49-58 | 87-106 |
| anti-HIV__CAP256-VRC26.12__HeavyChain | 1201 | 22-41 | | 94-113 |
| anti-HIV__CAP256-VRC26.UCA__LightChain | 1202 | 22-41 | 49-58 | 87-106 |
| anti-HIV__CAP256-VRC26.UCA__HeavyChain | 1203 | 22-41 | | 94-113 |
| anti-HIV__CH01__LightChain | 1204 | 22-41 | 49-58 | 87-106 |
| anti-HIV__CH01__HeavyChain | 1205 | 22-41 | | 94-113 |
| anti-HIV__CH02__LightChain | 1206 | 22-41 | | |
| anti-HIV__CH02__HeavyChain | 1207 | 22-41 | | 94-113 |
| anti-HIV__CH03__LightChain | 1208 | 22-41 | 49-58 | |
| anti-HIV__CH03__HeavyChain | 1209 | 22-41 | | 94-113 |
| anti-HIV__CH04__LightChain | 1210 | 22-41 | 49-58 | 87-106 |
| anti-HIV__CH04__HeavyChain | 1211 | 22-41 | 93-102 | 94-113 |
| anti-HIV__CH103__LightChain | 1212 | 22-41 | | 81-100 |
| anti-HIV__CH103__HeavyChain | 1213 | 22-41 | | |
| anti-HIV__M66.6__LightChain | 1214 | 22-41 | 48-57 | 86-105 |
| anti-HIV__M66.G__HeavyChain | 1215 | 22-41 | 51-60 | 94-113 |
| anti-HIV__N1H45-46__LightChain | 1216 | 22-41 | 46-55 | 84-103 |
| anti-HIV__N1H45-46__HeavyChain | 1217 | 22-41 | | |
| anti-HIV__PG16__LightChain | 1218 | 22-41 | | |
| anti-HIV__PG16__HeavyChain | 1219 | 22-41 | | |
| anti-HIV__PGT122__LightChain | 1220 | 22-41 | 40-49 | 81-100 |
| anti-HIV__PGT122__HeavyChain | 1221 | 22-41 | 92-101 | 93-112 |
| anti-HIV__PGT123__LightChain | 1222 | 22-41 | 40-49 | 81-100 |
| anti-HIV__PGT123__HeavyChain | 1223 | 22-41 | 104-113 | |
| anti-HIV__PGT125__LightChain | 1224 | 22-41 | | 83-102 |
| anti-HIV__PGT125__HeavyChain | 1225 | 22-41 | | 101-120 |
| anti-HIV__PGT126__LightChain | 1226 | 22-41 | 45-54 | 83-102 |
| anti-HIV__PGT126__HeavyChain | 1227 | 22-41 | 100-109 | 101-120 |
| anti-HIV__PGT127__LightChain | 1228 | 22-41 | 45-54 | 83-102 |
| anti-HIV__PGT127__HeavyChain | 1229 | 22-41 | | 101-120 |
| anti-HIV__PGT128__LightChain | 1230 | 22-41 | 45-54 | 83-102 |
| anti-HIV__PGT128__HeavyChain | 1231 | 22-41 | | 101-120 |
| anti-HIV__PGT130__LightChain | 1232 | 22-41 | | |
| anti-HIV__PGT130__HeavyChain | 1233 | 22-41 | 73-82 | |
| anti-HIV__PGT131__LightChain | 1234 | 22-41 | | |
| anti-HIV__PGT131__HeavyChain | 1235 | 22-41 | | |
| anti-HIV__PGT135__LightChain | 1236 | 22-41 | | 86-105 |
| anti-HIV__PGT135__HeavyChain | 1237 | 22-41 | | |
| anti-HIV__PGT136__LightChain | 1238 | 22-41 | | |
| anti-HIV__PGT136__HeavyChain | 1239 | 22-41 | | 101-120 |
| anti-HIV__PGT137__LightChain | 1240 | 22-41 | | 86-105 |

TABLE 5-continued

CDRs of exemplified antibodies

| Name | Protein SEQ ID NO | CDR1 | CDR2 | CDR3 |
|---|---|---|---|---|
| anti-HIV_PGT137_HeavyChain | 1241 | 22-41 | | 100-119 |
| anti-HIV_PGT141_LightChain | 1242 | 22-41 | 90-99 | 91-110 |
| anti-HIV_PGT141_HeavyChain | 1243 | 22-41 | 93-102 | 94-113 |
| anti-HIV_PGT142_LightChain | 1244 | 22-41 | 90-99 | 91-110 |
| anti-HIV_PGT142_HeavyChain | 1245 | 22-41 | 93-102 | 94-113 |
| anti-HIV_PGT143_LightChain | 1245 | 22-41 | 90-99 | 91-110 |
| anti-HIV_PGT143_HeavyChain | 1247 | 22-41 | 93-102 | 94-113 |
| anti-HIV_PGT144_LightChain | 1248 | 22-41 | 90-99 | 91-110 |
| anti-HIV_PGT144_HeavyChain | 1249 | 22-41 | 93-102 | 94-113 |
| anti-HIV_PGT145_LightChain | 1250 | 22-41 | | 91-110 |
| anti-HIV_PGT145_HeavyChain | 1251 | 22-41 | 93-102 | 94-113 |
| anti-HIV_PGT151_LightChain | 1252 | 22-41 | | 91-110 |
| anti-HIV_PGT151_HeavyChain | 1253 | 22-41 | | |
| anti-HIV_PGT152_LightChain | 1254 | 22-41 | | 91-110 |
| anti-HIV_PGT152_HeavyChain | 1255 | 22-41 | | |
| anti-HIV_VRC-CH30_LightChain | 1255 | 22-41 | | |
| anti-HIV_VRC-CH30_HeavyChain | 1257 | 22-41 | | 103-122 |
| anti-HIV_VRC-CH31_LightChain | 1258 | 22-41 | | |
| anti-HIV_VRC-CH31_HeavyChain | 1259 | 22-41 | | 103-122 |
| anti-HIV_VRC-CH32_LightChain | 1260 | 22-41 | | |
| anti-HIV_VRC-CH32_HeavyChain | 1261 | 22-41 | | 103-122 |
| anti-HIV_VRC-CH33_LightChain | 1262 | 22-41 | | |
| anti-HIV_VRC-CH33_HeavyChain | 1263 | 22-41 | | 103-122 |
| anti-HIV_VRC-CH34_LightChain | 1264 | 22-41 | | |
| anti-HIV_VRC-CH34_HeavyChain | 1265 | 22-41 | | 103-122 |
| anti-HIV_VRC-PG04_LightChain | 1266 | 22-41 | | 84-102 |
| anti-HIV_VRC-PG04_HeavyChain | 1267 | 22-41 | | |
| anti-HIV_VRC-PG04b_LightChain | 1268 | 22-41 | | 84-101 |
| anti-HIV_VRC-PG04b_HeavyChain | 1269 | 22-41 | | |
| anti-HIV_VRC-PG20_LightChain | 1270 | 22-41 | | |
| anti-HIV_VRC-PG20_HeavyChain | 1271 | 22-41 | | |
| anti-HIV_VRC-PG20_G-Chain | 1272 | 22-41 | | |
| anti-HIV_VRC02_LightChain | 1273 | 22-41 | 46-55 | 84-103 |
| anti-HIV_VRC02_HeavyChain | 1274 | 22-41 | | 94-113 |
| anti-HIV_VRC03_LightChain | 1275 | 22-41 | 47-56 | 85-103 |
| anti-HIV_VRC03_HeavyChain | 1276 | 22-41 | | |
| anti-HIV_VRC23_LightChain | 1277 | 22-41 | 48-57 | 86-105 |
| anti-HIV_VRC23_HeavyChain | 1278 | 22-41 | 93-102 | 94-113 |
| anti-HIV_VRC23_G-Chain | 1279 | 22-41 | | |
| anti-HIV_5CCK_LightChain | 1280 | 22-41 | 50-59 | 88-107 |
| anti-HIV_5CCK_HeavyChain | 1281 | 22-41 | | |
| anti-HIV_5AWN_LightChain | 1282 | 22-41 | 50-59 | 88-107 |
| anti-HIV_5AWN_HeavyChain | 1283 | 22-41 | | |
| anti-HIV_3QEG_LightChain | 1284 | 22-41 | 49-58 | 87-106 |
| anti-HIV_3QEG_HeavyChain | 1285 | 22-41 | | 94-113 |
| anti-HIV_1NOX_K-Chain | 1286 | 22-41 | | 94-113 |
| anti-HIV_1NOX_M-Chain | 1287 | 22-41 | | 87-106 |
| anti-HIV_3QEH_HeavyChain | 1288 | 22-41 | 53-62 | 91-110 |
| anti-HIV_3QEH_G-Chain | 1289 | 22-41 | 93-102 | 94-113 |
| anti-HIV_2B1H_HeavyChain | 1290 | 22-41 | | 94-113 |
| anti-HIV_2B1H_LightChain | 1291 | 22-41 | 49-58 | 87-106 |
| anti-HIV_3TNM_B-Chain | 1292 | 22-41 | | 88-107 |
| anti-HIV_3TNM_A-Chain | 1293 | 22-41 | | 95-114 |
| anti-HIV_3UJJ_HeavyChain | 1294 | 22-41 | 51-60 | 94-113 |
| anti-HIV_3UJJ_LightChain | 1295 | 22-41 | 47-56 | 85-104 |
| anti-HIV_3UJ1_HeavyChain | 1296 | 22-41 | | 94-113 |
| anti-HIV_3UJ1_LightChain | 1297 | 22-41 | 47-56 | 85-104 |
| anti-HIV_2QSC_HeavyChain | 1298 | 22-41 | | 94-113 |
| anti-HIV_2QSC_LightChain | 1299 | 22-41 | 48-57 | |
| anti-HIV_3MLZ_HeavyChain | 1300 | 22-41 | 51-60 | 93-112 |
| anti-HIV_3MLZ_LightChain | 1301 | 22-41 | 49-58 | 87-106 |
| anti-HIV_3MLX_I-Chain | 1302 | 22-41 | 51-60 | 93-112 |
| anti-HIV_3MLX_M-Chain | 1303 | 22-41 | 48-57 | 86-105 |
| anti-HIV_3MLW_I-Chain | 1304 | 22-41 | 51-60 | 94-113 |
| anti-HIV_3MLW_M-Chain | 1305 | 22-41 | | 87-108 |
| anti-HIV_3MLV_N-Chain | 1306 | 22-41 | 51-60 | |
| anti-HIV_3MLV_M-Chain | 1307 | 22-41 | | 85-104 |
| anti-HIV_3MLU_LightChain | 1308 | 22-41 | | 84-103 |
| anti-HIV_3MLT_G-Chain | 1309 | 22-41 | | 85-104 |
| anti-HIV_3G01_HeavyChain | 1310 | 22-41 | | 93-112 |
| anti-HIV_3G01_LightChain | 1311 | 22-41 | 47-56 | B5-104 |
| anti-HIV_4XCY_J-Chain | 1312 | 22-41 | | 94-113 |
| anti-HIV_4XCY_K-Chain | 1313 | 22-41 | 49-5B | 87-108 |
| anti-HIV_4YBL_C-Chain | 1314 | 22-41 | | 86-105 |
| anti-HIV_4YBL_B-Chain | 1315 | 22-41 | | 95-114 |
| anti-HIV_4R4N_X-Chain | 1316 | 22-41 | 48-57 | 86-105 |

TABLE 5-continued

CDRs of exemplified antibodies

| Name | Protein SEQ ID NO | CDR1 | CDR2 | CDR3 |
|---|---|---|---|---|
| anti-HIV__4R4B__F-Chain | 1317 | 22-41 | | |
| anti-HIV__3JUY__D-Chain | 1318 | 22-41 | | 94-113 |
| anti-HIV__4KG5__HeavyChain | 1319 | 22-41 | | 92-111 |
| anti-HIV__4KG5__LightChain | 1320 | 22-41 | 51-60 | 89-108 |
| anti-HIV-1__LightChain | 1321 | 22-41 | 48-57 | 86-103 |
| anti-HIV-1__LightChain | 1322 | 22-41 | 49-58 | 87-104 |
| anti-HIV-1__LightChain | 1323 | 22-41 | | |
| anti-HIV-1__LightChain | 1324 | 22-41 | 49-5B | 87-104 |
| anti-HIV-1__LightChain | 1325 | 22-41 | | 87-104 |
| anti-HIV-1__LightChain | 1326 | 22-41 | 49-58 | 87-104 |
| anti-HIV-1__HeavyChain | 1327 | 22-41 | 74-83 | 94-113 |
| anti-HIV-1__HeavyChain | 1328 | 22-41 | 74-83 | 94-113 |
| anti-HIV-1__HeavyChain | 1329 | 22-41 | | |
| anti-HIV-1__HeavyChain | 1330 | 22-41 | | 96-115 |
| anti-HIV-1__HeavyChain | 1331 | 22-41 | | 94-113 |
| anti-HIV-1__HeavyChain | 1332 | 22-41 | | 94-113 |
| anti-HIV-1__HeavyChain | 1333 | 22-41 | | |
| anti-HIV-1__HeavyChain | 1334 | 22-41 | | 94-113 |
| anti-HIV-1__HeavyChain | 1335 | 22-41 | | 93-112 |
| anti-HIV-1__HeavyChain | 1336 | 22-41 | | 94-113 |
| anti-HIV-1__LightChain | 1337 | 22-41 | 49-58 | 87-106 |
| anti-HIV-1__LightChain | 1338 | 22-41 | 49-58 | 87-106 |
| anti-HIV-1__LightChain | 1339 | 22-41 | 49-58 | 87-106 |
| anti-HIV-1__LightChain | 1340 | 22-41 | 49-58 | 87-106 |
| anti-HIV-1__LightChain | 1341 | 22-41 | 53-62 | 91-110 |
| anti-HIV-1__LightChain | 1342 | 22-41 | 48-57 | 86-105 |
| anti-HIV-1__LightChain | 1343 | 22-41 | | 89-108 |
| anti-HIV-1__LightChain | 1344 | 22-41 | | 89-108 |
| anti-HIV-1__HeavyChain | 1345 | 22-41 | | 99-118 |
| anti-HIV-1__HeavyChain | 1346 | 22-41 | | 99-118 |
| anti-HIV-1__HeavyChain | 1347 | 22-41 | | 99-118 |
| anti-HIV-1__HeavyChain | 1348 | 22-41 | | 97-118 |
| anti-HIV-1__HeavyChain | 1349 | 22-41 | 24-33 | 93-112 |
| anti-HIV-1__HeavyChain | 1350 | 22-41 | | 97-116 |
| anti-HIV-1__HeavyChain | 1351 | 22-41 | | |
| anti-HIV-1__HeavyChain | 1352 | 22-41 | | 94-113 |
| anti-HIV__V3__HeavyChain | 1353 | 22-41 | 51-60 | 94-113 |
| anti-HIV__V3__HeavyChain | 1354 | 22-41 | 51-60 | 94-113 |
| anti-HIV__V3__HeavyChain | 1355 | 22-41 | | 94-113 |
| anti-HIV__V3__HeavyChain | 1356 | 22-41 | | 93-112 |
| anti-HIV__V3__HeavyChain | 1357 | 22-41 | 51-60 | 94-113 |
| anti-HIV__V3__HeavyChain | 1358 | 22-41 | 51-60 | |
| anti-HIV__V3__HeavyChain | 1359 | 22-41 | | |
| anti-HIV__V3__HeavyChain | 1360 | 22-41 | | 94-113 |
| anti-HIV__V3__HeavyChain | 1361 | 22-41 | | 94-113 |
| anti-HIV__V3__HeavyChain | 1362 | 22-41 | | 94-113 |
| anti-HIV__V3__HeavyChain | 1363 | 22-41 | | 94-113 |
| anti-HIV__V3__HeavyChain | 1364 | 22-41 | | |
| anti-HIV__CD4bs__HeavyChain | 1365 | 22-41 | 58-67 | 94-113 |
| anti-HIV__CD4bs__HeavyChain | 1366 | 22-41 | | 94-113 |
| anti-HIV__CD4bs__HeavyChain | 1367 | 22-41 | | 93-112 |
| anti-HIV__CD4bs__HeavyChain | 1368 | 22-41 | 53-62 | |
| anti-HIV__CD4bs__HeavyChain | 1369 | 22-41 | | 96-115 |
| anti-HIV__CD4bs__HeavyChain | 1370 | 22-41 | | 94-113 |
| anti-HIV__CD4bs__HeavyChain | 1371 | 22-41 | | 94-113 |
| anti-HIV__CD4bs__HeavyChain | 1372 | 22-41 | | |
| anti-HIV__CD4bs__HeavyChain | 1373 | 22-41 | | |
| anti-HIV__CD4bs__HeavyChain | 1374 | 22-41 | | 94-113 |
| anti-HIV__V2__HeavyChain | 1375 | 22-41 | | 94-113 |
| anti-HIV__V2__HeavyChain | 1376 | 22-41 | | 94-113 |
| anti-HIV__V2__HeavyChain | 1377 | 22-41 | | 94-113 |
| anti-HIV__V2__HeavyChain | 1378 | 22-41 | | 93-112 |
| anti-HIV__V2__HeavyChain | 1379 | 22-41 | | 94-113 |
| anti-HIV__V2__HeavyChain | 1380 | 22-41 | | 94-113 |
| anti-HIV__V3__LightChain | 1381 | 22-41 | 47-56 | |
| anti-HIV__V3__LightChain | 1382 | 22-41 | | 85-104 |
| anti-HIV__V3__LightChain | 1383 | 22-41 | 49-58 | 87-106 |
| anti-HIV__V3__LightChain | 1384 | 22-41 | 91-100 | 92-111 |
| anti-HIV__V3__LightChain | 1385 | 22-41 | 47-56 | 85-104 |
| anti-HIV__V3__LightChain | 1386 | 22-41 | 49-58 | 87-106 |
| anti-HIV__V3__LightChain | 1387 | 22-41 | | 85-104 |
| anti-HIV__V3__LightChain | 1388 | 22-41 | 47-56 | 85-104 |
| anti-HIV__V3__LightChain | 1389 | 22-41 | 50-59 | 88-107 |
| anti-HIV__V3__LightChain | 1390 | 22-41 | 49-58 | 87-106 |
| anti-HIV__V3__LightChain | 1391 | 22-41 | | 86-105 |
| anti-HIV__V3__LightChain | 1392 | 22-41 | 85-94 | 86-105 |

TABLE 5-continued

CDRs of exemplified antibodies

| Name | Protein SEQ ID NO | CDR1 | CDR2 | CDR3 |
|---|---|---|---|---|
| anti-HIV_V3_LightChain | 1393 | 22-41 | | 85-104 |
| anti-HIV_V3_LightChain | 1394 | 22-41 | 48-57 | |
| anti-HIV_V3_LightChain | 1395 | 22-41 | 49-58 | 89-108 |
| anti-HIV_V3_LightChain | 1396 | 22-41 | 49-58 | 87-106 |
| anti-HIV_V3_LightChain | 1397 | 22-41 | | 85-104 |
| anti-HIV_V3_LightChain | 1398 | 22-41 | 49-58 | 87-106 |
| anti-HIV_V3_LightChain | 1399 | 22-41 | 53-62 | 91-110 |
| anti-HIV_V3_LightChain | 1400 | 22-41 | | 85-104 |
| anti-HIV_V3_LightChain | 1401 | 22-41 | 49-58 | |
| anti-HIV_V3_LightChain | 1402 | 22-41 | | |
| anti-HIV_V3_LightChain | 1403 | 22-41 | 47-56 | 85-104 |
| anti-HIV_V3_LightChain | 1404 | 22-41 | 48-57 | 86-105 |
| anti-HIV_V3_LightChain | 1405 | 22-41 | | 85-104 |
| anti-HIV_V3_LightChain | 1406 | 22-41 | 49-58 | |
| anti-HIV_V3_LightChain | 1407 | 22-41 | 48-57 | 86-105 |
| anti-HIV_V3_LightChain | 1408 | 22-41 | | 85-104 |
| anti-HIV_V3_LightChain | 1409 | 22-41 | 47-56 | 85-104 |
| anti-HIV_V3_LightChain | 1410 | 22-41 | 47-56 | 85-104 |
| anti-HIV_CD4bs_LightChain | 1411 | 22-41 | | 90-109 |
| anti-HIV_CD4bs_LightChain | 1412 | 22-41 | 49-58 | 87-106 |
| anti-HIV_CD4bs_LightChain | 1413 | 22-41 | 50-59 | 88-107 |
| anti-HIV_CD4bs_LightChain | 1414 | 22-41 | 36-45 | 91-110 |
| anti-HIV_CD4bs_LightChain | 1415 | 22-41 | 49-58 | 87-106 |
| anti-HIV_CD4bs_LightChain | 1416 | 22-41 | 49-58 | 89-108 |
| anti-HIV_CD4bs_LightChain | 1417 | 22-41 | 53-62 | 91-110 |
| anti-HIV_CD4bs_LightChain | 1418 | 22-41 | | 88-107 |
| anti-HIV_CD4bs_LightChain | 1419 | 22-41 | 29-38 | 86-105 |
| anti-HIV_CD4bs_LightChain | 1420 | 22-41 | | 88-107 |
| anti-HIV_V2_LightChain | 1421 | 22-41 | 48-57 | 86-105 |
| anti-HIV_V2_LightChain | 1422 | 22-41 | 48-57 | 86-105 |
| anti-HIV_V2_LightChain | 1423 | 22-41 | 50-59 | 88-107 |
| anti-HIV_V2_LightChain | 1424 | 22-41 | 48-57 | 86-105 |
| anti-HIV_V2_LightChain | 1425 | 22-41 | 49-58 | 87-106 |
| anti-HIV_V2_LightChain | 1426 | 22-41 | 48-57 | |
| anti-HIV_10E8 | 1427 | 22-41 | 47-56 | 85-104 |
| anti-HIV_10E8 | 1428 | 22-41 | 47-56 | 85-104 |
| anti-HIV_10E8 | 1429 | 22-41 | 47-56 | 85-104 |
| anti-HIV_10E8 | 1430 | 22-41 | 47-56 | 85-104 |
| anti-HIV_10E8 | 1431 | 22-41 | 47-56 | 85-104 |
| anti-HIV_10E8 | 1432 | 22-41 | 47-56 | 85-104 |
| anti-HIV_10E8 | 1433 | 22-41 | 47-56 | 85-104 |
| anti-HIV_10E8 | 1434 | 22-41 | 47-56 | 85-104 |
| anti-HIV_10E8 | 1435 | 22-41 | | 85-104 |
| anti-HIV_10E8 | 1436 | 22-41 | | 85-104 |
| anti-HIV_10E8 | 1437 | 22-41 | | 85-104 |
| anti-HIV_10E8 | 1438 | 22-41 | | 85-104 |
| anti-HIV_10E8 | 1439 | 22-41 | | 85-104 |
| anti-HIV_10E8 | 1440 | 22-41 | | 85-104 |
| anti-HIV_10E8 | 1441 | 22-41 | | 85-104 |
| anti-HIV_10E8 | 1442 | 22-41 | | 85-104 |
| anti-HIV_10E8 | 1443 | 22-41 | | 85-104 |
| anti-HIV_10E8 | 1444 | 22-41 | | 85-104 |
| anti-HIV_10E8 | 1445 | 22-41 | | 85-104 |
| anti-HIV_10E8 | 1446 | 22-41 | | |
| anti-HIV_10E8 | 1447 | 22-41 | | 85-104 |
| anti-HIV_10E8 | 1448 | 22-41 | | 85-104 |
| anti-HIV_10E8 | 1449 | 22-41 | | 96-115 |
| anti-HIV_10E8 | 1450 | 22-41 | | |
| anti-HIV_10E8 | 1451 | 22-41 | | |
| anti-HIV_10E8 | 1452 | 22-41 | | |
| anti-HIV_10E8 | 1453 | 22-41 | | |
| anti-HIV_10E8 | 1454 | 22-41 | | |
| anti-HIV_10E8 | 1455 | 22-41 | | |
| anti-HIV_10E8 | 1456 | 22-41 | | |
| anti-HIV_10E8 | 1457 | 22-41 | | |
| anti-HIV_10E8 | 1458 | 22-41 | | |
| anti-HIV-1_LightChain | 1459 | 22-41 | 49-58 | 87-106 |
| anti-HIV-1_LightChain | 1460 | 22-41 | 50-59 | 88-107 |
| anti-HIV-1_LightChain | 1461 | 22-41 | 45-54 | 83-102 |
| anti-HIV-1_LightChain | 1462 | 22-41 | 49-58 | 87-106 |
| anti-HIV-1_LightChain | 1463 | 22-41 | 49-58 | 87-106 |
| anti-HIV-1_LightChain | 1464 | 22-41 | | 87-106 |
| anti-HIV-1_LightChain | 1465 | 22-41 | 49-58 | 87-106 |
| anti-HIV-1_LightChain | 1466 | 22-41 | 49-58 | 87-106 |
| anti-HIV-1_LightChain | 1467 | 22-41 | 34-43 | 72-91 |
| anti-HIV-1_LightChain | 1468 | 22-41 | | 87-106 |

TABLE 5-continued

CDRs of exemplified antibodies

| Name | Protein SEQ ID NO | CDR1 | CDR2 | CDR3 |
|---|---|---|---|---|
| anti-HIV-1_LightChain | 1469 | 22-41 | 49-58 | 87-106 |
| anti-HIV-1_LightChain | 1470 | 22-41 | | 87-106 |
| anti-HIV-1_LightChain | 1471 | 22-41 | 50-59 | 88-107 |
| anti-HIV-1_LightChain | 1472 | 22-41 | | 87-106 |
| anti-HIV-1_LightChain | 1473 | 22-41 | 50-59 | 88-107 |
| anti-HIV-1_LightChain | 1474 | 22-41 | 49-58 | 87-106 |
| anti-HIV-1_LightChain | 1475 | 22-41 | 49-58 | 87-106 |
| anti-HIV-1_LightChain | 1476 | 22-41 | 49-58 | 87-106 |
| anti-HIV-1_LightChain | 1477 | 22-41 | 49-58 | 87-106 |
| anti-HIV-1_LightChain | 1478 | 22-41 | 49-58 | 87-106 |
| anti-HIV-1_LightChain | 1479 | 22-41 | 50-59 | 88-107 |
| anti-HIV-1_LightChain | 1480 | 22-41 | 49-58 | 87-106 |
| anti-HIV-1_LightChain | 1481 | 22-41 | | 87-106 |
| anti-HIV-1_LightChain | 1482 | 22-41 | 49-58 | 87-106 |
| anti-HIV-1_LightChain | 1483 | 22-41 | 49-58 | 87-106 |
| anti-HIV-1_LightChain | 1484 | 22-41 | 49-58 | 87-106 |
| anti-HIV-1_LightChain | 1485 | 22-41 | 50-59 | 88-107 |
| anti-HIV-1_LightChain | 1486 | 22-41 | 49-58 | 87-106 |
| anti-HIV-1_LightChain | 1487 | 22-41 | | 87-106 |
| anti-HIV-1_LightChain | 1488 | 22-41 | 49-58 | 87-106 |
| anti-HIV-1_LightChain | 1489 | 22-41 | 49-58 | 87-106 |
| anti-HIV-1_LightChain | 1490 | 22-41 | 49-58 | 87-106 |
| anti-HIV-1_LightChain | 1491 | 22-41 | | 87-106 |
| anti-HIV-1_LightChain | 1492 | 22-41 | 49-58 | 87-106 |
| anti-HIV-1_LightChain | 1493 | 22-41 | 49-58 | 87-106 |
| anti-HIV-1_LightChain | 1494 | 22-41 | 50-59 | 88-107 |
| anti-HIV-1_LightChain | 1495 | 22-41 | 49-58 | 87-106 |
| anti-HIV-1_LightChain | 1496 | 22-41 | 49-58 | 87-106 |
| anti-HIV-1_LightChain | 1497 | 22-41 | 49-58 | 87-106 |
| anti-HIV-1_LightChain | 1498 | 22-41 | 49-58 | 87-106 |
| anti-HIV-1_LightChain | 1499 | 22-41 | 49-58 | 87-106 |
| anti-HIV-1_LightChain | 1500 | 22-41 | 50-59 | 88-107 |
| anti-HIV-1_LightChain | 1501 | 22-41 | 49-58 | 87-106 |
| anti-HIV-1_LightChain | 1502 | 22-41 | 49-58 | 87-106 |
| anti-HIV-1_LightChain | 1503 | 22-41 | 50-59 | 88-107 |
| anti-HIV-1_LightChain | 1504 | 22-41 | 49-58 | 87-106 |
| anti-HIV-1_LightChain | 1505 | 22-41 | 49-58 | 87-106 |
| anti-HIV-1_LightChain | 1506 | 22-41 | 49-58 | 87-106 |
| anti-HIV-1_LightChain | 1507 | 22-41 | 49-58 | 87-106 |
| anti-HIV-1_LightChain | 1508 | 22-41 | 49-58 | 87-106 |
| anti-HIV-1_LightChain | 1509 | 22-41 | 49-58 | 87-106 |
| anti-HIV-1_LightChain | 1510 | 22-41 | 49-58 | 87-106 |
| anti-HIV-1_LightChain | 1511 | 22-41 | 50-59 | 88-107 |
| anti-HIV-1_LightChain | 1512 | 22-41 | 50-59 | 88-107 |
| anti-HIV-1_LightChain | 1513 | 22-41 | 49-58 | 87-106 |
| anti-HIV-1_LightChain | 1514 | 22-41 | 49-58 | 87-106 |
| anti-HIV-1_LightChain | 1515 | 22-41 | | 87-106 |
| anti-HIV-1_LightChain | 1516 | 22-41 | 49-58 | 87-106 |
| anti-HIV-1_LightChain | 1517 | 22-41 | 49-58 | 87-106 |
| anti-HIV-1_LightChain | 1518 | 22-41 | 49-58 | 87-106 |
| anti-HIV-1_LightChain | 1519 | 22-41 | 32-41 | 87-106 |
| anti-HIV-1_LightChain | 1520 | 22-41 | 49-58 | 87-106 |
| anti-HIV-1_LightChain | 1521 | 22-41 | 50-59 | 88-107 |
| anti-HIV-1_LightChain | 1522 | 22-41 | | 87-106 |
| anti-HIV-1_LightChain | 1523 | 22-41 | 49-58 | 87-106 |
| anti-HIV-1_LightChain | 1524 | 22-41 | 49-58 | 87-106 |
| anti-HIV-1_LightChain | 1525 | 22-41 | 50-59 | 88-107 |
| anti-HIV-1_LightChain | 1526 | 22-41 | | 87-106 |
| anti-HIV-1_LightChain | 1527 | 22-41 | 49-58 | 87-106 |
| anti-HIV-1_LightChain | 1528 | 22-41 | 49-58 | 87-106 |
| anti-HIV-1_LightChain | 1529 | 22-41 | | 87-106 |
| anti-HIV-1_LightChain | 1530 | 22-41 | | 87-106 |
| anti-HIV-1_LightChain | 1531 | 22-41 | 49-58 | 87-106 |
| anti-HIV-1_LightChain | 1532 | 22-41 | | 87-106 |
| anti-HIV-1_LightChain | 1533 | 22-41 | 49-58 | 87-106 |
| anti-HIV-1_LightChain | 1534 | 22-41 | 49-58 | 87-106 |
| anti-HIV-1_LightChain | 1535 | 22-41 | 49-58 | 87-106 |
| anti-HIV-1_LightChain | 1536 | 22-41 | 49-58 | 87-106 |
| anti-HIV-1_LightChain | 1537 | 22-41 | 49-58 | 87-106 |
| anti-HIV-1_LightChain | 1538 | 22-41 | 50-59 | 88-107 |
| anti-HIV-1_LightChain | 1539 | 22-41 | 50-59 | 88-107 |
| anti-HIV-1_LightChain | 1540 | 22-41 | | 87-106 |
| anti-HIV-1_LightChain | 1541 | 22-41 | 49-58 | 87-106 |
| anti-HIV-1_LightChain | 1542 | 22-41 | | 88-107 |
| anti-HIV-1_LightChain | 1543 | 22-41 | 49-58 | 87-106 |
| anti-HIV-1_LightChain | 1544 | 22-41 | 49-58 | 87-106 |

TABLE 5-continued

CDRs of exemplified antibodies

| Name | Protein SEQ ID NO | CDR1 | CDR2 | CDR3 |
|---|---|---|---|---|
| anti-HIV-1_LightChain | 1545 | 22-41 | 49-58 | 87-106 |
| anti-HIV-1_LightChain | 1546 | 22-41 | 49-58 | 87-106 |
| anti-HIV-1_LightChain | 1547 | 22-41 | | 87-106 |
| anti-HIV-1_LightChain | 1548 | 22-41 | | 87-106 |
| anti-HIV-1_LightChain | 1549 | 22-41 | 50-59 | 88-107 |
| anti-HIV-1_LightChain | 1550 | 22-41 | 49-58 | 87-106 |
| anti-HIV-1_LightChain | 1551 | 22-41 | 50-59 | 88-107 |
| anti-HIV-1_LightChain | 1552 | 22-41 | 49-58 | 87-106 |
| anti-HIV-1_LightChain | 1553 | 22-41 | | 87-106 |
| anti-HIV-1_LightChain | 1554 | 22-41 | 49-58 | 87-106 |
| anti-HIV-1_LightChain | 1555 | 22-41 | 50-59 | 88-107 |
| anti-HIV-1_LightChain | 1556 | 22-41 | 49-58 | 87-106 |
| anti-HIV-1_LightChain | 1557 | 22-41 | 49-58 | 87-106 |
| anti-HIV-1_LightChain | 1558 | 22-41 | 49-58 | 87-106 |
| anti-HIV-1_LightChain | 1559 | 22-41 | 49-58 | 87-106 |
| anti-HIV-1_LightChain | 1560 | 22-41 | 49-58 | 87-106 |
| anti-HIV-1_LightChain | 1561 | 22-41 | 49-58 | 87-106 |
| anti-HIV-1_LightChain | 1562 | 22-41 | 49-58 | 87-106 |
| anti-HIV-1_LightChain | 1563 | 22-41 | 49-58 | 87-106 |
| anti-HIV-1_LightChain | 1564 | 22-41 | 49-58 | 87-106 |
| anti-HIV-1_LightChain | 1565 | 22-41 | 49-58 | 87-106 |
| anti-HIV-1_LightChain | 1566 | 22-41 | 49-58 | 87-106 |
| anti-HIV-1_LightChain | 1567 | 22-41 | 49-58 | 87-106 |
| anti-HIV-1_LightChain | 1568 | 22-41 | 49-58 | 87-106 |
| anti-HIV-1_LightChain | 1569 | 22-41 | 45-54 | 83-102 |
| anti-HIV-1_LightChain | 1570 | 22-41 | 49-58 | 87-106 |
| anti-HIV-1_LightChain | 1571 | 22-41 | 49-58 | 87-106 |
| anti-HIV-1_LightChain | 1572 | 22-41 | 49-58 | 87-106 |
| anti-HIV-1_LightChain | 1573 | 22-41 | 50-59 | 88-107 |
| anti-HIV-1_LightChain | 1574 | 22-41 | 49-58 | 87-106 |
| anti-HIV-1_LightChain | 1575 | 22-41 | 49-58 | 87-106 |
| anti-HIV-1_LightChain | 1576 | 22-41 | 49-58 | 87-106 |
| anti-HIV-1_LightChain | 1577 | 22-41 | 49-58 | 87-106 |
| anti-HIV-1_LightChain | 1578 | 22-41 | 49-58 | 87-106 |
| anti-HIV-1_LightChain | 1579 | 22-41 | 32-41 | 87-106 |
| anti-HIV-1_LightChain | 1580 | 22-41 | 49-58 | 87-106 |
| anti-HIV-1_LightChain | 1581 | 22-41 | 49-58 | 87-106 |
| anti-HIV-1_LightChain | 1582 | 22-41 | 50-59 | 88-107 |
| anti-HIV-1_LightChain | 1583 | 22-41 | 49-58 | 87-106 |
| anti-HIV-1_LightChain | 1584 | 22-41 | | 88-107 |
| anti-HIV-1_LightChain | 1585 | 22-41 | 49-58 | 87-106 |
| anti-HIV-1_LightChain | 1586 | 22-41 | 49-58 | 87-106 |
| anti-HIV-1_LightChain | 1587 | 22-41 | 45-54 | 83-102 |
| anti-HIV-1_LightChain | 1588 | 22-41 | 49-58 | 87-106 |
| anti-HIV-1_LightChain | 1589 | 22-41 | 49-58 | 87-106 |
| anti-HIV-1_LightChain | 1590 | 22-41 | 49-58 | 87-106 |
| anti-HIV-1_LightChain | 1591 | 22-41 | | 88-107 |
| anti-HIV-1_LightChain | 1592 | 22-41 | 49-58 | 87-106 |
| anti-HIV-1_LightChain | 1593 | 22-41 | 49-58 | 87-106 |
| anti-HIV-1_LightChain | 1594 | 22-41 | 49-58 | 87-106 |
| anti-HIV-1_LightChain | 1595 | 22-41 | 49-58 | 87-106 |
| anti-HIV-1_LightChain | 1596 | 22-41 | 49-58 | 87-106 |
| anti-HIV-1_LightChain | 1597 | 22-41 | 49-58 | 87-106 |
| anti-HIV-1_LightChain | 1598 | 22-41 | | 88-107 |
| anti-HIV-1_LightChain | 1599 | 22-41 | 49-58 | 87-106 |
| anti-HIV-1_LightChain | 1600 | 22-41 | 49-58 | 87-106 |
| anti-HIV-1_LightChain | 1601 | 22-41 | | 87-106 |
| anti-HIV-1_LightChain | 1602 | 22-41 | 49-58 | 87-106 |
| anti-HIV-1_LightChain | 1603 | 22-41 | 49-58 | 87-106 |
| anti-HIV-1_LightChain | 1604 | 22-41 | 49-58 | 87-106 |
| anti-HIV-1_LightChain | 1605 | 22-41 | 49-58 | 87-106 |
| anti-HIV-1_LightChain | 1606 | 22-41 | 49-58 | 87-106 |
| anti-HIV-1_LightChain | 1607 | 22-41 | 49-58 | 87-106 |
| anti-HIV-1_LightChain | 1608 | 22-41 | 49-58 | 87-106 |
| anti-HIV-1_HeavyChain | 1609 | 22-41 | | 94-113 |
| anti-HIV-1_HeavyChain | 1610 | 22-41 | | 94-113 |
| anti-HIV-1_HeavyChain | 1611 | 22-41 | | 94-113 |
| anti-HIV-1_HeavyChain | 1612 | 22-41 | | 94-113 |
| anti-HIV-1_HeavyChain | 1613 | 22-41 | | |
| anti-HIV-1_HeavyChain | 1614 | 22-41 | | 94-113 |
| anti-HIV-1_HeavyChain | 1615 | 22-41 | 20-29 | 94-113 |
| anti-HIV-1_HeavyChain | 1616 | 22-41 | | 94-113 |
| anti-HIV-1_HeavyChain | 1617 | 22-41 | | |
| anti-HIV-1_HeavyChain | 1618 | 22-41 | | 94-113 |
| anti-HIV-1_HeavyChain | 1619 | 22-41 | | 94-113 |
| anti-HIV-1_HeavyChain | 1620 | 22-41 | 31-40 | 94-113 |

TABLE 5-continued

CDRs of exemplified antibodies

| Name | Protein SEQ ID NO | CDR1 | CDR2 | CDR3 |
|---|---|---|---|---|
| anti-HIV-1__HeavyChain | 1621 | 22-41 | | 94-113 |
| anti-HIV-1__HeavyChain | 1622 | 22-41 | | 94-113 |
| anti-HIV-1__HeavyChain | 1623 | 22-41 | | 94-113 |
| anti-HIV-1__HeavyChain | 1624 | 22-41 | | 94-113 |
| anti-HIV-1__HeavyChain | 1625 | 22-41 | | 94-113 |
| anti-HIV-1__HeavyChain | 1626 | 22-41 | | 94-113 |
| anti-HIV-1__HeavyChain | 1627 | 22-41 | | |
| anti-HIV-1__HeavyChain | 1628 | 22-41 | | |
| anti-HIV-1__HeavyChain | 1629 | 22-41 | | 94-113 |
| anti-HIV-1__HeavyChain | 1630 | 22-41 | | 94-113 |
| anti-HIV-1__HeavyChain | 1631 | 22-41 | | 94-113 |
| anti-HIV-1__HeavyChain | 1632 | 22-41 | | 94-113 |
| anti-HIV-1__HeavyChain | 1633 | 22-41 | | |
| anti-HIV-1__HeavyChain | 1634 | 22-41 | | 94-113 |
| anti-HIV-1__HeavyChain | 1635 | 22-41 | | 94-113 |
| anti-HIV-1__HeavyChain | 1636 | 22-41 | | 94-113 |
| anti-HIV-1__HeavyChain | 1637 | 22-41 | | 94-113 |
| anti-HIV-1__HeavyChain | 1638 | 22-41 | | 94-113 |
| anti-HIV-1__HeavyChain | 1639 | 22-41 | | 94-113 |
| anti-HIV-1__HeavyChain | 1640 | 22-41 | | 94-113 |
| anti-HIV-1__HeavyChain | 1641 | 22-41 | | 93-112 |
| anti-HIV-1__HeavyChain | 1642 | 22-41 | | 94-113 |
| anti-HIV-1__HeavyChain | 1643 | 22-41 | | 94-113 |
| anti-HIV-1__HeavyChain | 1644 | 22-41 | | 94-113 |
| anti-HIV-1__HeavyChain | 1645 | 22-41 | | 94-113 |
| anti-HIV-1__HeavyChain | 1646 | 22-41 | | 94-113 |
| anti-HIV-1__HeavyChain | 1647 | 22-41 | 20-29 | 94-113 |
| anti-HIV-1__HeavyChain | 1648 | 22-41 | | 94-113 |
| anti-HIV-1__HeavyChain | 1649 | 22-41 | | |
| anti-HIV-1__HeavyChain | 1650 | 22-41 | | 94-113 |
| anti-HIV-1__HeavyChain | 1651 | 22-41 | | 94-113 |
| anti-HIV-1__HeavyChain | 1652 | 22-41 | | 94-113 |
| anti-HIV-1__HeavyChain | 1653 | 22-41 | | 94-113 |
| anti-HIV-1__HeavyChain | 1654 | 22-41 | | 94-113 |
| anti-HIV-1__HeavyChain | 1655 | 22-41 | | 94-113 |
| anti-HIV__C38-VRC18.02__HeavyChain | 1656 | 22-41 | | |
| anti-HIV__44-VRC13.02__HeavyChain | 1657 | 22-41 | | |
| anti-HIV-1__LightChain | 1658 | 22-41 | | 86-105 |
| anti-HIV-1__LightChain | 1659 | 22-41 | | 86-105 |
| anti-HIV-1__LightChain | 1660 | 22-41 | 48-57 | 86-105 |
| anti-HIV-1__LightChain | 1661 | 22-41 | 48-57 | |
| anti-HIV-1__LightChain | 1662 | 22-41 | 48-57 | |
| anti-HIV-1__LightChain | 1663 | 22-41 | 48-57 | |
| anti-HIV-1__LightChain | 1664 | 22-41 | 48-57 | |
| anti-HIV-1__HeavyChain | 1665 | 22-41 | | |
| anti-HIV-1__HeavyChain | 1666 | 22-41 | | |
| anti-HIV-1__HeavyChain | 1667 | 22-41 | | 94-113 |
| anti-HIV-1__HeavyChain | 1668 | 22-41 | 93-102 | |
| anti-HIV-1__HeavyChain | 1669 | 22-41 | | |
| anti-HIV-1__HeavyChain | 1670 | 22-41 | 93-102 | 94-113 |
| anti-HIV-1__HeavyChain | 1671 | 22-41 | 93-102 | 94-113 |
| anti-HIV__45__LightChain | 1672 | 22-41 | 44-53 | 82-101 |
| anti-HIV__45__LightChain | 1673 | 22-41 | 44-53 | 82-101 |
| anti-HIV__45__LightChain | 1674 | 22-41 | 44-53 | 82-101 |
| anti-HIV__45__HeavyChain | 1675 | 22-41 | | |
| anti-HIV__45__HeavyChain | 1676 | 22-41 | | |
| anti-HIV__45__HeavyChain | 1677 | 22-41 | | |
| anti-HIV__cap256-206-252885__VR-Chain | 1678 | 22-41 | | 94-113 |
| anti-HIV__cap256-206-249183__VR-Chain | 1679 | 22-41 | | |
| anti-HIV__cap256-206-220956__VR-Chain | 1680 | 22-41 | | |
| anti-HIV__cap256-206-220629__VR-Chain | 1681 | 22-41 | | 94-113 |
| anti-HIV__cap256-206-200599__VR-Chain | 1682 | 22-41 | | 82-101 |
| anti-HIV__cap256-206-186347__VR-Chain | 1683 | 22-41 | | |
| anti-HIV__cap256-206-186226__VR-Chain | 1684 | 22-41 | | |
| anti-HIV__cap256-206-179686__VR-Chain | 1685 | 22-41 | | |
| anti-HIV__cap256-206-173707__VR-Chain | 1686 | 22-41 | | 94-113 |
| anti-HIV__cap256-206-173339__VR-Chain | 1687 | 22-41 | | 94-113 |
| anti-HIV__cap256-206-172689__VR-Chain | 1688 | 22-41 | | |
| anti-HIV__cap256-206-162744__VR-Chain | 1689 | 22-41 | | 94-113 |
| anti-HIV__cap256-206-146057__VR-Chain | 1690 | 22-41 | | |
| anti-HIV__cap256-206-139519__VR-Chain | 1691 | 22-41 | | 94-113 |
| anti-HIV__cap256-206-136316__VR-Chain | 1692 | 22-41 | | |
| anti-HIV__cap256-206-116098__VR-Chain | 1693 | 22-41 | | |
| anti-HIV__cap256-206-115862__VR-Chain | 1694 | 22-41 | | 94-113 |
| anti-HIV__cap256-206-107018__VR-Chain | 1695 | 22-41 | | 94-113 |
| anti-HIV__cap256-206-098644__VR-Chain | 1696 | 22-41 | | |

TABLE 5-continued

CDRs of exemplified antibodies

| Name | Protein SEQ ID NO | CDR1 | CDR2 | CDR3 |
|---|---|---|---|---|
| anti-HIV__cap256-206-098135__VR-Chain | 1697 | 22-41 | 70-79 | 94-113 |
| anti-HIV__cap256-206-096276__VR-Chain | 1698 | 22-41 | | 94-113 |
| anti-HIV__cap256-206-092794__VR-Chain | 1699 | 22-41 | | |
| anti-HIV__cap256-206-086817__VR-Chain | 1700 | 22-41 | | 94-113 |
| anti-HIV__cap256-206-086446__VR-Chain | 1701 | 22-41 | | 94-113 |
| anti-HIV__cap256-206-086180__VR-Chain | 1702 | 22-41 | | |
| anti-HIV__cap256-206-083708__VR-Chain | 1703 | 22-41 | | 94-113 |
| anti-HIV__cap256-206-079556__VR-Chain | 1704 | 22-41 | | 94-113 |
| anti-HIV__cap256-206-078657__VR-Chain | 1705 | 22-41 | | |
| anti-HIV__cap256-206-075802__VR-Chain | 1706 | 22-41 | | |
| anti-HIV__cap256-206-069097__VR-Chain | 1707 | 22-41 | | |
| anti-HIV__cap256-206-067758__VR-Chain | 1708 | 22-41 | | |
| anti-HIV__cap256-206-057019__VR-Chain | 1709 | 22-41 | 70-79 | 94-113 |
| anti-HIV__cap256-206-055385__VR-Chain | 1710 | 22-41 | | |
| anti-HIV__cap256-206-053187__VR-Chain | 1711 | 22-41 | | 94-113 |
| anti-HIV__cap256-206-053139__VR-Chain | 1712 | 22-41 | | |
| anti-HIV__cap256-206-050350__VR-Chain | 1713 | 22-41 | | |
| anti-HIV__cap256-206-046207__VR-Chain | 1714 | 22-41 | | 94-113 |
| anti-HIV__cap256-206-043389__VR-Chain | 1715 | 22-41 | | |
| anti-HIV__cap256-206-042555__VR-Chain | 1716 | 22-41 | | 94-113 |
| anti-HIV__cap256-206-029720__VR-Chain | 1717 | 22-41 | | |
| anti-HIV__cap256-206-028848__VR-Chain | 1718 | 22-41 | | 94-113 |
| anti-HIV__cap256-206-027652__VR-Chain | 1719 | 22-41 | | 94-113 |
| anti-HIV__cap256-206-024075__VR-Chain | 1720 | 22-41 | 93-102 | 94-113 |
| anti-HIV__cap256-206-008748__VR-Chain | 1721 | 22-41 | | 94-113 |
| anti-HIV__cap256-206-008530__VR-Chain | 1722 | 22-41 | | 94-113 |
| anti-HIV__cap256-176-723043__VR-Chain | 1723 | 22-41 | | 94-113 |
| anti-HIV__cap256-176-600049__VR-Chain | 1724 | 22-41 | | |
| anti-HIV__cap256-176-531926__VR-Chain | 1725 | 22-41 | | 94-113 |
| anti-HIV__cap256-176-504134__VR-Chain | 1726 | 22-41 | | 94-113 |
| anti-HIV__cap256-119-186229__VR-Chain | 1727 | 22-41 | | 94-113 |
| anti-HIV__cap256-119-183891__VR-Chain | 1728 | 22-41 | | |
| anti-HIV__cap256-119-183631__VR-Chain | 1729 | 22-41 | | 94-113 |
| anti-HIV__cap256-119-182676__VR-Chain | 1730 | 22-41 | | 94-113 |
| anti-HIV__cap256-119-180772__VR-Chain | 1731 | 22-41 | | 94-113 |
| anti-HIV__cap256-119-180508__VR-Chain | 1732 | 22-41 | | 94-113 |
| anti-HIV__cap256-119-180260__VR-Chain | 1733 | 22-41 | | 94-113 |
| anti-HIV__cap256-119-180173__VR-Chain | 1734 | 22-41 | | 94-113 |
| anti-HIV__cap256-119-179839__VR-Chain | 1735 | 22-41 | | 94-113 |
| anti-HIV__cap256-119-179262__VR-Chain | 1736 | 22-41 | | |
| anti-HIV__cap256-119-178995__VR-Chain | 1737 | 22-41 | | 94-113 |
| anti-HIV__cap256-119-178455__VR-Chain | 1738 | 22-41 | | |
| anti-HIV__cap256-119-177993__VR-Chain | 1739 | 22-41 | 20-29 | |
| anti-HIV__cap256-119-177727__VR-Chain | 1740 | 22-41 | | |
| anti-HIV__cap256-119-176746__VR-Chain | 1741 | 22-41 | | 94-113 |
| anti-HIV__cap256-119-176241__VR-Chain | 1742 | 22-41 | | 94-113 |
| anti-HIV__cap256-119-175215__VR-Chain | 1743 | 22-41 | | 94-113 |
| anti-HIV__cap256-119-173928__VR-Chain | 1744 | 22-41 | | 94-113 |
| anti-HIV__cap256-119-173495__VR-Chain | 1745 | 22-41 | | 94-113 |
| anti-HIV__cap256-119-172882__VR-Chain | 1746 | 22-41 | | 94-113 |
| anti-HIV__cap256-119-172429__VR-Chain | 1747 | 22-41 | | 94-113 |
| anti-HIV__cap256-119-172223__VR-Chain | 1748 | 22-41 | | |
| anti-HIV__cap256-119-171838__VR-Chain | 1749 | 22-41 | | 94-113 |
| anti-HIV__cap256-119-171587__VR-Chain | 1750 | 22-41 | | 94-113 |
| anti-HIV__cap256-119-169596__VR-Chain | 1751 | 22-41 | | 94-113 |
| anti-HIV__cap256-119-169523__VR-Chain | 1752 | 22-41 | | 94-113 |
| anti-HIV__cap256-119-169462__VR-Chain | 1753 | 22-41 | | 94-113 |
| anti-HIV__cap256-119-169092__VR-Chain | 1754 | 22-41 | | |
| anti-HIV__cap256-119-168680__VR-Chain | 1755 | 22-41 | | |
| anti-HIV__cap256-119-166385__VR-Chain | 1756 | 22-41 | | |
| anti-HIV__cap256-119-165943__VR-Chain | 1757 | 22-41 | | 94-113 |
| anti-HIV__cap256-119-165738__VR-Chain | 1758 | 22-41 | | 94-113 |
| anti-HIV__cap256-119-164913__VR-Chain | 1759 | 22-41 | | 94-113 |
| anti-HIV__cap256-119-164167__VR-Chain | 1760 | 22-41 | | |
| anti-HIV__cap256-119-163558__VR-Chain | 1761 | 22-41 | | 94-113 |
| anti-HIV__cap256-119-162043__VR-Chain | 1762 | 22-41 | | 94-113 |
| anti-HIV__cap256-119-161718__VR-Chain | 1763 | 22-41 | | 94-113 |
| anti-HIV__cap256-119-161675__VR-Chain | 1764 | 22-41 | 31-40 | 94-113 |
| anti-HIV__cap256-119-161053__VR-Chain | 1765 | 22-41 | | 94-113 |
| anti-HIV__cap256-119-159499__VR-Chain | 1766 | 22-41 | | 94-113 |
| anti-HIV__cap256-119-159114__VR-Chain | 1767 | 22-41 | | 94-113 |
| anti-HIV__cap256-119-156751__VR-Chain | 1768 | 22-41 | | |
| anti-HIV__cap256-119-155656__VR-Chain | 1769 | 22-41 | | 94-113 |
| anti-HIV__cap256-119-154420__VR-Chain | 1770 | 22-41 | | 94-113 |
| anti-HIV__cap256-119-153954__VR-Chain | 1771 | 22-41 | | 94-113 |
| anti-HIV__cap256-119-153864__VR-Chain | 1772 | 22-41 | | |

TABLE 5-continued

CDRs of exemplified antibodies

| Name | Protein SEQ ID NO | CDR1 | CDR2 | CDR3 |
|---|---|---|---|---|
| anti-HIV__cap256-119-153793__VR-Chain | 1773 | 22-41 | | 94-113 |
| anti-HIV__cap256-119-153462__VR-Chain | 1774 | 22-41 | | 94-113 |
| anti-HIV__cap256-119-153124__VR-Chain | 1775 | 22-41 | | |
| anti-HIV__cap256-119-153025__VR-Chain | 1776 | 22-41 | | |
| anti-HIV__cap256-119-152713__VR-Chain | 1777 | 22-41 | | 94-113 |
| anti-HIV__cap256-119-151794__VR-Chain | 1778 | 22-41 | | |
| anti-HIV__cap256-119-150980__VR-Chain | 1779 | 22-41 | | |
| anti-HIV__cap256-119-148895__VR-Chain | 1780 | 22-41 | | 94-113 |
| anti-HIV__cap256-119-148848__VR-Chain | 1781 | 22-41 | | |
| anti-HIV__cap256-119-148743__VR-Chain | 1782 | 22-41 | | |
| anti-HIV__cap256-119-148595__VR-Chain | 1783 | 22-41 | | |
| anti-HIV__cap256-119-148490__VR-Chain | 1784 | 22-41 | | 94-113 |
| anti-HIV__cap256-119-148470__VR-Chain | 1785 | 22-41 | | |
| anti-HIV__cap256-119-148107__VR-Chain | 1786 | 22-41 | | 94-113 |
| anti-HIV__cap256-119-147933__VR-Chain | 1787 | 22-41 | | 94-113 |
| anti-HIV__cap256-119-147434__VR-Chain | 1788 | 22-41 | | 94-113 |
| anti-HIV__cap256-119-146106__VR-Chain | 1789 | 22-41 | | 94-113 |
| anti-HIV__cap256-119-145604__VR-Chain | 1790 | 22-41 | | |
| anti-HIV__cap256-119-143998__VR-Chain | 1791 | 22-41 | | |
| anti-HIV__cap256-119-143441__VR-Chain | 1792 | 22-41 | | |
| anti-HIV__cap256-119-141307__VR-Chain | 1793 | 22-41 | | 94-113 |
| anti-HIV__cap256-119-140896__VR-Chain | 1794 | 22-41 | | |
| anti-HIV__cap256-119-140090__VR-Chain | 1795 | 22-41 | | 94-113 |
| anti-HIV__cap256-119-140037__VR-Chain | 1796 | 22-41 | | |
| anti-HIV__cap256-119-139135__VR-Chain | 1797 | 22-41 | | |
| anti-HIV__cap256-119-137881__VR-Chain | 1798 | 22-41 | | |
| anti-HIV__cap256-119-137643__VR-Chain | 1799 | 22-41 | | 94-113 |
| anti-HIV__cap256-119-137170__VR-Chain | 1800 | 22-41 | | |
| anti-HIV__cap256-119-136616__VR-Chain | 1801 | 22-41 | | 94-113 |
| anti-HIV__cap256-119-136206__VR-Chain | 1802 | 22-41 | | 94-113 |
| anti-HIV__cap256-119-135565__VR-Chain | 1803 | 22-41 | | |
| anti-HIV__cap256-119-135025__VR-Chain | 1804 | 22-41 | | 94-113 |
| anti-HIV__cap256-119-133983__VR-Chain | 1805 | 22-41 | | 94-113 |
| anti-HIV__cap256-119-133917__VR-Chain | 1806 | 22-41 | | |
| anti-HIV__cap256-119-132663__VR-Chain | 1807 | 22-41 | | 94-113 |
| anti-HIV__cap256-119-132113__VR-Chain | 1808 | 22-41 | | |
| anti-HIV__cap256-119-131839__VR-Chain | 1809 | 22-41 | | 94-113 |
| anti-HIV__cap256-119-130626__VR-Chain | 1810 | 22-41 | | 94-113 |
| anti-HIV__cap256-119-130191__VR-Chain | 1811 | 22-41 | | |
| anti-HIV__cap256-119-129798__VR-Chain | 1812 | 22-41 | | |
| anti-HIV__cap256-119-128745__VR-Chain | 1813 | 22-41 | | 94-113 |
| anti-HIV__cap256-119-128593__VR-Chain | 1814 | 22-41 | | |
| anti-HIV__cap256-119-128152__VR-Chain | 1815 | 22-41 | | |
| anti-HIV__cap256-119-127693__VR-Chain | 1816 | 22-41 | | |
| anti-HIV__cap256-119-126684__VR-Chain | 1817 | 22-41 | | 94-113 |
| anti-HIV__cap256-119-126056__VR-Chain | 1818 | 22-41 | | |
| anti-HIV__cap256-119-125765__VR-Chain | 1819 | 22-41 | | 94-113 |
| anti-HIV__cap256-119-125106__VR-Chain | 1820 | 22-41 | | |
| anti-HIV__cap256-119-124026__VR-Chain | 1821 | 22-41 | | 94-113 |
| anti-HIV__cap256-119-121783__VR-Chain | 1822 | 22-41 | | |
| anti-HIV__cap256-119-121208__VR-Chain | 1823 | 22-41 | | 94-113 |
| anti-HIV__cap256-119-120945__VR-Chain | 1824 | 22-41 | | |
| anti-HIV__cap256-119-118229__VR-Chain | 1825 | 22-41 | | 94-113 |
| anti-HIV__cap256-119-118025__VR-Chain | 1826 | 22-41 | | |
| anti-HIV__cap256-119-117418__VR-Chain | 1827 | 22-41 | | |
| anti-HIV__cap256-119-117250__VR-Chain | 1828 | 22-41 | | 94-113 |
| anti-HIV__cap256-119-117230__VR-Chain | 1829 | 22-41 | | 94-113 |
| anti-HIV__cap256-119-116999__VR-Chain | 1830 | 22-41 | | |
| anti-HIV__cap256-119-116558__VR-Chain | 1831 | 22-41 | | 94-113 |
| anti-HIV__cap256-119-116484__VR-Chain | 1832 | 22-41 | | 94-113 |
| anti-HIV__cap256-119-114844__VR-Chain | 1833 | 22-41 | | |
| anti-HIV__cap256-119-114141__VR-Chain | 1834 | 22-41 | | |
| anti-HIV__cap256-119-111917__VR-Chain | 1835 | 22-41 | | 94-113 |
| anti-HIV__cap256-119-111862__VR-Chain | 1836 | 22-41 | | 94-113 |
| anti-HIV__cap256-119-110064__VR-Chain | 1837 | 22-41 | | 94-113 |
| anti-HIV__cap256-119-109192__VR-Chain | 1838 | 22-41 | | 94-113 |
| anti-HIV__cap256-119-108793__VR-Chain | 1839 | 22-41 | | |
| anti-HIV__cap256-119-108127__VR-Chain | 1840 | 22-41 | | 94-113 |
| anti-HIV__cap256-119-107758__VR-Chain | 1841 | 22-41 | | |
| anti-HIV__cap256-119-107209__VR-Chain | 1842 | 22-41 | | |
| anti-HIV__cap256-119-107184__VR-Chain | 1843 | 22-41 | | |
| anti-HIV__cap256-119-106827__VR-Chain | 1844 | 22-41 | | |
| anti-HIV__cap256-119-106511__VR-Chain | 1845 | 22-41 | | 94-113 |
| anti-HIV__cap256-119-106327__VR-Chain | 1846 | 22-41 | | 94-113 |
| anti-HIV__cap256-119-105486__VR-Chain | 1847 | 22-41 | | |
| anti-HIV__cap256-119-105197__VR-Chain | 1848 | 22-41 | | 94-113 |

TABLE 5-continued

CDRs of exemplified antibodies

| Name | Protein SEQ ID NO | CDR1 | CDR2 | CDR3 |
|---|---|---|---|---|
| anti-HIV__cap256-119-104946__VR-Chain | 1849 | 22-41 | | 94-113 |
| anti-HIV__cap256-119-103667__VR-Chain | 1850 | 22-41 | | 94-113 |
| anti-HIV__cap256-119-103385__VR-Chain | 1851 | 22-41 | | |
| anti-HIV__cap256-119-103267__VR-Chain | 1852 | 22-41 | | |
| anti-HIV__cap256-119-103011__VR-Chain | 1853 | 22-41 | | 94-113 |
| anti-HIV__cap256-119-102072__VR-Chain | 1854 | 22-41 | | |
| anti-HIV__cap256-119-101945__VR-Chain | 1855 | 22-41 | | |
| anti-HIV__cap256-119-101319__VR-Chain | 1856 | 22-41 | | |
| anti-HIV__cap256-119-100871__VR-Chain | 1857 | 22-41 | | 94-113 |
| anti-HIV__cap256-119-100838__VR-Chain | 1858 | 22-41 | | 94-113 |
| anti-HIV__cap256-119-100025__VR-Chain | 1859 | 22-41 | | |
| anti-HIV__cap256-119-100000__VR-Chain | 1860 | 22-41 | | |
| anti-HIV__cap256-119-098890__VR-Chain | 1861 | 22-41 | | 94-113 |
| anti-HIV__cap256-119-098715__VR-Chain | 1862 | 22-41 | | 94-113 |
| anti-HIV__cap256-119-098632__VR-Chain | 1863 | 22-41 | | |
| anti-HIV__cap256-119-097199__VR-Chain | 1864 | 22-41 | | |
| anti-HIV__cap256-119-096189__VR-Chain | 1865 | 22-41 | | |
| anti-HIV__cap256-119-094581__VR-Chain | 1866 | 22-41 | | 94-113 |
| anti-HIV__cap256-119-094200__VR-Chain | 1867 | 22-41 | | 94-113 |
| anti-HIV__cap256-119-094158__VR-Chain | 1868 | 22-41 | | |
| anti-HIV__cap256-119-092814__VR-Chain | 1869 | 22-41 | | |
| anti-HIV__cap256-119-092808__VR-Chain | 1870 | 22-41 | | |
| anti-HIV__cap256-119-092573__VR-Chain | 1871 | 22-41 | | 94-113 |
| anti-HIV__cap256-119-090815__VR-Chain | 1872 | 22-41 | | |
| anti-HIV__cap256-119-090368__VR-Chain | 1873 | 22-41 | | |
| anti-HIV__cap256-119-089710__VR-Chain | 1874 | 22-41 | | |
| anti-HIV__cap256-119-088555__VR-Chain | 1875 | 22-41 | | 94-113 |
| anti-HIV__cap256-119-087962__VR-Chain | 1876 | 22-41 | | 94-113 |
| anti-HIV__cap256-119-086903__VR-Chain | 1877 | 22-41 | | 94-113 |
| anti-HIV__cap256-119-086804__VR-Chain | 1878 | 22-41 | | 94-113 |
| anti-HIV__cap256-119-085910__VR-Chain | 1879 | 22-41 | | |
| anti-HIV__cap256-119-085772__VR-Chain | 1880 | 22-41 | | 94-113 |
| anti-HIV__cap256-119-084603__VR-Chain | 1881 | 22-41 | | 94-113 |
| anti-HIV__cap256-119-084276__VR-Chain | 1882 | 22-41 | | |
| anti-HIV__cap256-119-082288__VR-Chain | 1883 | 22-41 | | 94-113 |
| anti-HIV__cap256-119-080383__VR-Chain | 1884 | 22-41 | | 94-113 |
| anti-HIV__cap256-119-079333__VR-Chain | 1885 | 22-41 | | |
| anti-HIV__cap256-119-078618__VR-Chain | 1886 | 22-41 | | |
| anti-HIV__cap256-119-077466__VR-Chain | 1887 | 22-41 | | 94-113 |
| anti-HIV__cap256-119-076284__VR-Chain | 1888 | 22-41 | | |
| anti-HIV__cap256-119-074680__VR-Chain | 1889 | 22-41 | | 94-113 |
| anti-HIV__cap256-119-074081__VR-Chain | 1890 | 22-41 | | 94-113 |
| anti-HIV__cap256-119-071704__VR-Chain | 1891 | 22-41 | | |
| anti-HIV__cap256-119-071266__VR-Chain | 1892 | 22-41 | | 94-113 |
| anti-HIV__cap256-119-069667__VR-Chain | 1893 | 22-41 | | 94-113 |
| anti-HIV__cap256-119-069591__VR-Chain | 1894 | 22-41 | | 94-113 |
| anti-HIV__cap256-119-068691__VR-Chain | 1895 | 22-41 | | 94-113 |
| anti-HIV__cap256-119-068488__VR-Chain | 1896 | 22-41 | | 94-113 |
| anti-HIV__cap256-119-067536__VR-Chain | 1897 | 22-41 | | |
| anti-HIV__cap256-119-065852__VR-Chain | 1898 | 22-41 | | 94-113 |
| anti-HIV__cap256-119-065457__VR-Chain | 1899 | 22-41 | | 94-113 |
| anti-HIV__cap256-119-064501__VR-Chain | 1900 | 22-41 | | |
| anti-HIV__cap256-119-063568__VR-Chain | 1901 | 22-41 | | 94-113 |
| anti-HIV__cap256-119-063103__VR-Chain | 1902 | 22-41 | | 94-113 |
| anti-HIV__cap256-119-061027__VR-Chain | 1903 | 22-41 | | 94-113 |
| anti-HIV__cap256-119-058232__VR-Chain | 1904 | 22-41 | | 94-113 |
| anti-HIV__cap256-119-057341__VR-Chain | 1905 | 22-41 | | 94-113 |
| anti-HIV__cap256-119-056895__VR-Chain | 1906 | 22-41 | | |
| anti-HIV__cap256-119-056402__VR-Chain | 1907 | 22-41 | | |
| anti-HIV__cap256-119-056034__VR-Chain | 1908 | 22-41 | | 94-113 |
| anti-HIV__cap256-119-055042__VR-Chain | 1909 | 22-41 | | 94-113 |
| anti-HIV__cap256-119-054776__VR-Chain | 1910 | 22-41 | | |
| anti-HIV__cap256-119-054539__VR-Chain | 1911 | 22-41 | | |
| anti-HIV__cap256-119-054112__VR-Chain | 1912 | 22-41 | | 94-113 |
| anti-HIV__cap256-119-053339__VR-Chain | 1913 | 22-41 | 93-102 | 94-113 |
| anti-HIV__cap256-119-052404__VR-Chain | 1914 | 22-41 | | |
| anti-HIV__cap256-119-051123__VR-Chain | 1915 | 22-41 | | 94-113 |
| anti-HIV__cap256-119-051077__VR-Chain | 1916 | 22-41 | | |
| anti-HIV__cap256-119-050442__VR-Chain | 1917 | 22-41 | | 94-113 |
| anti-HIV__cap256-119-049433__VR-Chain | 1918 | 22-41 | | 94-113 |
| anti-HIV__cap256-119-047532__VR-Chain | 1919 | 22-41 | | 94-113 |
| anti-HIV__cap256-119-047489__VR-Chain | 1920 | 22-41 | | 94-113 |
| anti-HIV__cap256-119-046020__VR-Chain | 1921 | 22-41 | | |
| anti-HIV__cap256-119-044746__VR-Chain | 1922 | 22-41 | | 94-113 |
| anti-HIV__cap256-119-044740__VR-Chain | 1923 | 22-41 | | |
| anti-HIV__cap256-119-043790__VR-Chain | 1924 | 22-41 | | 94-113 |

TABLE 5-continued

CDRs of exemplified antibodies

| Name | Protein SEQ ID NO | CDR1 | CDR2 | CDR3 |
|---|---|---|---|---|
| anti-HIV__cap256-119-042880__VR-Chain | 1925 | 22-41 | | 94-113 |
| anti-HIV__cap256-119-042606__VR-Chain | 1926 | 22-41 | | 94-113 |
| anti-HIV__cap256-119-042444__VR-Chain | 1927 | 22-41 | | |
| anti-HIV__cap256-119-040328__VR-Chain | 1928 | 22-41 | | 94-113 |
| anti-HIV__cap256-119-040164__VR-Chain | 1929 | 22-41 | | |
| anti-HIV__cap256-119-039130__VR-Chain | 1930 | 22-41 | | |
| anti-HIV__cap256-119-038138__VR-Chain | 1931 | 22-41 | | |
| anti-HIV__cap256-119-037868__VR-Chain | 1932 | 22-41 | | |
| anti-HIV__cap256-119-037102__VR-Chain | 1933 | 22-41 | | 94-113 |
| anti-HIV__cap256-119-036683__VR-Chain | 1934 | 22-41 | | |
| anti-HIV__cap256-119-036495__VR-Chain | 1935 | 22-41 | | |
| anti-HIV__cap256-119-035375__VR-Chain | 1936 | 22-41 | | |
| anti-HIV__cap256-119-035165__VR-Chain | 1937 | 22-41 | | |
| anti-HIV__cap256-119-035109__VR-Chain | 1938 | 22-41 | | 94-113 |
| anti-HIV__cap256-119-033789__VR-Chain | 1939 | 22-41 | | 63-82 |
| anti-HIV__cap256-119-033641__VR-Chain | 1940 | 22-41 | | |
| anti-HIV__cap256-119-032113__VR-Chain | 1941 | 22-41 | | 94-113 |
| anti-HIV__cap256-119-031739__VR-Chain | 1942 | 22-41 | | 94-113 |
| anti-HIV__cap256-119-030932__VR-Chain | 1943 | 22-41 | | 94-113 |
| anti-HIV__cap256-119-030740__VR-Chain | 1944 | 22-41 | | |
| anti-HIV__cap256-119-030197__VR-Chain | 1945 | 22-41 | | 94-113 |
| anti-HIV__cap256-119-027047__VR-Chain | 1946 | 22-41 | | |
| anti-HIV__cap256-119-026950__VR-Chain | 1947 | 22-41 | | 94-113 |
| anti-HIV__cap256-119-026279__VR-Chain | 1948 | 22-41 | | |
| anti-HIV__cap256-119-025355__VR-Chain | 1949 | 22-41 | | |
| anti-HIV__cap256-119-025301__VR-Chain | 1950 | 22-41 | | 94-113 |
| anti-HIV__cap256-119-025010__VR-Chain | 1951 | 22-41 | | |
| anti-HIV__cap256-119-024631__VR-Chain | 1952 | 22-41 | | |
| anti-HIV__cap256-119-024467__VR-Chain | 1953 | 22-41 | | 94-113 |
| anti-HIV__cap256-119-023805__VR-Chain | 1954 | 22-41 | | 94-113 |
| anti-HIV__cap256-119-021736__VR-Chain | 1955 | 22-41 | | 94-113 |
| anti-HIV__cap256-119-021203__VR-Chain | 1956 | 22-41 | | |
| anti-HIV__cap256-119-020569__VR-Chain | 1957 | 22-41 | | 94-113 |
| anti-HIV__cap256-119-019432__VR-Chain | 1958 | 22-41 | | 94-113 |
| anti-HIV__cap256-119-018827__VR-Chain | 1959 | 22-41 | | 94-113 |
| anti-HIV__cap256-119-018483__VR-Chain | 1960 | 22-41 | | |
| anti-HIV__cap256-119-018118__VR-Chain | 1961 | 22-41 | | 94-113 |
| anti-HIV__cap256-119-017782__VR-Chain | 1962 | 22-41 | | |
| anti-HIV__cap256-119-017669__VR-Chain | 1963 | 22-41 | | 94-113 |
| anti-HIV__cap256-119-016976__VR-Chain | 1964 | 22-41 | | 94-113 |
| anti-HIV__cap256-119-015432__VR-Chain | 1965 | 22-41 | | 94-113 |
| anti-HIV__cap256-119-015281__VR-Chain | 1966 | 22-41 | | 94-113 |
| anti-HIV__cap256-119-014957__VR-Chain | 1967 | 22-41 | | 94-113 |
| anti-HIV__cap256-119-014777__VR-Chain | 1968 | 22-41 | | 94-113 |
| anti-HIV__cap256-119-014313__VR-Chain | 1969 | 22-41 | | |
| anti-HIV__cap256-119-014219__VR-Chain | 1970 | 22-41 | | |
| anti-HIV__cap256-119-013631__VR-Chain | 1971 | 22-41 | | |
| anti-HIV__cap256-119-012924__VR-Chain | 1972 | 22-41 | | |
| anti-HIV__cap256-119-011793__VR-Chain | 1973 | 22-41 | | 94-113 |
| anti-HIV__cap256-119-011413__VR-Chain | 1974 | 22-41 | | 94-113 |
| anti-HIV__cap256-119-011323__VR-Chain | 1975 | 22-41 | | 94-113 |
| anti-HIV__cap256-119-011233__VR-Chain | 1976 | 22-41 | | 94-113 |
| anti-HIV__cap256-119-009038__VR-Chain | 1977 | 22-41 | | 94-113 |
| anti-HIV__cap256-119-008756__VR-Chain | 1978 | 22-41 | | 94-113 |
| anti-HIV__cap256-119-008055__VR-Chain | 1979 | 22-41 | | |
| anti-HIV__cap256-119-006949__VR-Chain | 1980 | 22-41 | | 94-113 |
| anti-HIV__cap256-119-006685__VR-Chain | 1981 | 22-41 | | |
| anti-HIV__cap256-119-006015__VR-Chain | 1982 | 22-41 | | 94-113 |
| anti-HIV__cap256-119-005841__VR-Chain | 1983 | 22-41 | | 94-113 |
| anti-HIV__cap256-119-005824__VR-Chain | 1984 | 22-41 | | 94-113 |
| anti-HIV__cap256-119-005494__VR-Chain | 1985 | 22-41 | | 94-113 |
| anti-HIV__cap256-119-004949__VR-Chain | 1986 | 22-41 | | |
| anti-HIV__cap256-119-004422__VR-Chain | 1987 | 22-41 | | 94-113 |
| anti-HIV__cap256-119-003932__VR-Chain | 1988 | 22-41 | | |
| anti-HIV__cap256-119-003577__VR-Chain | 1989 | 22-41 | | |
| anti-HIV__cap256-119-002155__VR-Chain | 1990 | 22-41 | | 94-113 |
| anti-HIV__cap256-119-002017__VR-Chain | 1991 | 22-41 | | |
| anti-HIV__cap256-119-001312__VR-Chain | 1992 | 22-41 | | 94-113 |
| anti-HIV__cap256-119-001017__VR-Chain | 1993 | 22-41 | | |
| anti-HIV__cap256-119-000594__VR-Chain | 1994 | 22-41 | | 94-113 |
| anti-HIV__cap256-059-241099__VR-Chain | 1995 | 22-41 | | 94-113 |
| anti-HIV__cap256-059-207529__VR-Chain | 1996 | 22-41 | | 94-113 |
| anti-HIV__cap256-059-205541__VR-Chain | 1997 | 22-41 | | 94-113 |
| anti-HIV__cap256-059-188439__VR-Chain | 1998 | 22-41 | | 94-113 |
| anti-HIV__cap256-059-187234__VR-Chain | 1999 | 22-41 | | 94-113 |
| anti-HIV__cap256-059-187047__VR-Chain | 2000 | 22-41 | | 94-113 |

TABLE 5-continued

CDRs of exemplified antibodies

| Name | Protein SEQ ID NO | CDR1 | CDR2 | CDR3 |
| --- | --- | --- | --- | --- |
| anti-HIV__cap256-059-186068__VR-Chain | 2001 | 22-41 | | 94-113 |
| anti-HIV__cap256-059-182835__VR-Chain | 2002 | 22-41 | | 94-113 |
| anti-HIV__cap256-059-176659__VR-Chain | 2003 | 22-41 | | 94-113 |
| anti-HIV__cap256-059-172956__VR-Chain | 2004 | 22-41 | | 94-113 |
| anti-HIV__cap256-059-171272__VR-Chain | 2005 | 22-41 | | 94-113 |
| anti-HIV__cap256-059-168734__VR-Chain | 2006 | 22-41 | | 94-113 |
| anti-HIV__cap256-059-155838__VR-Chain | 2007 | 22-41 | | 94-113 |
| anti-HIV__cap256-059-149799__VR-Chain | 2008 | 22-41 | | 94-113 |
| anti-HIV__cap256-059-148168__VR-Chain | 2009 | 22-41 | | |
| anti-HIV__cap256-059-144685__VR-Chain | 2010 | 22-41 | | 94-113 |
| anti-HIV__cap256-059-140017__VR-Chain | 2011 | 22-41 | | 94-113 |
| anti-HIV__cap256-059-137547__VR-Chain | 2012 | 22-41 | | 94-113 |
| anti-HIV__cap256-059-131908__VR-Chain | 2013 | 22-41 | | 94-113 |
| anti-HIV__cap256-059-116006__VR-Chain | 2014 | 22-41 | | 94-113 |
| anti-HIV__cap256-059-115783__VR-Chain | 2015 | 22-41 | | 87-106 |
| anti-HIV__cap256-059-114609__VR-Chain | 2016 | 22-41 | | |
| anti-HIV__cap256-059-113952__VR-Chain | 2017 | 22-41 | | 94-113 |
| anti-HIV__cap256-059-113878__VR-Chain | 2018 | 22-41 | | 94-113 |
| anti-HIV__cap256-059-113622__VR-Chain | 2019 | 22-41 | | 94-113 |
| anti-HIV__cap256-059-109427__VR-Chain | 2020 | 22-41 | | 94-113 |
| anti-HIV__cap256-059-109081__VR-Chain | 2021 | 22-41 | | 94-113 |
| anti-HIV__cap256-059-107590__VR-Chain | 2022 | 22-41 | | 94-113 |
| anti-HIV__cap256-059-107504__VR-Chain | 2023 | 22-41 | | 94-113 |
| anti-HIV__cap256-059-099614__VR-Chain | 2024 | 22-41 | | 94-113 |
| anti-HIV__cap256-059-098972__VR-Chain | 2025 | 22-41 | | 94-113 |
| anti-HIV__cap256-059-097236__VR-Chain | 2026 | 22-41 | | 94-113 |
| anti-HIV__cap256-059-091487__VR-Chain | 2027 | 22-41 | | 94-113 |
| anti-HIV__cap256-059-089812__VR-Chain | 2028 | 22-41 | | 94-113 |
| anti-HIV__cap256-059-088468__VR-Chain | 2029 | 22-41 | | 94-113 |
| anti-HIV__cap256-059-088341__VR-Chain | 2030 | 22-41 | | 94-113 |
| anti-HIV__cap256-059-086533__VR-Chain | 2031 | 22-41 | | 94-113 |
| anti-HIV__cap256-059-086043__VR-Chain | 2032 | 22-41 | 93-102 | 94-113 |
| anti-HIV__cap256-059-084191__VR-Chain | 2033 | 22-41 | | 94-113 |
| anti-HIV__cap256-059-082135__VR-Chain | 2034 | 22-41 | | 94-113 |
| anti-HIV__cap256-059-079417__VR-Chain | 2035 | 22-41 | | 94-113 |
| anti-HIV__cap256-059-076027__VR-Chain | 2036 | 22-41 | 93-102 | 94-113 |
| anti-HIV__cap256-059-075082__VR-Chain | 2037 | 22-41 | | 94-113 |
| anti-HIV__cap256-059-072575__VR-Chain | 2038 | 22-41 | | 94-113 |
| anti-HIV__cap256-059-071926__VR-Chain | 2039 | 22-41 | | 94-113 |
| anti-HIV__cap256-059-069638__VR-Chain | 2040 | 22-41 | | 94-113 |
| anti-HIV__cap256-059-069165__VR-Chain | 2041 | 22-41 | | 94-113 |
| anti-HIV__cap256-059-068956__VR-Chain | 2042 | 22-41 | | 94-113 |
| anti-HIV__cap256-059-068876__VR-Chain | 2043 | 22-41 | | 94-113 |
| anti-HIV__cap256-059-067733__VR-Chain | 2044 | 22-41 | | 94-113 |
| anti-HIV__cap256-059-067450__VR-Chain | 2045 | 22-41 | | 94-113 |
| anti-HIV__cap256-059-065694__VR-Chain | 2046 | 22-41 | | 94-113 |
| anti-HIV__cap256-059-065109__VR-Chain | 2047 | 22-41 | | 94-113 |
| anti-HIV__cap256-059-065060__VR-Chain | 2048 | 22-41 | | |
| anti-HIV__cap256-059-064001__VR-Chain | 2049 | 22-41 | | 94-113 |
| anti-HIV__cap256-059-063270__VR-Chain | 2050 | 22-41 | | 94-113 |
| anti-HIV__cap256-059-061357__VR-Chain | 2051 | 22-41 | 58-67 | |
| anti-HIV__cap256-059-059834__VR-Chain | 2052 | 22-41 | | 94-113 |
| anti-HIV__cap256-059-059313__VR-Chain | 2053 | 22-41 | | 94-113 |
| anti-HIV__cap256-059-057130__VR-Chain | 2054 | 22-41 | | 94-113 |
| anti-HIV__cap256-059-050520__VR-Chain | 2055 | 22-41 | | 87-106 |
| anti-HIV__cap256-059-049839__VR-Chain | 2056 | 22-41 | | 94-113 |
| anti-HIV__cap256-059-048503__VR-Chain | 2057 | 22-41 | | 94-113 |
| anti-HIV__cap256-059-045516__VR-Chain | 2058 | 22-41 | | 94-113 |
| anti-HIV__cap256-059-044188__VR-Chain | 2059 | 22-41 | | 94-113 |
| anti-HIV__cap256-059-044105__VR-Chain | 2060 | 22-41 | 93-102 | 94-113 |
| anti-HIV__cap256-059-042100__VR-Chain | 2061 | 22-41 | | |
| anti-HIV__cap256-059-040742__VR-Chain | 2062 | 22-41 | | 94-113 |
| anti-HIV__cap256-059-040554__VR-Chain | 2063 | 22-41 | | 94-113 |
| anti-HIV__cap256-059-039660__VR-Chain | 2064 | 22-41 | | 94-113 |
| anti-HIV__cap256-059-039298__VR-Chain | 2065 | 22-41 | | 94-113 |
| anti-HIV__cap256-059-037873__VR-Chain | 2066 | 22-41 | | 94-113 |
| anti-HIV__cap256-059-037633__VR-Chain | 2067 | 22-41 | | 94-113 |
| anti-HIV__cap256-059-036817__VR-Chain | 2068 | 22-41 | | 94-113 |
| anti-HIV__cap256-059-032787__VR-Chain | 2069 | 22-41 | | 94-113 |
| anti-HIV__cap256-059-032427__VR-Chain | 2070 | 22-41 | | 94-113 |
| anti-HIV__cap256-059-029390__VR-Chain | 2071 | 22-41 | | 94-113 |
| anti-HIV__cap256-059-027877__VR-Chain | 2072 | 22-41 | | 94-113 |
| anti-HIV__cap256-059-026640__VR-Chain | 2073 | 22-41 | 93-102 | 94-113 |
| anti-HIV__cap256-059-026017__VR-Chain | 2074 | 22-41 | | |
| anti-HIV__cap256-059-024100__VR-Chain | 2075 | 22-41 | | 94-113 |
| anti-HIV__cap256-059-023966__VR-Chain | 2076 | 22-41 | | 94-113 |

TABLE 5-continued

CDRs of exemplified antibodies

| Name | Protein SEQ ID NO | CDR1 | CDR2 | CDR3 |
| --- | --- | --- | --- | --- |
| anti-HIV__cap256-059-020534__VR-Chain | 2077 | 22-41 | | 94-113 |
| anti-HIV__cap256-059-019513__VR-Chain | 2078 | 22-41 | | 94-113 |
| anti-HIV__cap256-059-012963__VR-Chain | 2079 | 22-41 | | 94-113 |
| anti-HIV__cap256-059-010396__VR-Chain | 2080 | 22-41 | | 94-113 |
| anti-HIV__cap256-059-008136__VR-Chain | 2081 | 22-41 | | |
| anti-HIV__cap256-059-006147__VR-Chain | 2082 | 22-41 | | 94-113 |
| anti-HIV__cap256-059-005081__VR-Chain | 2083 | 22-41 | | 94-113 |
| anti-HIV__cap256-059-005006__VR-Chain | 2084 | 22-41 | | 94-113 |
| anti-HIV__cap256-059-004451__VR-Chain | 2085 | 22-41 | | 94-113 |
| anti-HIV__cap256-059-003571__VR-Chain | 2086 | 22-41 | | 94-113 |
| anti-HIV__cap256-059-003449__VR-Chain | 2087 | 22-41 | | 94-113 |
| anti-HIV__cap256-059-002712__VR-Chain | 2088 | 22-41 | | 94-113 |
| anti-HIV__cap256-059-001573__VR-Chain | 2089 | 22-41 | | 94-113 |
| anti-HIV__cap256-059-001379__VR-Chain | 2090 | 22-41 | | 94-113 |
| anti-HIV__cap256-059-001029__VR-Chain | 2091 | 22-41 | | 94-113 |
| anti-HIV__cap256-048-165087__VR-Chain | 2092 | 22-41 | | 94-113 |
| anti-HIV__cap256-048-158861__VR-Chain | 2093 | 22-41 | | 94-113 |
| anti-HIV__cap256-048-158280__VR-Chain | 2094 | 22-41 | 20-29 | 94-113 |
| anti-HIV__cap256-048-157928__VR-Chain | 2095 | 22-41 | | 94-113 |
| anti-HIV__cap256-048-157056__VR-Chain | 2096 | 22-41 | | 94-113 |
| anti-HIV__cap256-048-156422__VR-Chain | 2097 | 22-41 | | 94-113 |
| anti-HIV__cap256-048-152863__VR-Chain | 2098 | 22-41 | | 94-113 |
| anti-HIV__cap256-048-152770__VR-Chain | 2099 | 22-41 | | 94-113 |
| anti-HIV__cap256-048-150027__VR-Chain | 2100 | 22-41 | | 94-113 |
| anti-HIV__cap256-048-148246__VR-Chain | 2101 | 22-41 | | 94-113 |
| anti-HIV__cap256-048-147428__VR-Chain | 2102 | 22-41 | | 94-113 |
| anti-HIV__cap256-048-146603__VR-Chain | 2103 | 22-41 | | |
| anti-HIV__cap256-048-145735__VR-Chain | 2104 | 22-41 | | 94-113 |
| anti-HIV__cap256-048-145116__VR-Chain | 2105 | 22-41 | | 94-113 |
| anti-HIV__cap256-048-144077__VR-Chain | 2106 | 22-41 | | 94-113 |
| anti-HIV__cap256-048-142876__VR-Chain | 2107 | 22-41 | | |
| anti-HIV__cap256-048-140582__VR-Chain | 2108 | 22-41 | | 94-113 |
| anti-HIV__cap256-048-139355__VR-Chain | 2109 | 22-41 | | 94-113 |
| anti-HIV__cap256-048-139151__VR-Chain | 2110 | 22-41 | | 94-113 |
| anti-HIV__cap256-048-137672__VR-Chain | 2111 | 22-41 | | 94-113 |
| anti-HIV__cap256-048-137506__VR-Chain | 2112 | 22-41 | | 94-113 |
| anti-HIV__cap256-048-137270__VR-Chain | 2113 | 22-41 | | 94-113 |
| anti-HIV__cap256-048-135447__VR-Chain | 2114 | 22-41 | | 94-113 |
| anti-HIV__cap256-048-131966__VR-Chain | 2115 | 22-41 | | 94-113 |
| anti-HIV__cap256-048-131008__VR-Chain | 2116 | 22-41 | | 94-113 |
| anti-HIV__cap256-048-129369__VR-Chain | 2117 | 22-41 | | 94-113 |
| anti-HIV__cap256-048-128476__VR-Chain | 2118 | 22-41 | | 94-113 |
| anti-HIV__cap256-048-128270__VR-Chain | 2119 | 22-41 | | 94-113 |
| anti-HIV__cap256-048-126220__VR-Chain | 2120 | 22-41 | | 94-113 |
| anti-HIV__cap256-048-125713__VR-Chain | 2121 | 22-41 | | 94-113 |
| anti-HIV__cap256-048-123934__VR-Chain | 2122 | 22-41 | | 94-113 |
| anti-HIV__cap256-048-122673__VR-Chain | 2123 | 22-41 | | 94-113 |
| anti-HIV__cap256-048-122208__VR-Chain | 2124 | 22-41 | | 94-113 |
| anti-HIV__cap256-048-121552__VR-Chain | 2125 | 22-41 | | 94-113 |
| anti-HIV__cap256-048-120643__VR-Chain | 2126 | 22-41 | | 94-113 |
| anti-HIV__cap256-048-118458__VR-Chain | 2127 | 22-41 | | |
| anti-HIV__cap256-048-118112__VR-Chain | 2128 | 22-41 | | 94-113 |
| anti-HIV__cap256-048-116469__VR-Chain | 2129 | 22-41 | | 94-113 |
| anti-HIV__cap256-048-113917__VR-Chain | 2130 | 22-41 | | 94-113 |
| anti-HIV__cap256-048-112368__VR-Chain | 2131 | 22-41 | | 94-113 |
| anti-HIV__cap256-048-112047__VR-Chain | 2132 | 22-41 | | 94-113 |
| anti-HIV__cap256-048-112029__VR-Chain | 2133 | 22-41 | | 94-113 |
| anti-HIV__cap256-048-110957__VR-Chain | 2134 | 22-41 | | 94-113 |
| anti-HIV__cap256-048-110526__VR-Chain | 2135 | 22-41 | | 94-113 |
| anti-HIV__cap256-048-109336__VR-Chain | 2136 | 22-41 | | 94-113 |
| anti-HIV__cap256-048-108152__VR-Chain | 2137 | 22-41 | | 94-113 |
| anti-HIV__cap256-048-107799__VR-Chain | 2138 | 22-41 | | 94-113 |
| anti-HIV__cap256-048-107384__VR-Chain | 2139 | 22-41 | | 94-113 |
| anti-HIV__cap256-048-106530__VR-Chain | 2140 | 22-41 | | 94-113 |
| anti-HIV__cap256-048-106464__VR-Chain | 2141 | 22-41 | | 94-113 |
| anti-HIV__cap256-048-106411__VR-Chain | 2142 | 22-41 | | |
| anti-HIV__cap256-048-106306__VR-Chain | 2143 | 22-41 | | 94-113 |
| anti-HIV__cap256-048-104496__VR-Chain | 2144 | 22-41 | | 94-113 |
| anti-HIV__cap256-048-103074__VR-Chain | 2145 | 22-41 | | 94-113 |
| anti-HIV__cap256-048-100832__VR-Chain | 2146 | 22-41 | | 94-113 |
| anti-HIV__cap256-048-100188__VR-Chain | 2147 | 22-41 | 20-29 | 94-113 |
| anti-HIV__cap256-048-099645__VR-Chain | 2148 | 22-41 | | |
| anti-HIV__cap256-048-098137__VR-Chain | 2149 | 22-41 | | 94-113 |
| anti-HIV__cap256-048-097878__VR-Chain | 2150 | 22-41 | | 94-113 |
| anti-HIV__cap256-048-097510__VR-Chain | 2151 | 22-41 | | 94-113 |
| anti-HIV__cap256-048-097313__VR-Chain | 2152 | 22-41 | | 94-113 |

TABLE 5-continued

CDRs of exemplified antibodies

| Name | Protein SEQ ID NO | CDR1 | CDR2 | CDR3 |
|---|---|---|---|---|
| anti-HIV__cap256-048-096626__VR-Chain | 2153 | 22-41 | | 94-113 |
| anti-HIV__cap256-048-096483__VR-Chain | 2154 | 22-41 | | 94-113 |
| anti-HIV__cap256-048-095691__VR-Chain | 2155 | 22-41 | | 94-113 |
| anti-HIV__cap256-048-095525__VR-Chain | 2156 | 22-41 | | 94-113 |
| anti-HIV__cap256-048-094783__VR-Chain | 2157 | 22-41 | | 94-113 |
| anti-HIV__cap256-048-094356__VR-Chain | 2158 | 22-41 | | 94-113 |
| anti-HIV__cap256-048-090756__VR-Chain | 2159 | 22-41 | | 94-113 |
| anti-HIV__cap256-048-089065__VR-Chain | 2160 | 22-41 | | 94-113 |
| anti-HIV__cap256-048-084986__VR-Chain | 2161 | 22-41 | | 94-113 |
| anti-HIV__cap256-048-083355__VR-Chain | 2162 | 22-41 | | 94-113 |
| anti-HIV__cap256-048-082462__VR-Chain | 2163 | 22-41 | | 94-113 |
| anti-HIV__cap256-048-082246__VR-Chain | 2164 | 22-41 | | 94-113 |
| anti-HIV__cap256-048-080752__VR-Chain | 2165 | 22-41 | | 94-113 |
| anti-HIV__cap256-048-078409__VR-Chain | 2166 | 22-41 | | 94-113 |
| anti-HIV__cap256-048-078273__VR-Chain | 2167 | 22-41 | | |
| anti-HIV__cap256-048-078062__VR-Chain | 2168 | 22-41 | | 94-113 |
| anti-HIV__cap256-048-077798__VR-Chain | 2169 | 22-41 | | |
| anti-HIV__cap256-048-073853__VR-Chain | 2170 | 22-41 | | 94-113 |
| anti-HIV__cap256-048-071661__VR-Chain | 2171 | 22-41 | | |
| anti-HIV__cap256-048-071360__VR-Chain | 2172 | 22-41 | | 94-113 |
| anti-HIV__cap256-048-070955__VR-Chain | 2173 | 22-41 | | |
| anti-HIV__cap256-048-070061__VR-Chain | 2174 | 22-41 | | 94-113 |
| anti-HIV__cap256-048-069669__VR-Chain | 2175 | 22-41 | | 94-113 |
| anti-HIV__cap256-048-069205__VR-Chain | 2176 | 22-41 | | 94-113 |
| anti-HIV__cap256-048-068882__VR-Chain | 2177 | 22-41 | | 94-113 |
| anti-HIV__cap256-048-067764__VR-Chain | 2178 | 22-41 | | 94-113 |
| anti-HIV__cap256-048-066845__VR-Chain | 2179 | 22-41 | | 94-113 |
| anti-HIV__cap256-048-065226__VR-Chain | 2180 | 22-41 | | 94-113 |
| anti-HIV__cap256-048-063717__VR-Chain | 2181 | 22-41 | 59-68 | |
| anti-HIV__cap256-048-063150__VR-Chain | 2182 | 22-41 | | 94-113 |
| anti-HIV__cap256-048-062431__VR-Chain | 2183 | 22-41 | | 94-113 |
| anti-HIV__cap256-048-060745__VR-Chain | 2184 | 22-41 | | 94-113 |
| anti-HIV__cap256-048-060420__VR-Chain | 2185 | 22-41 | | 94-113 |
| anti-HIV__cap256-048-060014__VR-Chain | 2186 | 22-41 | 93-102 | 94-113 |
| anti-HIV__cap256-048-059747__VR-Chain | 2187 | 22-41 | | 94-113 |
| anti-HIV__cap256-048-058393__VR-Chain | 2188 | 22-41 | | 94-113 |
| anti-HIV__cap256-048-058159__VR-Chain | 2189 | 22-41 | | 94-113 |
| anti-HIV__cap256-048-057127__VR-Chain | 2190 | 22-41 | | 94-113 |
| anti-HIV__cap256-048-056251__VR-Chain | 2191 | 22-41 | | 94-113 |
| anti-HIV__cap256-048-055421__VR-Chain | 2192 | 22-41 | | 94-113 |
| anti-HIV__cap256-048-054989__VR-Chain | 2193 | 22-41 | | 94-113 |
| anti-HIV__cap256-048-054759__VR-Chain | 2194 | 22-41 | | 94-113 |
| anti-HIV__cap256-048-052573__VR-Chain | 2195 | 22-41 | | 94-113 |
| anti-HIV__cap256-048-051477__VR-Chain | 2196 | 22-41 | | 94-113 |
| anti-HIV__cap256-048-051299__VR-Chain | 2197 | 22-41 | | 94-113 |
| anti-HIV__cap256-048-050815__VR-Chain | 2198 | 22-41 | | 94-113 |
| anti-HIV__cap256-048-049884__VR-Chain | 2199 | 22-41 | | 94-113 |
| anti-HIV__cap256-048-049170__VR-Chain | 2200 | 22-41 | | 94-113 |
| anti-HIV__cap256-048-048531__VR-Chain | 2201 | 22-41 | | 94-113 |
| anti-HIV__cap256-048-048259__VR-Chain | 2202 | 22-41 | | 94-113 |
| anti-HIV__cap256-048-047313__VR-Chain | 2203 | 22-41 | | 94-113 |
| anti-HIV__cap256-048-046596__VR-Chain | 2204 | 22-41 | | 94-113 |
| anti-HIV__cap256-048-044781__VR-Chain | 2205 | 22-41 | | 94-113 |
| anti-HIV__cap256-048-042599__VR-Chain | 2206 | 22-41 | | 94-113 |
| anti-HIV__cap256-048-041276__VR-Chain | 2207 | 22-41 | | 94-113 |
| anti-HIV__cap256-048-040200__VR-Chain | 2208 | 22-41 | | 94-113 |
| anti-HIV__cap256-048-039061__VR-Chain | 2209 | 22-41 | 93-102 | |
| anti-HIV__cap256-048-038515__VR-Chain | 2210 | 22-41 | | 94-113 |
| anti-HIV__cap256-048-038255__VR-Chain | 2211 | 22-41 | | 94-113 |
| anti-HIV__cap256-048-038177__VR-Chain | 2212 | 22-41 | 93-102 | |
| anti-HIV__cap256-048-035513__VR-Chain | 2213 | 22-41 | | 94-113 |
| anti-HIV__cap256-048-034112__VR-Chain | 2214 | 22-41 | | 94-113 |
| anti-HIV__cap256-048-033983__VR-Chain | 2215 | 22-41 | | 94-113 |
| anti-HIV__cap256-048-032688__VR-Chain | 2216 | 22-41 | | 94-113 |
| anti-HIV__cap256-048-031092__VR-Chain | 2217 | 22-41 | | 94-113 |
| anti-HIV__cap256-048-030464__VR-Chain | 2218 | 22-41 | | 94-113 |
| anti-HIV__cap256-048-030289__VR-Chain | 2219 | 22-41 | | 94-113 |
| anti-HIV__cap256-048-030261__VR-Chain | 2220 | 22-41 | | |
| anti-HIV__cap256-048-029362__VR-Chain | 2221 | 22-41 | | 94-113 |
| anti-HIV__cap256-048-027638__VR-Chain | 2222 | 22-41 | | |
| anti-HIV__cap256-048-027613__VR-Chain | 2223 | 22-41 | | 94-113 |
| anti-HIV__cap256-048-026627__VR-Chain | 2224 | 22-41 | | 94-113 |
| anti-HIV__cap256-048-026239__VR-Chain | 2225 | 22-41 | | 94-113 |
| anti-HIV__cap256-048-025518__VR-Chain | 2226 | 22-41 | | 94-113 |
| anti-HIV__cap256-048-024854__VR-Chain | 2227 | 22-41 | | 94-113 |
| anti-HIV__cap256-048-024537__VR-Chain | 2228 | 22-41 | | 94-113 |

TABLE 5-continued

CDRs of exemplified antibodies

| Name | Protein SEQ ID NO | CDR1 | CDR2 | CDR3 |
|---|---|---|---|---|
| anti-HIV__cap256-048-021781__VR-Chain | 2229 | 22-41 | | 94-113 |
| anti-HIV__cap256-048-021758__VR-Chain | 2230 | 22-41 | | 94-113 |
| anti-HIV__cap256-048-020988__VR-Chain | 2231 | 22-41 | | 94-113 |
| anti-HIV__cap256-048-020663__VR-Chain | 2232 | 22-41 | | |
| anti-HIV__cap256-048-020590__VR-Chain | 2233 | 22-41 | | 94-113 |
| anti-HIV__cap256-048-019765__VR-Chain | 2234 | 22-41 | | 94-113 |
| anti-HIV__cap256-048-019254__VR-Chain | 2235 | 22-41 | | |
| anti-HIV__cap256-048-018073__VR-Chain | 2236 | 22-41 | | 94-113 |
| anti-HIV__cap256-048-016775__VR-Chain | 2237 | 22-41 | | 94-113 |
| anti-HIV__cap256-048-016069__VR-Chain | 2238 | 22-41 | | 94-113 |
| anti-HIV__cap256-048-015867__VR-Chain | 2239 | 22-41 | | |
| anti-HIV__cap256-048-015673__VR-Chain | 2240 | 22-41 | | 94-113 |
| anti-HIV__cap256-048-015156__VR-Chain | 2241 | 22-41 | | 94-113 |
| anti-HIV__cap256-048-014521__VR-Chain | 2242 | 22-41 | | 94-113 |
| anti-HIV__cap256-048-014475__VR-Chain | 2243 | 22-41 | | 94-113 |
| anti-HIV__cap256-048-013798__VR-Chain | 2244 | 22-41 | | |
| anti-HIV__cap256-048-013271__VR-Chain | 2245 | 22-41 | | 94-113 |
| anti-HIV__cap256-048-013180__VR-Chain | 2246 | 22-41 | | 94-113 |
| anti-HIV__cap256-048-012148__VR-Chain | 2247 | 22-41 | | 94-113 |
| anti-HIV__cap256-048-011870__VR-Chain | 2248 | 22-41 | | 94-113 |
| anti-HIV__cap256-048-011530__VR-Chain | 2249 | 22-41 | | 94-113 |
| anti-HIV__cap256-048-010968__VR-Chain | 2250 | 22-41 | | |
| anti-HIV__cap256-048-010224__VR-Chain | 2251 | 22-41 | | 92-111 |
| anti-HIV__cap256-048-009749__VR-Chain | 2252 | 22-41 | | 94-113 |
| anti-HIV__cap256-048-009623__VR-Chain | 2253 | 22-41 | | 94-113 |
| anti-HIV__cap256-048-008234__VR-Chain | 2254 | 22-41 | | 94-113 |
| anti-HIV__cap256-048-008149__VR-Chain | 2255 | 22-41 | | 94-113 |
| anti-HIV__cap256-048-007301__VR-Chain | 2256 | 22-41 | | 94-113 |
| anti-HIV__cap256-048-007174__VR-Chain | 2257 | 22-41 | | 94-113 |
| anti-HIV__cap256-048-007079__VR-Chain | 2258 | 22-41 | 31-40 | 94-113 |
| anti-HIV__cap256-048-007033__VR-Chain | 2259 | 22-41 | | 94-113 |
| anti-HIV__cap256-048-006128__VR-Chain | 2260 | 22-41 | | |
| anti-HIV__cap256-048-005999__VR-Chain | 2261 | 22-41 | | 94-113 |
| anti-HIV__cap256-048-005394__VR-Chain | 2262 | 22-41 | | 94-113 |
| anti-HIV__cap256-048-004226__VR-Chain | 2263 | 22-41 | | 94-113 |
| anti-HIV__cap256-048-004097__VR-Chain | 2264 | 22-41 | | 94-113 |
| anti-HIV__cap256-048-003289__VR-Chain | 2265 | 22-41 | | 94-113 |
| anti-HIV__cap256-048-002601__VR-Chain | 2266 | 22-41 | | 94-113 |
| anti-HIV__cap256-048-002129__VR-Chain | 2267 | 22-41 | | |
| anti-HIV__cap256-048-001875__VR-Chain | 2268 | 22-41 | | 94-113 |
| anti-HIV__cap256-048-001302__VR-Chain | 2269 | 22-41 | | 94-113 |
| anti-HIV__cap256-048-001203__VR-Chain | 2270 | 22-41 | | 94-113 |
| anti-HIV__cap256-048-000383__VR-Chain | 2271 | 22-41 | | 94-113 |
| anti-HIV__cap256-038-261791__VR-Chain | 2272 | 22-41 | | 94-113 |
| anti-HIV__cap256-038-241540__VR-Chain | 2273 | 22-41 | 58-67 | 94-113 |
| anti-HIV__cap256-038-235677__VR-Chain | 2274 | 22-41 | | 94-113 |
| anti-HIV__cap256-038-234314__VR-Chain | 2275 | 22-41 | | 94-113 |
| anti-HIV__cap256-038-234273__VR-Chain | 2276 | 22-41 | | 94-113 |
| anti-HIV__cap256-038-223164__VR-Chain | 2277 | 22-41 | | 94-113 |
| anti-HIV__cap256-038-220289__VR-Chain | 2278 | 22-41 | | 94-113 |
| anti-HIV__cap256-038-220020__VR-Chain | 2279 | 22-41 | | 94-113 |
| anti-HIV__cap256-038-216853__VR-Chain | 2280 | 22-41 | | 94-113 |
| anti-HIV__cap256-038-213466__VR-Chain | 2281 | 22-41 | | 94-113 |
| anti-HIV__cap256-038-213212__VR-Chain | 2282 | 22-41 | | |
| anti-HIV__cap256-038-213120__VR-Chain | 2283 | 22-41 | | 94-113 |
| anti-HIV__cap256-038-212592__VR-Chain | 2284 | 22-41 | | 94-113 |
| anti-HIV__cap256-038-211790__VR-Chain | 2285 | 22-41 | | 94-113 |
| anti-HIV__cap256-038-209916__VR-Chain | 2286 | 22-41 | | 94-113 |
| anti-HIV__cap256-038-207938__VR-Chain | 2287 | 22-41 | | 94-113 |
| anti-HIV__cap256-038-202245__VR-Chain | 2288 | 22-41 | | |
| anti-HIV__cap256-038-197721__VR-Chain | 2289 | 22-41 | | 94-113 |
| anti-HIV__cap256-038-196679__VR-Chain | 2290 | 22-41 | | 94-113 |
| anti-HIV__cap256-038-196118__VR-Chain | 2291 | 22-41 | | 94-113 |
| anti-HIV__cap256-038-195382__VR-Chain | 2292 | 22-41 | | 93-112 |
| anti-HIV__cap256-038-180001__VR-Chain | 2293 | 22-41 | | 94-113 |
| anti-HIV__cap256-038-178021__VR-Chain | 2294 | 22-41 | | 94-113 |
| anti-HIV__cap256-038-177104__VR-Chain | 2295 | 22-41 | | 94-113 |
| anti-HIV__cap256-038-171261__VR-Chain | 2296 | 22-41 | | 94-113 |
| anti-HIV__cap256-038-169090__VR-Chain | 2297 | 22-41 | | 94-113 |
| anti-HIV__cap256-038-168705__VR-Chain | 2298 | 22-41 | | 94-113 |
| anti-HIV__cap256-038-167685__VR-Chain | 2299 | 22-41 | | 94-113 |
| anti-HIV__cap256-038-158775__VR-Chain | 2300 | 22-41 | | 94-113 |
| anti-HIV__cap256-038-157318__VR-Chain | 2301 | 22-41 | | 94-113 |
| anti-HIV__cap256-038-153058__VR-Chain | 2302 | 22-41 | | 94-113 |
| anti-HIV__cap256-038-150027__VR-Chain | 2303 | 22-41 | | 94-113 |
| anti-HIV__cap256-038-146372__VR-Chain | 2304 | 22-41 | | 94-113 |

TABLE 5-continued

CDRs of exemplified antibodies

| Name | Protein SEQ ID NO | CDR1 | CDR2 | CDR3 |
| --- | --- | --- | --- | --- |
| anti-HIV__cap256-038-141868__VR-Chain | 2305 | 22-41 | | 94-113 |
| anti-HIV__cap256-038-141616__VR-Chain | 2306 | 22-41 | | 94-113 |
| anti-HIV__cap256-038-127989__VR-Chain | 2307 | 22-41 | | 94-113 |
| anti-HIV__cap256-038-118109__VR-Chain | 2308 | 22-41 | | 94-113 |
| anti-HIV__cap256-038-112226__VR-Chain | 2309 | 22-41 | | 94-113 |
| anti-HIV__cap256-038-105918__VR-Chain | 2310 | 22-41 | | 94-113 |
| anti-HIV__cap256-038-104487__VR-Chain | 2311 | 22-41 | | 94-113 |
| anti-HIV__cap256-038-102308__VR-Chain | 2312 | 22-41 | | 94-113 |
| anti-HIV__cap256-038-091115__VR-Chain | 2313 | 22-41 | | 94-113 |
| anti-HIV__cap256-038-090262__VR-Chain | 2314 | 22-41 | | 94-113 |
| anti-HIV__cap256-038-083260__VR-Chain | 2315 | 22-41 | | 94-113 |
| anti-HIV__cap256-038-080981__VR-Chain | 2316 | 22-41 | | 94-113 |
| anti-HIV__cap256-038-080873__VR-Chain | 2317 | 22-41 | | 94-113 |
| anti-HIV__cap256-038-074413__VR-Chain | 2318 | 22-41 | | 94-113 |
| anti-HIV__cap256-038-073153__VR-Chain | 2319 | 22-41 | | 94-113 |
| anti-HIV__cap256-038-064227__VR-Chain | 2320 | 22-41 | | 94-113 |
| anti-HIV__cap256-038-061640__VR-Chain | 2321 | 22-41 | | 94-113 |
| anti-HIV__cap256-038-059482__VR-Chain | 2322 | 22-41 | | 88-107 |
| anti-HIV__cap256-038-054000__VR-Chain | 2323 | 22-41 | | 94-113 |
| anti-HIV__cap256-038-050554__VR-Chain | 2324 | 22-41 | | 94-113 |
| anti-HIV__cap256-038-044256__VR-Chain | 2325 | 22-41 | | 94-113 |
| anti-HIV__cap256-038-040944__VR-Chain | 2326 | 22-41 | | 94-113 |
| anti-HIV__cap256-038-040090__VR-Chain | 2327 | 22-41 | | 94-113 |
| anti-HIV__cap256-038-032874__VR-Chain | 2328 | 22-41 | | |
| anti-HIV__cap256-038-025899__VR-Chain | 2329 | 22-41 | | 94-113 |
| anti-HIV__cap256-038-024581__VR-Chain | 2330 | 22-41 | | 94-113 |
| anti-HIV__cap256-038-013345__VR-Chain | 2331 | 22-41 | | 94-113 |
| anti-HIV__cap256-038-011559__VR-Chain | 2332 | 22-41 | | 94-113 |
| anti-HIV__cap256-038-009634__VR-Chain | 2333 | 22-41 | | |
| anti-HIV__cap256-038-006730__VR-Chain | 2334 | 22-41 | | 94-113 |
| anti-HIV__cap256-038-004887__VR-Chain | 2335 | 22-41 | | 94-113 |
| anti-HIV__cap256-038-004840__VR-Chain | 2336 | 22-41 | | 94-113 |
| anti-HIV__cap256-038-002181__VR-Chain | 2337 | 22-41 | | 94-113 |
| anti-HIV__cap256-038-001902__VR-Chain | 2338 | 22-41 | | 94-113 |
| anti-HIV__cap256-038-000976__VR-Chain | 2339 | 22-41 | | 94-113 |
| anti-HIV__cap256-038-000384__VR-Chain | 2340 | 22-41 | | 94-113 |
| anti-HIV__206-314431__VR-Chain | 2341 | 22-41 | 49-58 | 87-106 |
| anti-HIV__206-247594__VR-Chain | 2342 | 22-41 | 49-58 | 87-106 |
| anti-HIV__206-116890__VR-Chain | 2343 | 22-41 | 49-58 | 87-106 |
| anti-HIV__206-072383__VR-Chain | 2344 | 22-41 | 49-58 | |
| anti-HIV__206-037527__VR-Chain | 2345 | 22-41 | 49-58 | |
| anti-HIV__206-009095__VR-Chain | 2346 | 22-41 | 49-58 | |
| anti-HIV__176-503620__VR-Chain | 2347 | 22-41 | 49-58 | 87-106 |
| anti-HIV__176-478726__VR-Chain | 2348 | 22-41 | 49-58 | 87-106 |
| anti-HIV__176-245056__VR-Chain | 2349 | 22-41 | 49-58 | 87-106 |
| anti-HIV__176-164413__VR-Chain | 2350 | 22-41 | 49-58 | 87-106 |
| anti-HIV__176-094308__VR-Chain | 2351 | 22-41 | | |
| anti-HIV__176-065321__VR-Chain | 2352 | 22-41 | | 87-106 |
| anti-HIV__119-099719__VR-Chain | 2353 | 22-41 | 49-58 | 87-106 |
| anti-HIV__119-099536__VR-Chain | 2354 | 22-41 | 47-56 | 85-104 |
| anti-HIV__119-098907__VR-Chain | 2355 | 22-41 | | 87-106 |
| anti-HIV__119-098555__VR-Chain | 2356 | 22-41 | 49-58 | 87-106 |
| anti-HIV__119-097828__VR-Chain | 2357 | 22-41 | 49-58 | 87-106 |
| anti-HIV__119-096480__VR-Chain | 2358 | 22-41 | | 87-106 |
| anti-HIV__119-095664__VR-Chain | 2359 | 22-41 | 49-58 | 87-106 |
| anti-HIV__119-095212__VR-Chain | 2360 | 22-41 | | |
| anti-HIV__119-094773__VR-Chain | 2361 | 22-41 | 49-58 | |
| anti-HIV__119-094508__VR-Chain | 2362 | 22-41 | | 87-106 |
| anti-HIV__119-093795__VR-Chain | 2363 | 22-41 | | 87-106 |
| anti-HIV__119-093732__VR-Chain | 2364 | 22-41 | 49-58 | |
| anti-HIV__119-092903__VR-Chain | 2365 | 22-41 | 49-58 | 87-106 |
| anti-HIV__119-092284__VR-Chain | 2366 | 22-41 | | |
| anti-HIV__119-091586__VR-Chain | 2367 | 22-41 | 49-58 | |
| anti-HIV__119-091023__VR-Chain | 2368 | 22-41 | 49-58 | |
| anti-HIV__119-090334__VR-Chain | 2369 | 22-41 | | 87-106 |
| anti-HIV__119-088694__VR-Chain | 2370 | 22-41 | | 87-106 |
| anti-HIV__119-088499__VR-Chain | 2371 | 22-41 | 49-58 | 87-106 |
| anti-HIV__119-088298__VR-Chain | 2372 | 22-41 | 49-58 | |
| anti-HIV__119-087488__VR-Chain | 2373 | 22-41 | | 87-106 |
| anti-HIV__119-087423__VR-Chain | 2374 | 22-41 | 49-58 | 87-106 |
| anti-HIV__119-087371__VR-Chain | 2375 | 22-41 | 49-58 | 87-106 |
| anti-HIV__119-087279__VR-Chain | 2376 | 22-41 | | 87-106 |
| anti-HIV__119-087146__VR-Chain | 2377 | 22-41 | 49-58 | 87-106 |
| anti-HIV__119-087048__VR-Chain | 2378 | 22-41 | 49-58 | 87-106 |
| anti-HIV__119-085802__VR-Chain | 2379 | 22-41 | | |
| anti-HIV__119-085784__VR-Chain | 2380 | 22-41 | 49-58 | 87-106 |

TABLE 5-continued

CDRs of exemplified antibodies

| Name | Protein SEQ ID NO | CDR1 | CDR2 | CDR3 |
|---|---|---|---|---|
| anti-HIV__119-085370__VR-Chain | 2381 | 22-41 | 49-58 | 87-106 |
| anti-HIV__119-085276__VR-Chain | 2382 | 22-41 | 49-58 | |
| anti-HIV__119-084885__VR-Chain | 2383 | 22-41 | | 87-106 |
| anti-HIV__119-084874__VR-Chain | 2384 | 22-41 | 49-58 | |
| anti-HIV__119-084691__VR-Chain | 2385 | 22-41 | 49-58 | |
| anti-HIV__119-083793__VR-Chain | 2386 | 22-41 | 49-58 | 87-106 |
| anti-HIV__119-083163__VR-Chain | 2387 | 22-41 | | 87-106 |
| anti-HIV__119-082331__VR-Chain | 2388 | 22-41 | 49-58 | |
| anti-HIV__119-082070__VR-Chain | 2389 | 22-41 | 49-58 | 87-106 |
| anti-HIV__119-081512__VR-Chain | 2390 | 22-41 | 49-58 | |
| anti-HIV__119-080816__VR-Chain | 2391 | 22-41 | 49-58 | 87-106 |
| anti-HIV__119-079302__VR-Chain | 2392 | 22-41 | 49-58 | |
| anti-HIV__119-079292__VR-Chain | 2393 | 22-41 | 49-58 | 87-106 |
| anti-HIV__119-079289__VR-Chain | 2394 | 22-41 | 49-58 | |
| anti-HIV__119-078935__VR-Chain | 2395 | 22-41 | 49-58 | 87-106 |
| anti-HIV__119-078702__VR-Chain | 2396 | 22-41 | 49-58 | 87-106 |
| anti-HIV__119-078593__VR-Chain | 2397 | 22-41 | 49-58 | 87-106 |
| anti-HIV__119-077708__VR-Chain | 2398 | 22-41 | 49-58 | 87-106 |
| anti-HIV__119-076904__VR-Chain | 2399 | 22-41 | 49-58 | |
| anti-HIV__119-075862__VR-Chain | 2400 | 22-41 | 49-58 | 87-106 |
| anti-HIV__119-075465__VR-Chain | 2401 | 22-41 | 49-58 | |
| anti-HIV__119-074822__VR-Chain | 2402 | 22-41 | 48-57 | 86-105 |
| anti-HIV__119-074629__VR-Chain | 2403 | 22-41 | 49-58 | |
| anti-HIV__119-074500__VR-Chain | 2404 | 22-41 | 49-58 | 87-106 |
| anti-HIV__119-073911__VR-Chain | 2405 | 22-41 | | 87-106 |
| anti-HIV__119-072765__VR-Chain | 2406 | 22-41 | | 87-106 |
| anti-HIV__119-072313__VR-Chain | 2407 | 22-41 | 49-58 | 87-106 |
| anti-HIV__119-072280__VR-Chain | 2408 | 22-41 | | 87-106 |
| anti-HIV__119-071693__VR-Chain | 2409 | 22-41 | 49-58 | 87-106 |
| anti-HIV__119-071353__VR-Chain | 2410 | 22-41 | | |
| anti-HIV__119-069711__VR-Chain | 2411 | 22-41 | 49-58 | 87-106 |
| anti-HIV__119-069061__VR-Chain | 2412 | 22-41 | | 87-106 |
| anti-HIV__119-068202__VR-Chain | 2413 | 22-41 | 49-58 | 87-106 |
| anti-HIV__119-068063__VR-Chain | 2414 | 22-41 | | 87-106 |
| anti-HIV__119-067980__VR-Chain | 2415 | 22-41 | | |
| anti-HIV__119-067866__VR-Chain | 2416 | 22-41 | 49-58 | 87-106 |
| anti-HIV__119-067756__VR-Chain | 2417 | 22-41 | 49-58 | |
| anti-HIV__119-066859__VR-Chain | 2418 | 22-41 | 49-58 | |
| anti-HIV__119-065821__VR-Chain | 2419 | 22-41 | 49-58 | 87-106 |
| anti-HIV__119-065191__VR-Chain | 2420 | 22-41 | | 87-106 |
| anti-HIV__119-064667__VR-Chain | 2421 | 22-41 | 49-58 | |
| anti-HIV__119-063791__VR-Chain | 2422 | 22-41 | 49-58 | 87-106 |
| anti-HIV__119-062989__VR-Chain | 2423 | 22-41 | 49-58 | 87-106 |
| anti-HIV__119-062286__VR-Chain | 2424 | 22-41 | | 87-106 |
| anti-HIV__119-061416__VR-Chain | 2425 | 22-41 | 49-58 | |
| anti-HIV__119-061344__VR-Chain | 2426 | 22-41 | 49-58 | 87-106 |
| anti-HIV__119-060240__VR-Chain | 2427 | 22-41 | | 87-106 |
| anti-HIV__119-060184__VR-Chain | 2428 | 22-41 | 49-58 | |
| anti-HIV__119-058035__VR-Chain | 2429 | 22-41 | 49-58 | |
| anti-HIV__119-057858__VR-Chain | 2430 | 22-41 | 49-58 | |
| anti-HIV__119-057473__VR-Chain | 2431 | 22-41 | 49-58 | 87-106 |
| anti-HIV__119-057090__VR-Chain | 2432 | 22-41 | | |
| anti-HIV__119-055754__VR-Chain | 2433 | 22-41 | | |
| anti-HIV__119-054899__VR-Chain | 2434 | 22-41 | | 87-106 |
| anti-HIV__119-054501__VR-Chain | 2435 | 22-41 | | 87-106 |
| anti-HIV__119-051867__VR-Chain | 2436 | 22-41 | 49-58 | 87-106 |
| anti-HIV__119-051814__VR-Chain | 2437 | 22-41 | 49-58 | 87-106 |
| anti-HIV__119-051567__VR-Chain | 2438 | 22-41 | 20-29 | |
| anti-HIV__119-051483__VR-Chain | 2439 | 22-41 | 49-58 | 87-106 |
| anti-HIV__119-050913__VR-Chain | 2440 | 22-41 | 49-58 | 87-106 |
| anti-HIV__119-050187__VR-Chain | 2441 | 22-41 | 49-58 | |
| anti-HIV__119-049069__VR-Chain | 2442 | 22-41 | | 87-106 |
| anti-HIV__119-048517__VR-Chain | 2443 | 22-41 | 49-58 | |
| anti-HIV__119-048470__VR-Chain | 2444 | 22-41 | 49-58 | |
| anti-HIV__119-048303__VR-Chain | 2445 | 22-41 | 48-57 | 86-94 |
| anti-HIV__119-048021__VR-Chain | 2446 | 22-41 | 49-58 | |
| anti-HIV__119-047928__VR-Chain | 2447 | 22-41 | 49-58 | 87-106 |
| anti-HIV__119-047384__VR-Chain | 2448 | 22-41 | 49-58 | 87-106 |
| anti-HIV__119-047145__VR-Chain | 2449 | 22-41 | 49-58 | 87-106 |
| anti-HIV__119-046752__VR-Chain | 2450 | 22-41 | | 87-106 |
| anti-HIV__119-046660__VR-Chain | 2451 | 22-41 | 49-58 | 87-106 |
| anti-HIV__119-046202__VR-Chain | 2452 | 22-41 | | |
| anti-HIV__119-045790__VR-Chain | 2453 | 22-41 | | 87-106 |
| anti-HIV__119-044670__VR-Chain | 2454 | 22-41 | 49-58 | 87-106 |
| anti-HIV__119-044140__VR-Chain | 2455 | 22-41 | 49-58 | 87-106 |
| anti-HIV__119-042776__VR-Chain | 2456 | 22-41 | 49-58 | 87-106 |

TABLE 5-continued

CDRs of exemplified antibodies

| Name | Protein SEQ ID NO | CDR1 | CDR2 | CDR3 |
|---|---|---|---|---|
| anti-HIV__119-042581__VR-Chain | 2457 | 22-41 | | 87-106 |
| anti-HIV__119-040905__VR-Chain | 2458 | 22-41 | | |
| anti-HIV__119-040322__VR-Chain | 2459 | 22-41 | 49-58 | |
| anti-HIV__119-039892__VR-Chain | 2460 | 22-41 | 49-58 | 87-106 |
| anti-HIV__119-039764__VR-Chain | 2461 | 22-41 | 49-58 | 87-106 |
| anti-HIV__119-039188__VR-Chain | 2462 | 22-41 | 49-58 | |
| anti-HIV__119-039058__VR-Chain | 2463 | 22-41 | 49-58 | |
| anti-HIV__119-038837__VR-Chain | 2464 | 22-41 | | 87-106 |
| anti-HIV__119-038396__VR-Chain | 2465 | 22-41 | | 87-106 |
| anti-HIV__119-036918__VR-Chain | 2466 | 22-41 | 49-58 | 87-106 |
| anti-HIV__119-036592__VR-Chain | 2467 | 22-41 | 49-58 | 87-106 |
| anti-HIV__119-036310__VR-Chain | 2468 | 22-41 | 49-58 | 87-106 |
| anti-HIV__119-035618__VR-Chain | 2469 | 22-41 | | 87-106 |
| anti-HIV__119-035569__VR-Chain | 2470 | 22-41 | 49-58 | 87-106 |
| anti-HIV__119-035466__VR-Chain | 2471 | 22-41 | 49-58 | 87-106 |
| anti-HIV__119-035157__VR-Chain | 2472 | 22-41 | 49-58 | 87-106 |
| anti-HIV__119-035121__VR-Chain | 2473 | 22-41 | 49-58 | |
| anti-HIV__119-035046__VR-Chain | 2474 | 22-41 | 49-58 | 87-106 |
| anti-HIV__119-034754__VR-Chain | 2475 | 22-41 | 49-58 | 87-106 |
| anti-HIV__119-034318__VR-Chain | 2476 | 22-41 | 49-58 | 87-106 |
| anti-HIV__119-033780__VR-Chain | 2477 | 22-41 | 49-58 | |
| anti-HIV__119-033632__VR-Chain | 2478 | 22-41 | 49-58 | 87-106 |
| anti-HIV__119-033183__VR-Chain | 2479 | 22-41 | 49-58 | 87-106 |
| anti-HIV__119-030696__VR-Chain | 2480 | 22-41 | 49-58 | |
| anti-HIV__119-030059__VR-Chain | 2481 | 22-41 | 49-58 | |
| anti-HIV__119-029589__VR-Chain | 2482 | 22-41 | 49-58 | |
| anti-HIV__119-029448__VR-Chain | 2483 | 22-41 | 49-58 | 87-106 |
| anti-HIV__119-029220__VR-Chain | 2484 | 22-41 | 49-58 | |
| anti-HIV__119-028317__VR-Chain | 2485 | 22-41 | 49-58 | 87-106 |
| anti-HIV__119-028165__VR-Chain | 2486 | 22-41 | | 87-106 |
| anti-HIV__119-027147__VR-Chain | 2487 | 22-41 | | 87-106 |
| anti-HIV__119-026743__VR-Chain | 2488 | 22-41 | 49-58 | 87-106 |
| anti-HIV__119-026508__VR-Chain | 2489 | 22-41 | | 87-106 |
| anti-HIV__119-025683__VR-Chain | 2490 | 22-41 | 49-58 | 87-106 |
| anti-HIV__119-025614__VR-Chain | 2491 | 22-41 | | 87-106 |
| anti-HIV__119-025548__VR-Chain | 2492 | 22-41 | 49-58 | 87-106 |
| anti-HIV__119-025526__VR-Chain | 2493 | 22-41 | 49-58 | 87-106 |
| anti-HIV__119-023552__VR-Chain | 2494 | 22-41 | | 87-106 |
| anti-HIV__119-023092__VR-Chain | 2495 | 22-41 | | |
| anti-HIV__119-022793__VR-Chain | 2496 | 22-41 | 49-58 | 87-106 |
| anti-HIV__119-022395__VR-Chain | 2497 | 22-41 | | 87-106 |
| anti-HIV__119-022334__VR-Chain | 2498 | 22-41 | 49-58 | 87-106 |
| anti-HIV__119-021866__VR-Chain | 2499 | 22-41 | 49-58 | |
| anti-HIV__119-021278__VR-Chain | 2500 | 22-41 | 49-58 | 87-106 |
| anti-HIV__119-021183__VR-Chain | 2501 | 22-41 | | 87-106 |
| anti-HIV__119-019376__VR-Chain | 2502 | 22-41 | | 87-106 |
| anti-HIV__119-019238__VR-Chain | 2503 | 22-41 | 49-58 | |
| anti-HIV__119-018500__VR-Chain | 2504 | 22-41 | 49-58 | 87-106 |
| anti-HIV__119-018318__VR-Chain | 2505 | 22-41 | | 87-106 |
| anti-HIV__119-018218__VR-Chain | 2506 | 22-41 | 49-58 | |
| anti-HIV__119-017876__VR-Chain | 2507 | 22-41 | 49-58 | 87-106 |
| anti-HIV__119-017740__VR-Chain | 2508 | 22-41 | 49-58 | 87-106 |
| anti-HIV__119-017128__VR-Chain | 2509 | 22-41 | 49-58 | |
| anti-HIV__119-017044__VR-Chain | 2510 | 22-41 | 49-58 | 87-106 |
| anti-HIV__119-016644__VR-Chain | 2511 | 22-41 | 49-58 | 87-106 |
| anti-HIV__119-015878__VR-Chain | 2512 | 22-41 | 49-58 | 87-106 |
| anti-HIV__119-015538__VR-Chain | 2513 | 22-41 | 49-58 | 87-106 |
| anti-HIV__119-015455__VR-Chain | 2514 | 22-41 | 49-58 | 87-106 |
| anti-HIV__119-014425__VR-Chain | 2515 | 22-41 | 49-58 | 87-106 |
| anti-HIV__119-013582__VR-Chain | 2516 | 22-41 | | 87-106 |
| anti-HIV__119-013364__VR-Chain | 2517 | 22-41 | 49-58 | 87-106 |
| anti-HIV__119-012886__VR-Chain | 2518 | 22-41 | | 87-106 |
| anti-HIV__119-012249__VR-Chain | 2519 | 22-41 | 49-58 | |
| anti-HIV__119-012161__VR-Chain | 2520 | 22-41 | 49-58 | 87-106 |
| anti-HIV__119-012110__VR-Chain | 2521 | 22-41 | | 87-106 |
| anti-HIV__119-012100__VR-Chain | 2522 | 22-41 | 49-58 | 87-106 |
| anti-HIV__119-011651__VR-Chain | 2523 | 22-41 | 49-58 | 87-106 |
| anti-HIV__119-011479__VR-Chain | 2524 | 22-41 | 49-58 | 87-106 |
| anti-HIV__119-011232__VR-Chain | 2525 | 22-41 | 49-58 | |
| anti-HIV__119-011175__VR-Chain | 2526 | 22-41 | 49-58 | |
| anti-HIV__119-008396__VR-Chain | 2527 | 22-41 | | 87-106 |
| anti-HIV__119-007148__VR-Chain | 2528 | 22-41 | | 87-106 |
| anti-HIV__119-007029__VR-Chain | 2529 | 22-41 | | 87-106 |
| anti-HIV__119-004707__VR-Chain | 2530 | 22-41 | | 87-106 |
| anti-HIV__119-003910__VR-Chain | 2531 | 22-41 | | 87-106 |
| anti-HIV__119-002450__VR-Chain | 2532 | 22-41 | 49-58 | 87-106 |

TABLE 5-continued

CDRs of exemplified antibodies

| Name | Protein SEQ ID NO | CDR1 | CDR2 | CDR3 |
|---|---|---|---|---|
| anti-HIV__119-001552__VR-Chain | 2533 | 22-41 | 49-58 | 87-106 |
| anti-HIV__059-188169__VR-Chain | 2534 | 22-41 | 49-58 | 87-106 |
| anti-HIV__059-183739__VR-Chain | 2535 | 22-41 | 49-58 | 87-106 |
| anti-HIV__059-182376__VR-Chain | 2536 | 22-41 | 49-58 | 87-106 |
| anti-HIV__059-182199__VR-Chain | 2537 | 22-41 | 49-58 | 87-106 |
| anti-HIV__059-169202__VR-Chain | 2538 | 22-41 | 49-58 | 87-106 |
| anti-HIV__059-155645__VR-Chain | 2539 | 22-41 | 49-58 | 87-106 |
| anti-HIV__059-151619__VR-Chain | 2540 | 22-41 | | 87-106 |
| anti-HIV__059-146503__VR-Chain | 2541 | 22-41 | 49-58 | 87-106 |
| anti-HIV__059-136098__VR-Chain | 2542 | 22-41 | 49-58 | 87-106 |
| anti-HIV__059-105516__VR-Chain | 2543 | 22-41 | 49-58 | 87-106 |
| anti-HIV__059-095709__VR-Chain | 2544 | 22-41 | 49-58 | 87-106 |
| anti-HIV__059-069468__VR-Chain | 2545 | 22-41 | 49-58 | 87-106 |
| anti-HIV__059-060026__VR-Chain | 2546 | 22-41 | 49-58 | 87-106 |
| anti-HIV__059-053668__VR-Chain | 2547 | 22-41 | 49-58 | 87-106 |
| anti-HIV__059-052864__VR-Chain | 2548 | 22-41 | 49-58 | 87-106 |
| anti-HIV__059-050968__VR-Chain | 2549 | 22-41 | 49-58 | 87-106 |
| anti-HIV__059-046422__VR-Chain | 2550 | 22-41 | | 87-106 |
| anti-HIV__059-045120__VR-Chain | 2551 | 22-41 | | 87-106 |
| anti-HIV__059-039932__VR-Chain | 2552 | 22-41 | 49-58 | 87-106 |
| anti-HIV__059-038595__VR-Chain | 2553 | 22-41 | 49-58 | 87-106 |
| anti-HIV__059-035082__VR-Chain | 2554 | 22-41 | 49-58 | 87-106 |
| anti-HIV__059-029204__VR-Chain | 2555 | 22-41 | 49-58 | 87-106 |
| anti-HIV__059-025235__VR-Chain | 2556 | 22-41 | 49-58 | 87-106 |
| anti-HIV__059-015192__VR-Chain | 2557 | 22-41 | 49-58 | 87-106 |
| anti-HIV__059-007060__VR-Chain | 2558 | 22-41 | 49-58 | |
| anti-HIV__059-006953__VR-Chain | 2559 | 22-41 | 46-55 | 84-103 |
| anti-HIV__059-005953__VR-Chain | 2560 | 22-41 | 49-58 | 87-106 |
| anti-HIV__059-003725__VR-Chain | 2561 | 22-41 | | 87-106 |
| anti-HIV__059-002618__VR-Chain | 2562 | 22-41 | 49-58 | 87-106 |
| anti-HIV__059-001522__VR-Chain | 2563 | 22-41 | 49-58 | 87-106 |
| anti-HIV__059-000731__VR-Chain | 2564 | 22-41 | 49-58 | 87-106 |
| anti-HIV__059-000634__VR-Chain | 2565 | 22-41 | 49-58 | 87-106 |
| anti-HIV__048-250757__VR-Chain | 2566 | 22-41 | 49-58 | 87-106 |
| anti-HIV__048-250716__VR-Chain | 2567 | 22-41 | 49-58 | 87-106 |
| anti-HIV__048-250463__VR-Chain | 2568 | 22-41 | 49-58 | 87-106 |
| anti-HIV__048-248153__VR-Chain | 2569 | 22-41 | 49-58 | 87-106 |
| anti-HIV__048-247532__VR-Chain | 2570 | 22-41 | 49-58 | 87-106 |
| anti-HIV__048-245846__VR-Chain | 2571 | 22-41 | 49-58 | 87-106 |
| anti-HIV__048-244016__VR-Chain | 2572 | 22-41 | 49-58 | 87-106 |
| anti-HIV__048-243682__VR-Chain | 2573 | 22-41 | 49-58 | 87-106 |
| anti-HIV__048-243588__VR-Chain | 2574 | 22-41 | 49-58 | 87-106 |
| anti-HIV__048-241775__VR-Chain | 2575 | 22-41 | 49-58 | 87-106 |
| anti-HIV__048-237996__VR-Chain | 2576 | 22-41 | 49-58 | 87-106 |
| anti-HIV__048-237730__VR-Chain | 2577 | 22-41 | 48-57 | 86-105 |
| anti-HIV__048-237253__VR-Chain | 2578 | 22-41 | 49-58 | 87-106 |
| anti-HIV__048-234100__VR-Chain | 2579 | 22-41 | 49-58 | 87-106 |
| anti-HIV__048-230882__VR-Chain | 2580 | 22-41 | 49-58 | 87-106 |
| anti-HIV__048-229473__VR-Chain | 2581 | 22-41 | 49-58 | 87-106 |
| anti-HIV__048-228238__VR-Chain | 2582 | 22-41 | 49-58 | 87-106 |
| anti-HIV__048-228027__VR-Chain | 2583 | 22-41 | 49-58 | 87-106 |
| anti-HIV__048-227795__VR-Chain | 2584 | 22-41 | 49-58 | 87-106 |
| anti-HIV__048-227770__VR-Chain | 2585 | 22-41 | 49-58 | 87-106 |
| anti-HIV__048-225298__VR-Chain | 2586 | 22-41 | 49-58 | 87-106 |
| anti-HIV__048-225090__VR-Chain | 2587 | 22-41 | 47-56 | 85-104 |
| anti-HIV__048-224187__VR-Chain | 2588 | 22-41 | | 87-106 |
| anti-HIV__048-223055__VR-Chain | 2589 | 22-41 | 49-58 | 87-106 |
| anti-HIV__048-222711__VR-Chain | 2590 | 22-41 | | 87-106 |
| anti-HIV__048-221209__VR-Chain | 2591 | 22-41 | | 87-106 |
| anti-HIV__048-220629__VR-Chain | 2592 | 22-41 | 49-58 | 87-106 |
| anti-HIV__048-219430__VR-Chain | 2593 | 22-41 | 49-58 | 87-106 |
| anti-HIV__048-216250__VR-Chain | 2594 | 22-41 | | 87-106 |
| anti-HIV__048-216133__VR-Chain | 2595 | 22-41 | 45-54 | 83-102 |
| anti-HIV__048-214886__VR-Chain | 2596 | 22-41 | 49-58 | 87-106 |
| anti-HIV__048-214709__VR-Chain | 2597 | 22-41 | 49-58 | 87-106 |
| anti-HIV__048-214001__VR-Chain | 2598 | 22-41 | 49-58 | 87-106 |
| anti-HIV__048-213230__VR-Chain | 2599 | 22-41 | 49-58 | 87-106 |
| anti-HIV__048-212574__VR-Chain | 2600 | 22-41 | 49-58 | 87-106 |
| anti-HIV__048-212207__VR-Chain | 2601 | 22-41 | 49-58 | 87-106 |
| anti-HIV__048-209146__VR-Chain | 2602 | 22-41 | | 87-106 |
| anti-HIV__048-208206__VR-Chain | 2603 | 22-41 | 49-58 | 87-106 |
| anti-HIV__048-208194__VR-Chain | 2604 | 22-41 | | 87-106 |
| anti-HIV__048-207744__VR-Chain | 2605 | 22-41 | 49-58 | 87-106 |
| anti-HIV__048-206501__VR-Chain | 2606 | 22-41 | 49-58 | 87-106 |
| anti-HIV__048-204221__VR-Chain | 2607 | 22-41 | 49-58 | 87-106 |
| anti-HIV__048-204015__VR-Chain | 2608 | 22-41 | 49-58 | 87-106 |

TABLE 5-continued

CDRs of exemplified antibodies

| Name | Protein SEQ ID NO | CDR1 | CDR2 | CDR3 |
|---|---|---|---|---|
| anti-HIV__048-201240__VR-Chain | 2609 | 22-41 | | 87-106 |
| anti-HIV__048-200455__VR-Chain | 2610 | 22-41 | 49-58 | 87-106 |
| anti-HIV__048-200319__VR-Chain | 2611 | 22-41 | 49-58 | 87-106 |
| anti-HIV__048-197896__VR-Chain | 2612 | 22-41 | | 87-106 |
| anti-HIV__048-193813__VR-Chain | 2613 | 22-41 | 49-58 | 87-106 |
| anti-HIV__048-192098__VR-Chain | 2614 | 22-41 | 49-58 | 87-106 |
| anti-HIV__048-191786__VR-Chain | 2615 | 22-41 | 49-58 | 87-106 |
| anti-HIV__048-188746__VR-Chain | 2616 | 22-41 | 49-58 | 87-106 |
| anti-HIV__048-185937__VR-Chain | 2617 | 22-41 | 49-58 | 87-106 |
| anti-HIV__048-184849__VR-Chain | 2618 | 22-41 | 49-58 | 87-106 |
| anti-HIV__048-183089__VR-Chain | 2619 | 22-41 | | 87-106 |
| anti-HIV__048-181509__VR-Chain | 2620 | 22-41 | 49-58 | 87-106 |
| anti-HIV__048-180990__VR-Chain | 2621 | 22-41 | | 87-106 |
| anti-HIV__048-177532__VR-Chain | 2622 | 22-41 | | 87-106 |
| anti-HIV__048-177426__VR-Chain | 2623 | 22-41 | 46-55 | 84-103 |
| anti-HIV__048-177389__VR-Chain | 2624 | 22-41 | 49-58 | 87-106 |
| anti-HIV__048-174266__VR-Chain | 2625 | 22-41 | 49-58 | 87-106 |
| anti-HIV__048-172847__VR-Chain | 2626 | 22-41 | 49-58 | 87-106 |
| anti-HIV__048-172845__VR-Chain | 2627 | 22-41 | 49-58 | 87-106 |
| anti-HIV__048-172363__VR-Chain | 2628 | 22-41 | | 87-106 |
| anti-HIV__048-171609__VR-Chain | 2629 | 22-41 | 49-58 | 87-106 |
| anti-HIV__048-170705__VR-Chain | 2630 | 22-41 | 49-58 | 87-106 |
| anti-HIV__048-168381__VR-Chain | 2631 | 22-41 | 49-58 | 87-106 |
| anti-HIV__048-166619__VR-Chain | 2632 | 22-41 | 49-58 | 87-106 |
| anti-HIV__048-162036__VR-Chain | 2633 | 22-41 | 49-58 | 87-106 |
| anti-HIV__048-160042__VR-Chain | 2634 | 22-41 | 49-58 | 87-106 |
| anti-HIV__048-159676__VR-Chain | 2635 | 22-41 | 49-58 | 87-106 |
| anti-HIV__048-159500__VR-Chain | 2636 | 22-41 | 49-58 | 87-106 |
| anti-HIV__048-159421__VR-Chain | 2637 | 22-41 | 49-58 | 87-106 |
| anti-HIV__048-159333__VR-Chain | 2638 | 22-41 | 49-58 | 87-106 |
| anti-HIV__048-158932__VR-Chain | 2639 | 22-41 | 49-58 | 87-106 |
| anti-HIV__048-155811__VR-Chain | 2640 | 22-41 | | 87-106 |
| anti-HIV__048-155464__VR-Chain | 2641 | 22-41 | 49-58 | 87-106 |
| anti-HIV__048-155392__VR-Chain | 2642 | 22-41 | | 87-106 |
| anti-HIV__048-155389__VR-Chain | 2643 | 22-41 | 49-58 | 87-106 |
| anti-HIV__048-154449__VR-Chain | 2644 | 22-41 | 49-58 | 87-106 |
| anti-HIV__048-153379__VR-Chain | 2645 | 22-41 | 49-58 | 87-106 |
| anti-HIV__048-153171__VR-Chain | 2646 | 22-41 | 32-41 | 87-106 |
| anti-HIV__048-152324__VR-Chain | 2647 | 22-41 | 49-58 | 87-106 |
| anti-HIV__048-146102__VR-Chain | 2648 | 22-41 | 49-58 | 87-106 |
| anti-HIV__048-145984__VR-Chain | 2649 | 22-41 | | 87-106 |
| anti-HIV__048-145371__VR-Chain | 2650 | 22-41 | 49-58 | 87-106 |
| anti-HIV__048-144907__VR-Chain | 2651 | 22-41 | 49-58 | 87-106 |
| anti-HIV__048-142298__VR-Chain | 2652 | 22-41 | | 87-106 |
| anti-HIV__048-142277__VR-Chain | 2653 | 22-41 | 49-58 | 87-106 |
| anti-HIV__048-141934__VR-Chain | 2654 | 22-41 | 49-58 | 87-106 |
| anti-HIV__048-141207__VR-Chain | 2655 | 22-41 | 49-58 | 87-106 |
| anti-HIV__048-140796__VR-Chain | 2656 | 22-41 | 49-58 | 87-106 |
| anti-HIV__048-139893__VR-Chain | 2657 | 22-41 | 49-58 | 87-106 |
| anti-HIV__048-138820__VR-Chain | 2658 | 22-41 | 49-58 | 87-106 |
| anti-HIV__048-135858__VR-Chain | 2659 | 22-41 | 49-58 | 87-106 |
| anti-HIV__048-134968__VR-Chain | 2660 | 22-41 | 49-58 | 87-106 |
| anti-HIV__048-134312__VR-Chain | 2661 | 22-41 | 49-58 | 87-106 |
| anti-HIV__048-132253__VR-Chain | 2662 | 22-41 | 48-57 | 86-105 |
| anti-HIV__048-130710__VR-Chain | 2663 | 22-41 | | 87-106 |
| anti-HIV__048-128564__VR-Chain | 2664 | 22-41 | 49-58 | 87-106 |
| anti-HIV__048-126702__VR-Chain | 2665 | 22-41 | 49-58 | 87-106 |
| anti-HIV__048-124521__VR-Chain | 2666 | 22-41 | 49-58 | 87-106 |
| anti-HIV__048-122740__VR-Chain | 2667 | 22-41 | | 87-106 |
| anti-HIV__048-119536__VR-Chain | 2668 | 22-41 | 47-56 | 85-104 |
| anti-HIV__048-116929__VR-Chain | 2669 | 22-41 | 49-58 | 87-106 |
| anti-HIV__048-116577__VR-Chain | 2670 | 22-41 | 49-58 | 87-106 |
| anti-HIV__048-116046__VR-Chain | 2671 | 22-41 | 49-58 | 87-106 |
| anti-HIV__048-115875__VR-Chain | 2672 | 22-41 | 49-58 | 87-106 |
| anti-HIV__048-115599__VR-Chain | 2673 | 22-41 | | 87-106 |
| anti-HIV__048-113988__VR-Chain | 2674 | 22-41 | | 87-106 |
| anti-HIV__048-112989__VR-Chain | 2675 | 22-41 | 49-58 | 87-106 |
| anti-HIV__048-112435__VR-Chain | 2676 | 22-41 | | 87-106 |
| anti-HIV__048-111339__VR-Chain | 2677 | 22-41 | 49-58 | 87-106 |
| anti-HIV__048-111055__VR-Chain | 2678 | 22-41 | 49-58 | 87-106 |
| anti-HIV__048-111027__VR-Chain | 2679 | 22-41 | 49-58 | 87-106 |
| anti-HIV__048-109721__VR-Chain | 2680 | 22-41 | 49-58 | 87-106 |
| anti-HIV__048-109666__VR-Chain | 2681 | 22-41 | 49-58 | 87-106 |
| anti-HIV__048-109196__VR-Chain | 2682 | 22-41 | 49-58 | 87-106 |
| anti-HIV__048-109051__VR-Chain | 2683 | 22-41 | | 87-106 |
| anti-HIV__048-108570__VR-Chain | 2684 | 22-41 | 49-58 | 87-106 |

TABLE 5-continued

CDRs of exemplified antibodies

| Name | Protein SEQ ID NO | CDR1 | CDR2 | CDR3 |
|---|---|---|---|---|
| anti-HIV__048-108033__VR-Chain | 2685 | 22-41 | 47-56 | 85-104 |
| anti-HIV__048-107279__VR-Chain | 2686 | 22-41 | 49-58 | 87-106 |
| anti-HIV__048-106271__VR-Chain | 2687 | 22-41 | 49-58 | 87-106 |
| anti-HIV__048-106054__VR-Chain | 2688 | 22-41 | 49-58 | 87-106 |
| anti-HIV__048-104848__VR-Chain | 2689 | 22-41 | | 87-106 |
| anti-HIV__048-104638__VR-Chain | 2690 | 22-41 | 49-58 | 87-106 |
| anti-HIV__048-104567__VR-Chain | 2691 | 22-41 | 49-58 | 87-106 |
| anti-HIV__048-102804__VR-Chain | 2692 | 22-41 | 49-58 | 87-106 |
| anti-HIV__048-101676__VR-Chain | 2693 | 22-41 | | 87-106 |
| anti-HIV__048-097603__VR-Chain | 2694 | 22-41 | 49-58 | 87-106 |
| anti-HIV__048-097107__VR-Chain | 2695 | 22-41 | 49-58 | 87-106 |
| anti-HIV__048-096871__VR-Chain | 2696 | 22-41 | 49-58 | 87-106 |
| anti-HIV__048-096668__VR-Chain | 2697 | 22-41 | 49-58 | 87-106 |
| anti-HIV__048-095236__VR-Chain | 2698 | 22-41 | 49-58 | 87-106 |
| anti-HIV__048-094155__VR-Chain | 2699 | 22-41 | 49-58 | 87-106 |
| anti-HIV__048-093219__VR-Chain | 2700 | 22-41 | 49-58 | 87-106 |
| anti-HIV__048-092976__VR-Chain | 2701 | 22-41 | 49-58 | 87-106 |
| anti-HIV__048-090866__VR-Chain | 2702 | 22-41 | 49-58 | 87-106 |
| anti-HIV__048-090650__VR-Chain | 2703 | 22-41 | | 87-106 |
| anti-HIV__048-089009__VR-Chain | 2704 | 22-41 | 49-58 | 87-106 |
| anti-HIV__048-088654__VR-Chain | 2705 | 22-41 | 49-58 | 87-106 |
| anti-HIV__048-086513__VR-Chain | 2706 | 22-41 | 49-58 | 87-106 |
| anti-HIV__048-086024__VR-Chain | 2707 | 22-41 | 46-55 | 84-103 |
| anti-HIV__048-085857__VR-Chain | 2708 | 22-41 | 49-58 | 87-106 |
| anti-HIV__048-084277__VR-Chain | 2709 | 22-41 | 49-58 | 87-106 |
| anti-HIV__048-084245__VR-Chain | 2710 | 22-41 | 49-58 | 87-106 |
| anti-HIV__048-082487__VR-Chain | 2711 | 22-41 | | 87-106 |
| anti-HIV__048-081787__VR-Chain | 2712 | 22-41 | 49-58 | 87-106 |
| anti-HIV__048-081062__VR-Chain | 2713 | 22-41 | 49-58 | 87-106 |
| anti-HIV__048-079639__VR-Chain | 2714 | 22-41 | 49-58 | 87-106 |
| anti-HIV__048-079126__VR-Chain | 2715 | 22-41 | | 87-106 |
| anti-HIV__048-073118__VR-Chain | 2716 | 22-41 | 49-58 | 87-106 |
| anti-HIV__048-070264__VR-Chain | 2717 | 22-41 | 49-58 | 87-106 |
| anti-HIV__048-069426__VR-Chain | 2718 | 22-41 | 49-58 | 87-106 |
| anti-HIV__048-068564__VR-Chain | 2719 | 22-41 | 49-58 | 87-106 |
| anti-HIV__048-068345__VR-Chain | 2720 | 22-41 | 49-58 | 87-106 |
| anti-HIV__048-067337__VR-Chain | 2721 | 22-41 | 49-58 | 87-106 |
| anti-HIV__048-067180__VR-Chain | 2722 | 22-41 | 49-58 | 87-106 |
| anti-HIV__048-063017__VR-Chain | 2723 | 22-41 | 49-58 | 87-106 |
| anti-HIV__048-061885__VR-Chain | 2724 | 22-41 | 49-58 | 87-106 |
| anti-HIV__048-061671__VR-Chain | 2725 | 22-41 | 49-58 | 87-106 |
| anti-HIV__048-060700__VR-Chain | 2726 | 22-41 | 49-58 | 87-106 |
| anti-HIV__048-060592__VR-Chain | 2727 | 22-41 | 49-58 | 87-106 |
| anti-HIV__048-060300__VR-Chain | 2728 | 22-41 | 49-58 | 87-106 |
| anti-HIV__048-059141__VR-Chain | 2729 | 22-41 | 49-58 | 87-106 |
| anti-HIV__048-057777__VR-Chain | 2730 | 22-41 | 49-58 | 87-106 |
| anti-HIV__048-056928__VR-Chain | 2731 | 22-41 | 49-58 | 87-106 |
| anti-HIV__048-056131__VR-Chain | 2732 | 22-41 | 49-58 | 87-106 |
| anti-HIV__048-055864__VR-Chain | 2733 | 22-41 | 20-29 | 87-106 |
| anti-HIV__048-055094__VR-Chain | 2734 | 22-41 | | 87-106 |
| anti-HIV__048-054343__VR-Chain | 2735 | 22-41 | | 87-106 |
| anti-HIV__048-054193__VR-Chain | 2736 | 22-41 | | 87-106 |
| anti-HIV__048-052521__VR-Chain | 2737 | 22-41 | 49-58 | 87-106 |
| anti-HIV__048-049037__VR-Chain | 2738 | 22-41 | 49-58 | 87-106 |
| anti-HIV__048-048720__VR-Chain | 2739 | 22-41 | 49-58 | 87-106 |
| anti-HIV__048-048542__VR-Chain | 2740 | 22-41 | 49-58 | 87-106 |
| anti-HIV__048-047777__VR-Chain | 2741 | 22-41 | 49-58 | 87-106 |
| anti-HIV__048-046841__VR-Chain | 2742 | 22-41 | 49-58 | 87-106 |
| anti-HIV__048-046202__VR-Chain | 2743 | 22-41 | 49-58 | 87-106 |
| anti-HIV__048-046059__VR-Chain | 2744 | 22-41 | 49-58 | 87-106 |
| anti-HIV__048-043568__VR-Chain | 2745 | 22-41 | 49-58 | 87-106 |
| anti-HIV__048-042713__VR-Chain | 2746 | 22-41 | 49-58 | 87-106 |
| anti-HIV__048-042440__VR-Chain | 2747 | 22-41 | 49-58 | 87-106 |
| anti-HIV__048-040511__VR-Chain | 2748 | 22-41 | 49-58 | 87-106 |
| anti-HIV__048-039195__VR-Chain | 2749 | 22-41 | 49-58 | 87-106 |
| anti-HIV__048-036935__VR-Chain | 2750 | 22-41 | 49-58 | 87-106 |
| anti-HIV__048-034478__VR-Chain | 2751 | 22-41 | 49-58 | 87-106 |
| anti-HIV__048-031641__VR-Chain | 2752 | 22-41 | 49-58 | 87-106 |
| anti-HIV__048-029760__VR-Chain | 2753 | 22-41 | 49-58 | 87-106 |
| anti-HIV__048-027970__VR-Chain | 2754 | 22-41 | 49-58 | 87-106 |
| anti-HIV__048-027337__VR-Chain | 2755 | 22-41 | 49-58 | 87-106 |
| anti-HIV__048-027217__VR-Chain | 2756 | 22-41 | 49-58 | 87-106 |
| anti-HIV__048-026760__VR-Chain | 2757 | 22-41 | 49-58 | 87-106 |
| anti-HIV__048-024800__VR-Chain | 2758 | 22-41 | 49-58 | 87-106 |
| anti-HIV__048-024313__VR-Chain | 2759 | 22-41 | 49-58 | 87-106 |
| anti-HIV__048-021748__VR-Chain | 2760 | 22-41 | 49-58 | 87-106 |

TABLE 5-continued

CDRs of exemplified antibodies

| Name | Protein SEQ ID NO | CDR1 | CDR2 | CDR3 |
| --- | --- | --- | --- | --- |
| anti-HIV__048-020991__VR-Chain | 2761 | 22-41 | 49-58 | 87-106 |
| anti-HIV__048-020340__VR-Chain | 2762 | 22-41 | 49-58 | 87-106 |
| anti-HIV__048-019993__VR-Chain | 2763 | 22-41 | 49-58 | 87-106 |
| anti-HIV__048-019947__VR-Chain | 2764 | 22-41 | 49-58 | 87-106 |
| anti-HIV__048-017871__VR-Chain | 2765 | 22-41 | 49-58 | 87-106 |
| anti-HIV__048-015931__VR-Chain | 2766 | 22-41 | 49-58 | 87-106 |
| anti-HIV__048-015920__VR-Chain | 2767 | 22-41 | 49-58 | 87-106 |
| anti-HIV__048-013898__VR-Chain | 2768 | 22-41 | 49-58 | 87-106 |
| anti-HIV__048-013429__VR-Chain | 2769 | 22-41 | 49-58 | 87-106 |
| anti-HIV__048-012358__VR-Chain | 2770 | 22-41 | 49-58 | 87-106 |
| anti-HIV__048-011158__VR-Chain | 2771 | 22-41 | 49-58 | 87-106 |
| anti-HIV__048-010720__VR-Chain | 2772 | 22-41 | 49-58 | 87-106 |
| anti-HIV__048-009445__VR-Chain | 2773 | 22-41 | 49-58 | 87-106 |
| anti-HIV__048-006126__VR-Chain | 2774 | 22-41 | 46-55 | 84-103 |
| anti-HIV__048-005652__VR-Chain | 2775 | 22-41 | 49-58 | 87-106 |
| anti-HIV__048-005532__VR-Chain | 2776 | 22-41 | 49-58 | 87-106 |
| anti-HIV__048-005189__VR-Chain | 2777 | 22-41 | 49-58 | 87-106 |
| anti-HIV__048-005088__VR-Chain | 2778 | 22-41 | 49-58 | 87-106 |
| anti-HIV__048-004023__VR-Chain | 2779 | 22-41 | 49-58 | 87-106 |
| anti-HIV__048-001580__VR-Chain | 2780 | 22-41 | | 87-106 |
| anti-HIV__038-221120__VR-Chain | 2781 | 22-41 | 49-58 | 87-106 |
| anti-HIV__038-197677__VR-Chain | 2782 | 22-41 | 49-58 | 87-106 |
| anti-HIV__038-196765__VR-Chain | 2783 | 22-41 | 49-58 | 87-106 |
| anti-HIV__038-186200__VR-Chain | 2784 | 22-41 | | 87-106 |
| anti-HIV__038-126170__VR-Chain | 2785 | 22-41 | 49-58 | 87-106 |
| anti-HIV__038-108545__VR-Chain | 2786 | 22-41 | 49-58 | 87-106 |
| anti-HIV__038-107263__VR-Chain | 2787 | 22-41 | 49-58 | 87-106 |
| anti-HIV__038-104530__VR-Chain | 2788 | 22-41 | 49-58 | 87-106 |
| anti-HIV__038-099169__VR-Chain | 2789 | 22-41 | 49-58 | 87-106 |
| anti-HIV__038-075067__VR-Chain | 2790 | 22-41 | 49-58 | 87-106 |
| anti-HIV__038-072368__VR-Chain | 2791 | 22-41 | 49-58 | 87-106 |
| anti-HIV__038-068503__VR-Chain | 2792 | 22-41 | 49-58 | 87-106 |
| anti-HIV__038-068016__VR-Chain | 2793 | 22-41 | 49-58 | 87-106 |
| anti-HIV__038-063958__VR-Chain | 2794 | 22-41 | 49-58 | 87-106 |
| anti-HIV__038-033733__VR-Chain | 2795 | 22-41 | 49-58 | 87-106 |
| anti-HIV__038-030557__VR-Chain | 2796 | 22-41 | 49-58 | 87-106 |
| anti-HIV__038-024298__VR-Chain | 2797 | 22-41 | 49-58 | 87-106 |
| anti-HIV__038-011154__VR-Chain | 2798 | 22-41 | 49-58 | 87-106 |
| anti-HIV-1__LightChain | 2799 | 22-41 | 49-58 | 87-106 |
| anti-HIV-1__LightChain | 2800 | 22-41 | | |
| anti-HIV-1__LightChain | 2801 | 22-41 | 46-55 | |
| anti-HIV-1__LightChain | 2802 | 22-41 | 45-54 | |
| anti-HIV-1__LightChain | 2803 | 22-41 | 45-54 | |
| anti-HIV-1__LightChain | 2804 | 22-41 | | 84-103 |
| anti-HIV-1__LightChain | 2805 | 22-41 | 45-54 | 83-102 |
| anti-HIV-1__LightChain | 2806 | 22-41 | 46-55 | |
| anti-HIV-1__LightChain | 2807 | 22-41 | 45-54 | 83-102 |
| anti-HIV-1__LightChain | 2808 | 22-41 | | 84-103 |
| anti-HIV-1__LightChain | 2809 | 22-41 | 48-57 | |
| anti-HIV-1__LightChain | 2810 | 22-41 | | |
| anti-HIV-1__LightChain | 2811 | 22-41 | | |
| anti-HIV-1__LightChain | 2812 | 22-41 | | |
| anti-HIV-1__LightChain | 2813 | 22-41 | | |
| anti-HIV-1__LightChain | 2814 | 22-41 | | |
| anti-HIV-1__LightChain | 2815 | 22-41 | | |
| anti-HIV-1__LightChain | 2816 | 22-41 | | |
| anti-HIV-1__LightChain | 2817 | 22-41 | | |
| anti-HIV-1__LightChain | 2818 | 22-41 | | |
| anti-HIV-1__LightChain | 2819 | 22-41 | | |
| anti-HIV-1__LightChain | 2820 | 22-41 | | |
| anti-HIV-1__HeavyChain | 2821 | 22-41 | 74-83 | |
| anti-HIV-1__HeavyChain | 2822 | 22-41 | 74-83 | |
| anti-HIV-1__HeavyChain | 2823 | 22-41 | | |
| anti-HIV-1__HeavyChain | 2824 | 22-41 | 74-83 | 94-113 |
| anti-HIV-1__HeavyChain | 2825 | 22-41 | 74-83 | |
| anti-HIV-1__HeavyChain | 2826 | 22-41 | 74-83 | 94-113 |
| anti-HIV-1__HeavyChain | 2827 | 22-41 | | |
| anti-HIV-1__HeavyChain | 2828 | 22-41 | 74-83 | 94-113 |
| anti-HIV-1__HeavyChain | 2829 | 22-41 | 74-83 | |
| anti-HIV-1__HeavyChain | 2830 | 22-41 | | |
| anti-HIV-1__HeavyChain | 2831 | 22-41 | | 86-105 |
| anti-HIV-1__HeavyChain | 2832 | 22-41 | | 86-105 |
| anti-HIV-1__HeavyChain | 2833 | 22-41 | | 86-105 |
| anti-HIV-1__HeavyChain | 2834 | 22-41 | | 86-105 |
| anti-HIV-1__HeavyChain | 2835 | 22-41 | | |
| anti-HIV-1__HeavyChain | 2836 | 22-41 | | 86-105 |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 2837 | 22-41 | | 100-119 |
| anti-HIV-1_HeavyChain | 2838 | 22-41 | | 100-119 |
| anti-HIV-1_HeavyChain | 2839 | 22-41 | | 100-119 |
| anti-HIV-1_HeavyChain | 2840 | 22-41 | | 100-119 |
| anti-HIV-1_HeavyChain | 2841 | 22-41 | | 100-119 |
| anti-HIV-1_HeavyChain | 2842 | 22-41 | | 100-119 |
| anti-HIV-1_HeavyChain | 2843 | 22-41 | | 100-119 |
| anti-HIV-1_HeavyChain | 2844 | 22-41 | | 100-119 |
| anti-HIV-1_HeavyChain | 2845 | 22-41 | | 100-119 |
| anti-HIV-1_HeavyChain | 2846 | 22-41 | | |
| anti-HIV-1_HeavyChain | 2847 | 22-41 | | |
| anti-HIV-1_LightChain | 2848 | 22-41 | 46-55 | 84-101 |
| anti-HIV-1_HeavyChain | 2849 | 22-41 | | |
| anti-HIV-1_HeavyChain | 2850 | 22-41 | | |
| anti-HIV-1_HeavyChain | 2851 | 22-41 | 35-44 | |
| anti-HIV-1_HeavyChain | 2852 | 22-41 | 35-44 | |
| anti-HIV-1_HeavyChain | 2853 | 22-41 | 35-44 | |
| anti-HIV-1_HeavyChain | 2854 | 22-41 | 35-44 | |
| anti-HIV-1_HeavyChain | 2855 | 22-41 | 35-44 | |
| anti-HIV-1_HeavyChain | 2856 | 22-41 | | |
| anti-HIV-1_HeavyChain | 2857 | 22-41 | | |
| anti-HIV-1_HeavyChain | 2858 | 22-41 | | |
| anti-HIV-1_HeavyChain | 2859 | 22-41 | | |
| anti-HIV-1_HeavyChain | 2860 | 22-41 | | |
| anti-HIV-1_HeavyChain | 2861 | 22-41 | 95-104 | |
| anti-HIV-1_HeavyChain | 2862 | 22-41 | | |
| anti-HIV-1_HeavyChain | 2863 | 22-41 | | |
| anti-HIV-1_HeavyChain | 2864 | 22-41 | | |
| anti-HIV-1_HeavyChain | 2865 | 22-41 | | |
| anti-HIV-1_HeavyChain | 2866 | 22-41 | 34-43 | |
| anti-HIV-1_HeavyChain | 2867 | 22-41 | | |
| anti-HIV-1_HeavyChain | 2868 | 22-41 | | |
| anti-HIV-1_HeavyChain | 2869 | 22-41 | | |
| anti-HIV-1_HeavyChain | 2870 | 22-41 | | |
| anti-HIV-1_HeavyChain | 2871 | 22-41 | | 95-114 |
| anti-HIV-1_HeavyChain | 2872 | 22-41 | 35-44 | |
| anti-HIV-1_HeavyChain | 2873 | 22-41 | | |
| anti-HIV-1_HeavyChain | 2874 | 22-41 | | |
| anti-HIV-1_HeavyChain | 2875 | 22-41 | | |
| anti-HIV-1_HeavyChain | 2876 | 22-41 | | |
| anti-HIV-1_HeavyChain | 2877 | 22-41 | | 96-115 |
| anti-HIV-1_HeavyChain | 2878 | 22-41 | | |
| anti-HIV-1_HeavyChain | 2879 | 22-41 | | |
| anti-HIV-1_HeavyChain | 2880 | 22-41 | | |
| anti-HIV-1_HeavyChain | 2881 | 22-41 | | |
| anti-HIV-1_HeavyChain | 2882 | 22-41 | | |
| anti-HIV-1_HeavyChain | 2883 | 22-41 | | |
| anti-HIV-1_HeavyChain | 2884 | 22-41 | 35-44 | |
| anti-HIV-1_HeavyChain | 2885 | 22-41 | | |
| anti-HIV-1_HeavyChain | 2886 | 22-41 | | 96-115 |
| anti-HIV-1_HeavyChain | 2887 | 22-41 | | |
| anti-HIV-1_HeavyChain | 2888 | 22-41 | | |
| anti-HIV-1_HeavyChain | 2889 | 22-41 | 34-43 | |
| anti-HIV-1_HeavyChain | 2890 | 22-41 | | |
| anti-HIV-1_HeavyChain | 2891 | 22-41 | | |
| anti-HIV-1_HeavyChain | 2892 | 22-41 | 34-43 | |
| anti-HIV-1_HeavyChain | 2893 | 22-41 | 34-43 | |
| anti-HIV-1_HeavyChain | 2894 | 22-41 | | |
| anti-HIV-1_HeavyChain | 2895 | 22-41 | | |
| anti-HIV-1_HeavyChain | 2896 | 22-41 | | |
| anti-HIV-1_HeavyChain | 2897 | 22-41 | | |
| anti-HIV-1_HeavyChain | 2898 | 22-41 | | |
| anti-HIV-1_HeavyChain | 2899 | 22-41 | | |
| anti-HIV-1_HeavyChain | 2900 | 22-41 | 137-138 | 96-115 |
| anti-HIV-1_HeavyChain | 2901 | 22-41 | | 96-115 |
| anti-HIV-1_HeavyChain | 2902 | 22-41 | | 96-115 |
| anti-HIV-1_HeavyChain | 2903 | 22-41 | 34-43 | |
| anti-HIV-1_HeavyChain | 2904 | 22-41 | | |
| anti-HIV-1_HeavyChain | 2905 | 22-41 | | |
| anti-HIV-1_HeavyChain | 2906 | 22-41 | | |
| anti-HIV-1_HeavyChain | 2907 | 22-41 | 35-44 | |
| anti-HIV-1_HeavyChain | 2908 | 22-41 | | |
| anti-HIV-1_HeavyChain | 2909 | 22-41 | | |
| anti-HIV-1_HeavyChain | 2910 | 22-41 | | 96-115 |
| anti-HIV-1_HeavyChain | 2911 | 22-41 | | 96-115 |
| anti-HIV-1_HeavyChain | 2912 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 2913 | 22-41 | | |
| anti-HIV-1_HeavyChain | 2914 | 22-41 | | |
| anti-HIV-1_HeavyChain | 2915 | 22-41 | | |
| anti-HIV-1_HeavyChain | 2916 | 22-41 | | |
| anti-HIV-1_HeavyChain | 2917 | 22-41 | | |
| anti-HIV-1_HeavyChain | 2918 | 22-41 | 140-141 | |
| anti-HIV-1_HeavyChain | 2919 | 22-41 | | |
| anti-HIV-1_HeavyChain | 2920 | 22-41 | | |
| anti-HIV-1_HeavyChain | 2921 | 22-41 | | 96-115 |
| anti-HIV-1_HeavyChain | 2922 | 22-41 | | 94-113 |
| anti-HIV-1_HeavyChain | 2923 | 22-41 | | |
| anti-HIV-1_HeavyChain | 2924 | 22-41 | | |
| anti-HIV-1_HeavyChain | 2925 | 22-41 | 28-37 | |
| anti-HIV-1_HeavyChain | 2926 | 22-41 | | |
| anti-HIV-1_HeavyChain | 2927 | 22-41 | | |
| anti-HIV-1_HeavyChain | 2928 | 22-41 | | 96-115 |
| anti-HIV-1_HeavyChain | 2929 | 22-41 | | 96-115 |
| anti-HIV-1_HeavyChain | 2930 | 22-41 | | |
| anti-HIV-1_HeavyChain | 2931 | 22-41 | | |
| anti-HIV-1_HeavyChain | 2932 | 22-41 | 93-102 | |
| anti-HIV-1_HeavyChain | 2933 | 22-41 | | |
| anti-HIV-1_HeavyChain | 2934 | 22-41 | | |
| anti-HIV-1_HeavyChain | 2935 | 22-41 | | |
| anti-HIV-1_HeavyChain | 2936 | 22-41 | | |
| anti-HIV-1_HeavyChain | 2937 | 22-41 | | |
| anti-HIV-1_HeavyChain | 2938 | 22-41 | | |
| anti-HIV-1_HeavyChain | 2939 | 22-41 | | |
| anti-HIV-1_HeavyChain | 2940 | 22-41 | | |
| anti-HIV-1_HeavyChain | 2941 | 22-41 | | 96-115 |
| anti-HIV-1_HeavyChain | 2942 | 22-41 | | 96-115 |
| anti-HIV-1_HeavyChain | 2943 | 22-41 | | |
| anti-HIV-1_HeavyChain | 2944 | 22-41 | | |
| anti-HIV-1_HeavyChain | 2945 | 22-41 | | |
| anti-HIV-1_HeavyChain | 2946 | 22-41 | 35-44 | |
| anti-HIV-1_HeavyChain | 2947 | 22-41 | | |
| anti-HIV-1_HeavyChain | 2948 | 22-41 | | |
| anti-HIV-1_HeavyChain | 2949 | 22-41 | 35-44 | |
| anti-HIV-1_HeavyChain | 2950 | 22-41 | | |
| anti-HIV-1_HeavyChain | 2951 | 22-41 | | |
| anti-HIV-1_HeavyChain | 2952 | 22-41 | | |
| anti-HIV-1_HeavyChain | 2953 | 22-41 | | 96-115 |
| anti-HIV-1_HeavyChain | 2954 | 22-41 | | |
| anti-HIV-1_HeavyChain | 2955 | 22-41 | | |
| anti-HIV-1_HeavyChain | 2956 | 22-41 | | |
| anti-HIV-1_HeavyChain | 2957 | 22-41 | | |
| anti-HIV-1_HeavyChain | 2958 | 22-41 | | |
| anti-HIV-1_HeavyChain | 2959 | 22-41 | | |
| anti-HIV-1_HeavyChain | 2960 | 22-41 | | |
| anti-HIV-1_HeavyChain | 2961 | 22-41 | | |
| anti-HIV-1_HeavyChain | 2962 | 22-41 | | |
| anti-HIV-1_HeavyChain | 2963 | 22-41 | | |
| anti-HIV-1_HeavyChain | 2964 | 22-41 | | |
| anti-HIV-1_HeavyChain | 2965 | 22-41 | | |
| anti-HIV-1_HeavyChain | 2966 | 22-41 | | |
| anti-HIV-1_HeavyChain | 2967 | 22-41 | | |
| anti-HIV-1_HeavyChain | 2968 | 22-41 | | |
| anti-HIV-1_HeavyChain | 2969 | 22-41 | | |
| anti-HIV-1_HeavyChain | 2970 | 22-41 | | |
| anti-HIV-1_HeavyChain | 2971 | 22-41 | | |
| anti-HIV-1_HeavyChain | 2972 | 22-41 | | |
| anti-HIV-1_HeavyChain | 2973 | 22-41 | | |
| anti-HIV-1_HeavyChain | 2974 | 22-41 | | |
| anti-HIV-1_HeavyChain | 2975 | 22-41 | | |
| anti-HIV-1_HeavyChain | 2976 | 22-41 | | |
| anti-HIV-1_HeavyChain | 2977 | 22-41 | 35-44 | |
| anti-HIV-1_HeavyChain | 2978 | 22-41 | 35-44 | |
| anti-HIV-1_HeavyChain | 2979 | 22-41 | | |
| anti-HIV-1_HeavyChain | 2980 | 22-41 | | |
| anti-HIV-1_HeavyChain | 2981 | 22-41 | | |
| anti-HIV-1_HeavyChain | 2982 | 22-41 | | |
| anti-HIV-1_HeavyChain | 2983 | 22-41 | | |
| anti-HIV-1_HeavyChain | 2984 | 22-41 | | |
| anti-HIV-1_HeavyChain | 2985 | 22-41 | 35-44 | |
| anti-HIV-1_HeavyChain | 2986 | 22-41 | | |
| anti-HIV-1_HeavyChain | 2987 | 22-41 | | |
| anti-HIV-1_HeavyChain | 2988 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 2989 | 22-41 | | 94-113 |
| anti-HIV-1_HeavyChain | 2990 | 22-41 | | |
| anti-HIV-1_HeavyChain | 2991 | 22-41 | | |
| anti-HIV-1_HeavyChain | 2992 | 22-41 | | |
| anti-HIV-1_HeavyChain | 2993 | 22-41 | | |
| anti-HIV-1_HeavyChain | 2994 | 22-41 | | |
| anti-HIV-1_HeavyChain | 2995 | 22-41 | | |
| anti-HIV-1_HeavyChain | 2996 | 22-41 | | |
| anti-HIV-1_HeavyChain | 2997 | 22-41 | | |
| anti-HIV-1_HeavyChain | 2998 | 22-41 | | |
| anti-HIV-1_HeavyChain | 2999 | 22-41 | | |
| anti-HIV-1_HeavyChain | 3000 | 22-41 | | |
| anti-HIV-1_HeavyChain | 3001 | 22-41 | | |
| anti-HIV-1_HeavyChain | 3002 | 22-41 | | |
| anti-HIV-1_HeavyChain | 3003 | 22-41 | | |
| anti-HIV-1_HeavyChain | 3004 | 22-41 | | |
| anti-HIV-1_HeavyChain | 3005 | 22-41 | | |
| anti-HIV-1_HeavyChain | 3006 | 22-41 | 95-104 | |
| anti-HIV-1_HeavyChain | 3007 | 22-41 | | |
| anti-HIV-1_HeavyChain | 3008 | 22-41 | | |
| anti-HIV-1_HeavyChain | 3009 | 22-41 | | |
| anti-HIV-1_HeavyChain | 3010 | 22-41 | | |
| anti-HIV-1_HeavyChain | 3011 | 22-41 | | |
| anti-HIV-1_HeavyChain | 3012 | 22-41 | | |
| anti-HIV-1_HeavyChain | 3013 | 22-41 | | |
| anti-HIV-1_HeavyChain | 3014 | 22-41 | | |
| anti-HIV-1_HeavyChain | 3015 | 22-41 | | |
| anti-HIV-1_HeavyChain | 3016 | 22-41 | 35-44 | |
| anti-HIV-1_HeavyChain | 3017 | 22-41 | | |
| anti-HIV-1_HeavyChain | 3018 | 22-41 | | |
| anti-HIV-1_HeavyChain | 3019 | 22-41 | | |
| anti-HIV-1_HeavyChain | 3020 | 22-41 | | |
| anti-HIV-1_HeavyChain | 3021 | 22-41 | | |
| anti-HIV-1_HeavyChain | 3022 | 22-41 | | |
| anti-HIV-1_HeavyChain | 3023 | 22-41 | | |
| anti-HIV-1_HeavyChain | 3024 | 22-41 | | |
| anti-HIV-1_HeavyChain | 3025 | 22-41 | | |
| anti-HIV-1_HeavyChain | 3026 | 22-41 | | |
| anti-HIV-1_HeavyChain | 3027 | 22-41 | | |
| anti-HIV-1_HeavyChain | 3028 | 22-41 | | |
| anti-HIV-1_HeavyChain | 3029 | 22-41 | 35-44 | |
| anti-HIV-1_HeavyChain | 3030 | 22-41 | | |
| anti-HIV-1_HeavyChain | 3031 | 22-41 | | |
| anti-HIV-1_HeavyChain | 3032 | 22-41 | | |
| anti-HIV-1_HeavyChain | 3033 | 22-41 | | |
| anti-HIV-1_HeavyChain | 3034 | 22-41 | | |
| anti-HIV-1_HeavyChain | 3035 | 22-41 | | |
| anti-HIV-1_HeavyChain | 3036 | 22-41 | | |
| anti-HIV-1_HeavyChain | 3037 | 22-41 | | |
| anti-HIV-1_HeavyChain | 3038 | 22-41 | | |
| anti-HIV-1_HeavyChain | 3039 | 22-41 | 35-44 | |
| anti-HIV-1_HeavyChain | 3040 | 22-41 | | |
| anti-HIV-1_HeavyChain | 3041 | 22-41 | | |
| anti-HIV-1_HeavyChain | 3042 | 22-41 | | |
| anti-HIV-1_HeavyChain | 3043 | 22-41 | | |
| anti-HIV-1_HeavyChain | 3044 | 22-41 | | |
| anti-HIV-1_HeavyChain | 3045 | 22-41 | | |
| anti-HIV-1_HeavyChain | 3046 | 22-41 | | |
| anti-HIV-1_HeavyChain | 3047 | 22-41 | | |
| anti-HIV-1_HeavyChain | 3048 | 22-41 | | |
| anti-HIV-1_HeavyChain | 3049 | 22-41 | | |
| anti-HIV-1_HeavyChain | 3050 | 22-41 | | |
| anti-HIV-1_HeavyChain | 3051 | 22-41 | | |
| anti-HIV-1_HeavyChain | 3052 | 22-41 | 35-44 | |
| anti-HIV-1_HeavyChain | 3053 | 22-41 | | |
| anti-HIV-1_HeavyChain | 3054 | 22-41 | 35-44 | |
| anti-HIV-1_HeavyChain | 3055 | 22-41 | | |
| anti-HIV-1_HeavyChain | 3056 | 22-41 | | |
| anti-HIV-1_HeavyChain | 3057 | 22-41 | | |
| anti-HIV-1_HeavyChain | 3058 | 22-41 | | |
| anti-HIV-1_HeavyChain | 3059 | 22-41 | | |
| anti-HIV-1_HeavyChain | 3060 | 22-41 | 35-44 | |
| anti-HIV-1_HeavyChain | 3061 | 22-41 | 35-44 | |
| anti-HIV-1_HeavyChain | 3062 | 22-41 | | |
| anti-HIV-1_HeavyChain | 3063 | 22-41 | | |
| anti-HIV-1_HeavyChain | 3064 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3065 | 22-41 | | |
| anti-HIV-1_HeavyChain | 3066 | 22-41 | | |
| anti-HIV-1_HeavyChain | 3067 | 22-41 | | |
| anti-HIV-1_HeavyChain | 3068 | 22-41 | | |
| anti-HIV-1_HeavyChain | 3069 | 22-41 | | |
| anti-HIV-1_HeavyChain | 3070 | 22-41 | | |
| anti-HIV-1_HeavyChain | 3071 | 22-41 | | |
| anti-HIV-1_HeavyChain | 3072 | 22-41 | | |
| anti-HIV-1_HeavyChain | 3073 | 22-41 | | |
| anti-HIV-1_HeavyChain | 3074 | 22-41 | 35-44 | |
| anti-HIV-1_HeavyChain | 3075 | 22-41 | | |
| anti-HIV-1_HeavyChain | 3076 | 22-41 | 95-104 | |
| anti-HIV-1_HeavyChain | 3077 | 22-41 | 35-44 | |
| anti-HIV-1_HeavyChain | 3078 | 22-41 | | |
| anti-HIV-1_HeavyChain | 3079 | 22-41 | | |
| anti-HIV-1_HeavyChain | 3080 | 22-41 | | |
| anti-HIV-1_HeavyChain | 3081 | 22-41 | | |
| anti-HIV-1_HeavyChain | 3082 | 22-41 | | |
| anti-HIV-1_HeavyChain | 3083 | 22-41 | | |
| anti-HIV-1_HeavyChain | 3084 | 22-41 | | |
| anti-HIV-1_HeavyChain | 3085 | 22-41 | 35-44 | |
| anti-HIV-1_HeavyChain | 3086 | 22-41 | | |
| anti-HIV-1_HeavyChain | 3087 | 22-41 | | |
| anti-HIV-1_HeavyChain | 3088 | 22-41 | | |
| anti-HIV-1_HeavyChain | 3089 | 22-41 | | |
| anti-HIV-1_HeavyChain | 3090 | 22-41 | | |
| anti-HIV-1_HeavyChain | 3091 | 22-41 | | |
| anti-HIV-1_HeavyChain | 3092 | 22-41 | | |
| anti-HIV-1_HeavyChain | 3093 | 22-41 | | |
| anti-HIV-1_HeavyChain | 3094 | 22-41 | 35-44 | |
| anti-HIV-1_HeavyChain | 3095 | 22-41 | | |
| anti-HIV-1_HeavyChain | 3096 | 22-41 | | |
| anti-HIV-1_HeavyChain | 3097 | 22-41 | | |
| anti-HIV-1_HeavyChain | 3098 | 22-41 | | |
| anti-HIV-1_HeavyChain | 3099 | 22-41 | 35-44 | |
| anti-HIV-1_HeavyChain | 3100 | 22-41 | | |
| anti-HIV-1_HeavyChain | 3101 | 22-41 | | |
| anti-HIV-1_HeavyChain | 3102 | 22-41 | | |
| anti-HIV-1_HeavyChain | 3103 | 22-41 | | |
| anti-HIV-1_HeavyChain | 3104 | 22-41 | | |
| anti-HIV-1_HeavyChain | 3105 | 22-41 | | |
| anti-HIV-1_HeavyChain | 3106 | 22-41 | | |
| anti-HIV-1_HeavyChain | 3107 | 22-41 | | |
| anti-HIV-1_HeavyChain | 3108 | 22-41 | | |
| anti-HIV-1_HeavyChain | 3109 | 22-41 | | |
| anti-HIV-1_HeavyChain | 3110 | 22-41 | | |
| anti-HIV-1_HeavyChain | 3111 | 22-41 | | |
| anti-HIV-1_HeavyChain | 3112 | 22-41 | 95-104 | |
| anti-HIV-1_HeavyChain | 3113 | 22-41 | | |
| anti-HIV-1_HeavyChain | 3114 | 22-41 | | |
| anti-HIV-1_HeavyChain | 3115 | 22-41 | | |
| anti-HIV-1_HeavyChain | 3116 | 22-41 | | |
| anti-HIV-1_HeavyChain | 3117 | 22-41 | | |
| anti-HIV-1_HeavyChain | 3118 | 22-41 | | |
| anti-HIV-1_HeavyChain | 3119 | 22-41 | | |
| anti-HIV-1_HeavyChain | 3120 | 22-41 | | |
| anti-HIV-1_HeavyChain | 3121 | 22-41 | | |
| anti-HIV-1_HeavyChain | 3122 | 22-41 | 35-44 | |
| anti-HIV-1_HeavyChain | 3123 | 22-41 | | |
| anti-HIV-1_HeavyChain | 3124 | 22-41 | | |
| anti-HIV-1_HeavyChain | 3125 | 22-41 | | |
| anti-HIV-1_HeavyChain | 3126 | 22-41 | | |
| anti-HIV-1_HeavyChain | 3127 | 22-41 | | |
| anti-HIV-1_HeavyChain | 3128 | 22-41 | | |
| anti-HIV-1_HeavyChain | 3129 | 22-41 | | |
| anti-HIV-1_HeavyChain | 3130 | 22-41 | 95-104 | |
| anti-HIV-1_HeavyChain | 3131 | 22-41 | 95-104 | |
| anti-HIV-1_HeavyChain | 3132 | 22-41 | | |
| anti-HIV-1_HeavyChain | 3133 | 22-41 | | |
| anti-HIV-1_HeavyChain | 3134 | 22-41 | | |
| anti-HIV-1_HeavyChain | 3135 | 22-41 | | |
| anti-HIV-1_HeavyChain | 3136 | 22-41 | | |
| anti-HIV-1_HeavyChain | 3137 | 22-41 | | |
| anti-HIV-1_HeavyChain | 3138 | 22-41 | | |
| anti-HIV-1_HeavyChain | 3139 | 22-41 | | |
| anti-HIV-1_HeavyChain | 3140 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3141 | 22-41 | 35-44 | |
| anti-HIV-1_HeavyChain | 3142 | 22-41 | | |
| anti-HIV-1_HeavyChain | 3143 | 22-41 | | |
| anti-HIV-1_HeavyChain | 3144 | 22-41 | | |
| anti-HIV-1_HeavyChain | 3145 | 22-41 | 95-104 | |
| anti-HIV-1_HeavyChain | 3146 | 22-41 | | |
| anti-HIV-1_HeavyChain | 3147 | 22-41 | | |
| anti-HIV-1_HeavyChain | 3148 | 22-41 | | |
| anti-HIV-1_HeavyChain | 3149 | 22-41 | 35-44 | |
| anti-HIV-1_HeavyChain | 3150 | 22-41 | | |
| anti-HIV-1_HeavyChain | 3151 | 22-41 | 35-44 | |
| anti-HIV-1_HeavyChain | 3152 | 22-41 | | |
| anti-HIV-1_HeavyChain | 3153 | 22-41 | | |
| anti-HIV-1_HeavyChain | 3154 | 22-41 | | |
| anti-HIV-1_HeavyChain | 3155 | 22-41 | 35-44 | |
| anti-HIV-1_HeavyChain | 3156 | 22-41 | | |
| anti-HIV-1_HeavyChain | 3157 | 22-41 | | |
| anti-HIV-1_HeavyChain | 3158 | 22-41 | | |
| anti-HIV-1_HeavyChain | 3159 | 22-41 | | |
| anti-HIV-1_HeavyChain | 3160 | 22-41 | | |
| anti-HIV-1_HeavyChain | 3161 | 22-41 | 95-104 | |
| anti-HIV-1_HeavyChain | 3162 | 22-41 | | |
| anti-HIV-1_HeavyChain | 3163 | 22-41 | | |
| anti-HIV-1_HeavyChain | 3164 | 22-41 | | |
| anti-HIV-1_HeavyChain | 3165 | 22-41 | | |
| anti-HIV-1_HeavyChain | 3166 | 22-41 | 35-44 | |
| anti-HIV-1_HeavyChain | 3167 | 22-41 | | |
| anti-HIV-1_HeavyChain | 3168 | 22-41 | 35-44 | |
| anti-HIV-1_HeavyChain | 3169 | 22-41 | | |
| anti-HIV-1_HeavyChain | 3170 | 22-41 | 35-44 | |
| anti-HIV-1_HeavyChain | 3171 | 22-41 | | |
| anti-HIV-1_HeavyChain | 3172 | 22-41 | 95-104 | |
| anti-HIV-1_HeavyChain | 3173 | 22-41 | | |
| anti-HIV-1_HeavyChain | 3174 | 22-41 | | |
| anti-HIV-1_HeavyChain | 3175 | 22-41 | | |
| anti-HIV-1_HeavyChain | 3176 | 22-41 | | |
| anti-HIV-1_HeavyChain | 3177 | 22-41 | | |
| anti-HIV-1_HeavyChain | 3178 | 22-41 | 95-104 | |
| anti-HIV-1_HeavyChain | 3179 | 22-41 | | |
| anti-HIV-1_HeavyChain | 3180 | 22-41 | 35-44 | |
| anti-HIV-1_HeavyChain | 3181 | 22-41 | | |
| anti-HIV-1_HeavyChain | 3182 | 22-41 | | |
| anti-HIV-1_HeavyChain | 3183 | 22-41 | | |
| anti-HIV-1_HeavyChain | 3184 | 22-41 | | |
| anti-HIV-1_HeavyChain | 3185 | 22-41 | | |
| anti-HIV-1_HeavyChain | 3186 | 22-41 | 35-44 | |
| anti-HIV-1_HeavyChain | 3187 | 22-41 | | |
| anti-HIV-1_HeavyChain | 3188 | 22-41 | | |
| anti-HIV-1_HeavyChain | 3189 | 22-41 | | |
| anti-HIV-1_HeavyChain | 3190 | 22-41 | | |
| anti-HIV-1_HeavyChain | 3191 | 22-41 | | |
| anti-HIV-1_HeavyChain | 3192 | 22-41 | | |
| anti-HIV-1_HeavyChain | 3193 | 22-41 | | |
| anti-HIV-1_HeavyChain | 3194 | 22-41 | | |
| anti-HIV-1_HeavyChain | 3195 | 22-41 | | |
| anti-HIV-1_HeavyChain | 3196 | 22-41 | | |
| anti-HIV-1_HeavyChain | 3197 | 22-41 | | |
| anti-HIV-1_HeavyChain | 3198 | 22-41 | | |
| anti-HIV-1_HeavyChain | 3199 | 22-41 | 35-44 | |
| anti-HIV-1_HeavyChain | 3200 | 22-41 | | |
| anti-HIV-1_HeavyChain | 3201 | 22-41 | | |
| anti-HIV-1_HeavyChain | 3202 | 22-41 | 35-44 | |
| anti-HIV-1_HeavyChain | 3203 | 22-41 | | |
| anti-HIV-1_HeavyChain | 3204 | 22-41 | | |
| anti-HIV-1_HeavyChain | 3205 | 22-41 | | |
| anti-HIV-1_HeavyChain | 3206 | 22-41 | | |
| anti-HIV-1_HeavyChain | 3207 | 22-41 | | |
| anti-HIV-1_HeavyChain | 3208 | 22-41 | 28-37 | |
| anti-HIV-1_HeavyChain | 3209 | 22-41 | | |
| anti-HIV-1_HeavyChain | 3210 | 22-41 | | |
| anti-HIV-1_HeavyChain | 3211 | 22-41 | | |
| anti-HIV-1_HeavyChain | 3212 | 22-41 | | |
| anti-HIV-1_HeavyChain | 3213 | 22-41 | | |
| anti-HIV-1_HeavyChain | 3214 | 22-41 | | |
| anti-HIV-1_HeavyChain | 3215 | 22-41 | | |
| anti-HIV-1_HeavyChain | 3216 | 22-41 | | |

TABLE 5-continued

| CDRs of exemplified antibodies | | | | |
|---|---|---|---|---|
| Name | Protein SEQ ID NO | CDR1 | CDR2 | CDR3 |
| anti-HIV-1_HeavyChain | 3217 | 22-41 | 35-44 | |
| anti-HIV-1_HeavyChain | 3218 | 22-41 | 35-44 | |
| anti-HIV-1_HeavyChain | 3219 | 22-41 | | |
| anti-HIV-1_HeavyChain | 3220 | 22-41 | 35-44 | |
| anti-HIV-1_HeavyChain | 3221 | 22-41 | | |
| anti-HIV-1_HeavyChain | 3222 | 22-41 | | |
| anti-HIV-1_HeavyChain | 3223 | 22-41 | | |
| anti-HIV-1_HeavyChain | 3224 | 22-41 | | |
| anti-HIV-1_HeavyChain | 3225 | 22-41 | 35-44 | |
| anti-HIV-1_HeavyChain | 3226 | 22-41 | 35-44 | |
| anti-HIV-1_HeavyChain | 3227 | 22-41 | | |
| anti-HIV-1_HeavyChain | 3228 | 22-41 | | |
| anti-HIV-1_HeavyChain | 3229 | 22-41 | | |
| anti-HIV-1_HeavyChain | 3230 | 22-41 | | |
| anti-HIV-1_HeavyChain | 3231 | 22-41 | | |
| anti-HIV-1_HeavyChain | 3232 | 22-41 | 35-44 | |
| anti-HIV-1_HeavyChain | 3233 | 22-41 | | |
| anti-HIV-1_HeavyChain | 3234 | 22-41 | | |
| anti-HIV-1_HeavyChain | 3235 | 22-41 | | |
| anti-HIV-1_HeavyChain | 3236 | 22-41 | | |
| anti-HIV-1_HeavyChain | 3237 | 22-41 | | |
| anti-HIV-1_HeavyChain | 3238 | 22-41 | 95-104 | |
| anti-HIV-1_HeavyChain | 3239 | 22-41 | | |
| anti-HIV-1_HeavyChain | 3240 | 22-41 | | |
| anti-HIV-1_HeavyChain | 3241 | 22-41 | | |
| anti-HIV-1_HeavyChain | 3242 | 22-41 | | |
| anti-HIV-1_HeavyChain | 3243 | 22-41 | | |
| anti-HIV-1_HeavyChain | 3244 | 22-41 | | |
| anti-HIV-1_HeavyChain | 3245 | 22-41 | | |
| anti-HIV-1_HeavyChain | 3246 | 22-41 | | |
| anti-HIV-1_HeavyChain | 3247 | 22-41 | | |
| anti-HIV-1_HeavyChain | 3248 | 22-41 | | |
| anti-HIV-1_HeavyChain | 3249 | 22-41 | | |
| anti-HIV-1_HeavyChain | 3250 | 22-41 | | |
| anti-HIV-1_HeavyChain | 3251 | 22-41 | | |
| anti-HIV-1_HeavyChain | 3252 | 22-41 | | |
| anti-HIV-1_HeavyChain | 3253 | 22-41 | | |
| anti-HIV-1_HeavyChain | 3254 | 22-41 | | |
| anti-HIV-1_HeavyChain | 3255 | 22-41 | | |
| anti-HIV-1_HeavyChain | 3256 | 22-41 | | |
| anti-HIV-1_HeavyChain | 3257 | 22-41 | | |
| anti-HIV-1_HeavyChain | 3258 | 22-41 | | |
| anti-HIV-1_HeavyChain | 3259 | 22-41 | | |
| anti-HIV-1_HeavyChain | 3260 | 22-41 | | |
| anti-HIV-1_HeavyChain | 3261 | 22-41 | | |
| anti-HIV-1_HeavyChain | 3262 | 22-41 | | |
| anti-HIV-1_HeavyChain | 3263 | 22-41 | | |
| anti-HIV-1_HeavyChain | 3264 | 22-41 | | |
| anti-HIV-1_HeavyChain | 3265 | 22-41 | | |
| anti-HIV-1_HeavyChain | 3266 | 22-41 | | |
| anti-HIV-1_HeavyChain | 3267 | 22-41 | | |
| anti-HIV-1_HeavyChain | 3268 | 22-41 | | |
| anti-HIV-1_HeavyChain | 3269 | 22-41 | | |
| anti-HIV-1_HeavyChain | 3270 | 22-41 | | |
| anti-HIV-1_HeavyChain | 3271 | 22-41 | 95-104 | |
| anti-HIV-1_HeavyChain | 3272 | 22-41 | | |
| anti-HIV-1_HeavyChain | 3273 | 22-41 | | |
| anti-HIV-1_HeavyChain | 3274 | 22-41 | | |
| anti-HIV-1_HeavyChain | 3275 | 22-41 | | |
| anti-HIV-1_HeavyChain | 3276 | 22-41 | | |
| anti-HIV-1_HeavyChain | 3277 | 22-41 | | |
| anti-HIV-1_HeavyChain | 3278 | 22-41 | | |
| anti-HIV-1_HeavyChain | 3279 | 22-41 | | |
| anti-HIV-1_HeavyChain | 3280 | 22-41 | | |
| anti-HIV-1_HeavyChain | 3281 | 22-41 | | |
| anti-HIV-1_HeavyChain | 3282 | 22-41 | | |
| anti-HIV-1_HeavyChain | 3283 | 22-41 | | |
| anti-HIV-1_HeavyChain | 3284 | 22-41 | | |
| anti-HIV-1_HeavyChain | 3285 | 22-41 | | |
| anti-HIV-1_HeavyChain | 3286 | 22-41 | | |
| anti-HIV-1_HeavyChain | 3287 | 22-41 | | |
| anti-HIV-1_HeavyChain | 3288 | 22-41 | | |
| anti-HIV-1_HeavyChain | 3289 | 22-41 | | |
| anti-HIV-1_HeavyChain | 3290 | 22-41 | | |
| anti-HIV-1_HeavyChain | 3291 | 22-41 | 95-104 | |
| anti-HIV-1_HeavyChain | 3292 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3293 | 22-41 | | |
| anti-HIV-1_HeavyChain | 3294 | 22-41 | | |
| anti-HIV-1_HeavyChain | 3295 | 22-41 | | |
| anti-HIV-1_HeavyChain | 3296 | 22-41 | | |
| anti-HIV-1_HeavyChain | 3297 | 22-41 | | |
| anti-HIV-1_HeavyChain | 3298 | 22-41 | | |
| anti-HIV-1_HeavyChain | 3299 | 22-41 | 35-44 | |
| anti-HIV-1_HeavyChain | 3300 | 22-41 | | |
| anti-HIV-1_HeavyChain | 3301 | 22-41 | | |
| anti-HIV-1_HeavyChain | 3302 | 22-41 | | |
| anti-HIV-1_HeavyChain | 3303 | 22-41 | | |
| anti-HIV-1_HeavyChain | 3304 | 22-41 | | |
| anti-HIV-1_HeavyChain | 3305 | 22-41 | | |
| anti-HIV-1_HeavyChain | 3306 | 22-41 | | |
| anti-HIV-1_HeavyChain | 3307 | 22-41 | | |
| anti-HIV-1_HeavyChain | 3308 | 22-41 | | |
| anti-HIV-1_HeavyChain | 3309 | 22-41 | | |
| anti-HIV-1_HeavyChain | 3310 | 22-41 | | |
| anti-HIV-1_HeavyChain | 3311 | 22-41 | | |
| anti-HIV-1_HeavyChain | 3312 | 22-41 | | |
| anti-HIV-1_HeavyChain | 3313 | 22-41 | 35-44 | |
| anti-HIV-1_HeavyChain | 3314 | 22-41 | | |
| anti-HIV-1_HeavyChain | 3315 | 22-41 | 95-104 | |
| anti-HIV-1_HeavyChain | 3316 | 22-41 | | |
| anti-HIV-1_HeavyChain | 3317 | 22-41 | | |
| anti-HIV-1_HeavyChain | 3318 | 22-41 | | |
| anti-HIV-1_HeavyChain | 3319 | 22-41 | | |
| anti-HIV-1_HeavyChain | 3320 | 22-41 | | |
| anti-HIV-1_HeavyChain | 3321 | 22-41 | | |
| anti-HIV-1_HeavyChain | 3322 | 22-41 | | |
| anti-HIV-1_HeavyChain | 3323 | 22-41 | | |
| anti-HIV-1_HeavyChain | 3324 | 22-41 | | |
| anti-HIV-1_HeavyChain | 3325 | 22-41 | | |
| anti-HIV-1_HeavyChain | 3326 | 22-41 | | |
| anti-HIV-1_HeavyChain | 3327 | 22-41 | | |
| anti-HIV-1_HeavyChain | 3328 | 22-41 | | |
| anti-HIV-1_HeavyChain | 3329 | 22-41 | | |
| anti-HIV-1_HeavyChain | 3330 | 22-41 | | |
| anti-HIV-1_HeavyChain | 3331 | 22-41 | | |
| anti-HIV-1_HeavyChain | 3332 | 22-41 | | |
| anti-HIV-1_HeavyChain | 3333 | 22-41 | | |
| anti-HIV-1_HeavyChain | 3334 | 22-41 | | |
| anti-HIV-1_HeavyChain | 3335 | 22-41 | | |
| anti-HIV-1_HeavyChain | 3336 | 22-41 | | |
| anti-HIV-1_HeavyChain | 3337 | 22-41 | | |
| anti-HIV-1_HeavyChain | 3338 | 22-41 | | |
| anti-HIV-1_HeavyChain | 3339 | 22-41 | | |
| anti-HIV-1_HeavyChain | 3340 | 22-41 | | |
| anti-HIV-1_HeavyChain | 3341 | 22-41 | | |
| anti-HIV-1_HeavyChain | 3342 | 22-41 | 95-104 | |
| anti-HIV-1_HeavyChain | 3343 | 22-41 | | |
| anti-HIV-1_HeavyChain | 3344 | 22-41 | | |
| anti-HIV-1_HeavyChain | 3345 | 22-41 | | |
| anti-HIV-1_HeavyChain | 3346 | 22-41 | | |
| anti-HIV-1_HeavyChain | 3347 | 22-41 | | |
| anti-HIV-1_HeavyChain | 3348 | 22-41 | | |
| anti-HIV-1_HeavyChain | 3349 | 22-41 | | |
| anti-HIV-1_HeavyChain | 3350 | 22-41 | | |
| anti-HIV-1_HeavyChain | 3351 | 22-41 | | |
| anti-HIV-1_HeavyChain | 3352 | 22-41 | | |
| anti-HIV-1_HeavyChain | 3353 | 22-41 | | |
| anti-HIV-1_HeavyChain | 3354 | 22-41 | | |
| anti-HIV-1_HeavyChain | 3355 | 22-41 | | |
| anti-HIV-1_HeavyChain | 3356 | 22-41 | | |
| anti-HIV-1_HeavyChain | 3357 | 22-41 | | |
| anti-HIV-1_HeavyChain | 3358 | 22-41 | | |
| anti-HIV-1_HeavyChain | 3359 | 22-41 | | |
| anti-HIV-1_HeavyChain | 3360 | 22-41 | | |
| anti-HIV-1_HeavyChain | 3361 | 22-41 | | |
| anti-HIV-1_HeavyChain | 3362 | 22-41 | | |
| anti-HIV-1_HeavyChain | 3363 | 22-41 | | |
| anti-HIV-1_HeavyChain | 3364 | 22-41 | | |
| anti-HIV-1_HeavyChain | 3365 | 22-41 | | |
| anti-HIV-1_HeavyChain | 3366 | 22-41 | | |
| anti-HIV-1_HeavyChain | 3367 | 22-41 | | |
| anti-HIV-1_HeavyChain | 3368 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3369 | 22-41 | | |
| anti-HIV-1_HeavyChain | 3370 | 22-41 | | |
| anti-HIV-1_HeavyChain | 3371 | 22-41 | | |
| anti-HIV-1_HeavyChain | 3372 | 22-41 | | |
| anti-HIV-1_HeavyChain | 3373 | 22-41 | | |
| anti-HIV-1_HeavyChain | 3374 | 22-41 | | |
| anti-HIV-1_HeavyChain | 3375 | 22-41 | | |
| anti-HIV-1_HeavyChain | 3376 | 22-41 | | |
| anti-HIV-1_HeavyChain | 3377 | 22-41 | | |
| anti-HIV-1_HeavyChain | 3378 | 22-41 | | |
| anti-HIV-1_HeavyChain | 3379 | 22-41 | | |
| anti-HIV-1_HeavyChain | 3380 | 22-41 | | |
| anti-HIV-1_HeavyChain | 3381 | 22-41 | | |
| anti-HIV-1_HeavyChain | 3382 | 22-41 | | |
| anti-HIV-1_HeavyChain | 3383 | 22-41 | | |
| anti-HIV-1_HeavyChain | 3384 | 22-41 | | |
| anti-HIV-1_HeavyChain | 3385 | 22-41 | | |
| anti-HIV-1_HeavyChain | 3386 | 22-41 | | |
| anti-HIV-1_HeavyChain | 3387 | 22-41 | | |
| anti-HIV-1_HeavyChain | 3388 | 22-41 | | |
| anti-HIV-1_HeavyChain | 3389 | 22-41 | | |
| anti-HIV-1_HeavyChain | 3390 | 22-41 | | |
| anti-HIV-1_HeavyChain | 3391 | 22-41 | | |
| anti-HIV-1_HeavyChain | 3392 | 22-41 | | |
| anti-HIV-1_HeavyChain | 3393 | 22-41 | | |
| anti-HIV-1_HeavyChain | 3394 | 22-41 | | |
| anti-HIV-1_HeavyChain | 3395 | 22-41 | | |
| anti-HIV-1_HeavyChain | 3396 | 22-41 | | |
| anti-HIV-1_HeavyChain | 3397 | 22-41 | | |
| anti-HIV-1_HeavyChain | 3398 | 22-41 | | |
| anti-HIV-1_HeavyChain | 3399 | 22-41 | 35-44 | |
| anti-HIV-1_HeavyChain | 3400 | 22-41 | | |
| anti-HIV-1_HeavyChain | 3401 | 22-41 | | |
| anti-HIV-1_HeavyChain | 3402 | 22-41 | | |
| anti-HIV-1_HeavyChain | 3403 | 22-41 | | |
| anti-HIV-1_HeavyChain | 3404 | 22-41 | | |
| anti-HIV-1_HeavyChain | 3405 | 22-41 | | |
| anti-HIV-1_HeavyChain | 3406 | 22-41 | | |
| anti-HIV-1_HeavyChain | 3407 | 22-41 | | |
| anti-HIV-1_HeavyChain | 3408 | 22-41 | | |
| anti-HIV-1_HeavyChain | 3409 | 22-41 | | |
| anti-HIV-1_HeavyChain | 3410 | 22-41 | | |
| anti-HIV-1_HeavyChain | 3411 | 22-41 | | |
| anti-HIV-1_HeavyChain | 3412 | 22-41 | | |
| anti-HIV-1_HeavyChain | 3413 | 22-41 | | |
| anti-HIV-1_HeavyChain | 3414 | 22-41 | | |
| anti-HIV-1_HeavyChain | 3415 | 22-41 | 35-44 | |
| anti-HIV-1_HeavyChain | 3416 | 22-41 | 35-44 | |
| anti-HIV-1_HeavyChain | 3417 | 22-41 | 34-43 | |
| anti-HIV-1_HeavyChain | 3418 | 22-41 | | |
| anti-HIV-1_HeavyChain | 3419 | 22-41 | | |
| anti-HIV-1_HeavyChain | 3420 | 22-41 | | |
| anti-HIV-1_HeavyChain | 3421 | 22-41 | 34-43 | |
| anti-HIV-1_HeavyChain | 3422 | 22-41 | | |
| anti-HIV-1_HeavyChain | 3423 | 22-41 | | |
| anti-HIV-1_HeavyChain | 3424 | 22-41 | | |
| anti-HIV-1_HeavyChain | 3425 | 22-41 | | |
| anti-HIV-1_HeavyChain | 3426 | 22-41 | 35-44 | |
| anti-HIV-1_HeavyChain | 3427 | 22-41 | | |
| anti-HIV-1_HeavyChain | 3428 | 22-41 | | |
| anti-HIV-1_HeavyChain | 3429 | 22-41 | | |
| anti-HIV-1_HeavyChain | 3430 | 22-41 | 35-44 | |
| anti-HIV-1_HeavyChain | 3431 | 22-41 | 35-44 | |
| anti-HIV-1_HeavyChain | 3432 | 22-41 | | |
| anti-HIV-1_HeavyChain | 3433 | 22-41 | | |
| anti-HIV-1_HeavyChain | 3434 | 22-41 | | |
| anti-HIV-1_HeavyChain | 3435 | 22-41 | 35-44 | |
| anti-HIV-1_HeavyChain | 3436 | 22-41 | 35-44 | |
| anti-HIV-1_HeavyChain | 3437 | 22-41 | 35-44 | |
| anti-HIV-1_HeavyChain | 3438 | 22-41 | | |
| anti-HIV-1_HeavyChain | 3439 | 22-41 | | |
| anti-HIV-1_HeavyChain | 3440 | 22-41 | | |
| anti-HIV-1_HeavyChain | 3441 | 22-41 | 35-44 | |
| anti-HIV-1_HeavyChain | 3442 | 22-41 | | |
| anti-HIV-1_HeavyChain | 3443 | 22-41 | | |
| anti-HIV-1_HeavyChain | 3444 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3445 | 22-41 | | |
| anti-HIV-1_HeavyChain | 3446 | 22-41 | 35-44 | |
| anti-HIV-1_HeavyChain | 3447 | 22-41 | 35-44 | |
| anti-HIV-1_HeavyChain | 3448 | 22-41 | | |
| anti-HIV-1_HeavyChain | 3449 | 22-41 | | |
| anti-HIV-1_HeavyChain | 3450 | 22-41 | 35-44 | |
| anti-HIV-1_HeavyChain | 3451 | 22-41 | 35-44 | |
| anti-HIV-1_HeavyChain | 3452 | 22-41 | | |
| anti-HIV-1_HeavyChain | 3453 | 22-41 | | |
| anti-HIV-1_HeavyChain | 3454 | 22-41 | 35-44 | |
| anti-HIV-1_HeavyChain | 3455 | 22-41 | | |
| anti-HIV-1_HeavyChain | 3456 | 22-41 | 35-44 | |
| anti-HIV-1_HeavyChain | 3457 | 22-41 | 35-44 | |
| anti-HIV-1_HeavyChain | 3458 | 22-41 | | |
| anti-HIV-1_HeavyChain | 3459 | 22-41 | | |
| anti-HIV-1_HeavyChain | 3460 | 22-41 | | |
| anti-HIV-1_HeavyChain | 3461 | 22-41 | 35-44 | |
| anti-HIV-1_HeavyChain | 3462 | 22-41 | 35-44 | |
| anti-HIV-1_HeavyChain | 3463 | 22-41 | | |
| anti-HIV-1_HeavyChain | 3464 | 22-41 | 35-44 | |
| anti-HIV-1_HeavyChain | 3465 | 22-41 | | |
| anti-HIV-1_HeavyChain | 3466 | 22-41 | | |
| anti-HIV-1_HeavyChain | 3467 | 22-41 | | |
| anti-HIV-1_HeavyChain | 3468 | 22-41 | | |
| anti-HIV-1_HeavyChain | 3469 | 22-41 | 35-44 | |
| anti-HIV-1_HeavyChain | 3470 | 22-41 | | |
| anti-HIV-1_HeavyChain | 3471 | 22-41 | 35-44 | |
| anti-HIV-1_HeavyChain | 3472 | 22-41 | | |
| anti-HIV-1_HeavyChain | 3473 | 22-41 | | |
| anti-HIV-1_HeavyChain | 3474 | 22-41 | | |
| anti-HIV-1_HeavyChain | 3475 | 22-41 | | |
| anti-HIV-1_HeavyChain | 3476 | 22-41 | 35-44 | |
| anti-HIV-1_HeavyChain | 3477 | 22-41 | 35-44 | |
| anti-HIV-1_HeavyChain | 3478 | 22-41 | | |
| anti-HIV-1_HeavyChain | 3479 | 22-41 | 35-44 | |
| anti-HIV-1_HeavyChain | 3480 | 22-41 | | |
| anti-HIV-1_HeavyChain | 3481 | 22-41 | | |
| anti-HIV-1_HeavyChain | 3482 | 22-41 | 35-44 | |
| anti-HIV-1_HeavyChain | 3483 | 22-41 | 35-44 | |
| anti-HIV-1_HeavyChain | 3484 | 22-41 | | |
| anti-HIV-1_HeavyChain | 3485 | 22-41 | | |
| anti-HIV-1_HeavyChain | 3486 | 22-41 | 35-44 | |
| anti-HIV-1_HeavyChain | 3487 | 22-41 | | |
| anti-HIV-1_HeavyChain | 3488 | 22-41 | | |
| anti-HIV-1_HeavyChain | 3489 | 22-41 | | |
| anti-HIV-1_HeavyChain | 3490 | 22-41 | 35-44 | |
| anti-HIV-1_HeavyChain | 3491 | 22-41 | | |
| anti-HIV-1_HeavyChain | 3492 | 22-41 | | |
| anti-HIV-1_HeavyChain | 3493 | 22-41 | | |
| anti-HIV-1_HeavyChain | 3494 | 22-41 | 35-44 | |
| anti-HIV-1_HeavyChain | 3495 | 22-41 | | |
| anti-HIV-1_HeavyChain | 3496 | 22-41 | 35-44 | |
| anti-HIV-1_HeavyChain | 3497 | 22-41 | 35-44 | |
| anti-HIV-1_HeavyChain | 3498 | 22-41 | | |
| anti-HIV-1_HeavyChain | 3499 | 22-41 | | |
| anti-HIV-1_HeavyChain | 3500 | 22-41 | | |
| anti-HIV-1_HeavyChain | 3501 | 22-41 | 35-44 | |
| anti-HIV-1_HeavyChain | 3502 | 22-41 | 35-44 | |
| anti-HIV-1_HeavyChain | 3503 | 22-41 | 35-44 | |
| anti-HIV-1_HeavyChain | 3504 | 22-41 | 35-44 | |
| anti-HIV-1_HeavyChain | 3505 | 22-41 | 35-44 | |
| anti-HIV-1_HeavyChain | 3506 | 22-41 | 35-44 | |
| anti-HIV-1_HeavyChain | 3507 | 22-41 | | |
| anti-HIV-1_HeavyChain | 3508 | 22-41 | 35-44 | |
| anti-HIV-1_HeavyChain | 3509 | 22-41 | | |
| anti-HIV-1_HeavyChain | 3510 | 22-41 | | |
| anti-HIV-1_HeavyChain | 3511 | 22-41 | | |
| anti-HIV-1_HeavyChain | 3512 | 22-41 | 35-44 | |
| anti-HIV-1_HeavyChain | 3513 | 22-41 | | |
| anti-HIV-1_HeavyChain | 3514 | 22-41 | | |
| anti-HIV-1_HeavyChain | 3515 | 22-41 | 35-44 | |
| anti-HIV-1_HeavyChain | 3516 | 22-41 | | |
| anti-HIV-1_HeavyChain | 3517 | 22-41 | | |
| anti-HIV-1_HeavyChain | 3518 | 22-41 | 35-44 | |
| anti-HIV-1_HeavyChain | 3519 | 22-41 | 35-44 | |
| anti-HIV-1_HeavyChain | 3520 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3521 | 22-41 | 35-44 | |
| anti-HIV-1_HeavyChain | 3522 | 22-41 | | |
| anti-HIV-1_HeavyChain | 3523 | 22-41 | 35-44 | |
| anti-HIV-1_HeavyChain | 3524 | 22-41 | | |
| anti-HIV-1_HeavyChain | 3525 | 22-41 | 35-44 | |
| anti-HIV-1_HeavyChain | 3526 | 22-41 | | |
| anti-HIV-1_HeavyChain | 3527 | 22-41 | 35-44 | |
| anti-HIV-1_HeavyChain | 3528 | 22-41 | 35-44 | |
| anti-HIV-1_HeavyChain | 3529 | 22-41 | 35-44 | |
| anti-HIV-1_HeavyChain | 3530 | 22-41 | 35-44 | |
| anti-HIV-1_HeavyChain | 3531 | 22-41 | 35-44 | |
| anti-HIV-1_HeavyChain | 3532 | 22-41 | 35-44 | |
| anti-HIV-1_HeavyChain | 3533 | 22-41 | | |
| anti-HIV-1_HeavyChain | 3534 | 22-41 | | |
| anti-HIV-1_HeavyChain | 3535 | 22-41 | | |
| anti-HIV-1_HeavyChain | 3536 | 22-41 | | |
| anti-HIV-1_HeavyChain | 3537 | 22-41 | 35-44 | |
| anti-HIV-1_HeavyChain | 3538 | 22-41 | | |
| anti-HIV-1_HeavyChain | 3539 | 22-41 | 35-44 | |
| anti-HIV-1_HeavyChain | 3540 | 22-41 | 35-44 | |
| anti-HIV-1_HeavyChain | 3541 | 22-41 | 35-44 | |
| anti-HIV-1_HeavyChain | 3542 | 22-41 | | |
| anti-HIV-1_HeavyChain | 3543 | 22-41 | 35-44 | |
| anti-HIV-1_HeavyChain | 3544 | 22-41 | | |
| anti-HIV-1_HeavyChain | 3545 | 22-41 | 35-44 | |
| anti-HIV-1_HeavyChain | 3546 | 22-41 | | |
| anti-HIV-1_HeavyChain | 3547 | 22-41 | | |
| anti-HIV-1_HeavyChain | 3548 | 22-41 | 35-44 | |
| anti-HIV-1_HeavyChain | 3549 | 22-41 | | |
| anti-HIV-1_HeavyChain | 3550 | 22-41 | 35-44 | |
| anti-HIV-1_HeavyChain | 3551 | 22-41 | 35-44 | |
| anti-HIV-1_HeavyChain | 3552 | 22-41 | | |
| anti-HIV-1_HeavyChain | 3553 | 22-41 | | |
| anti-HIV-1_HeavyChain | 3554 | 22-41 | 35-44 | |
| anti-HIV-1_HeavyChain | 3555 | 22-41 | | |
| anti-HIV-1_HeavyChain | 3556 | 22-41 | | |
| anti-HIV-1_HeavyChain | 3557 | 22-41 | 35-44 | |
| anti-HIV-1_HeavyChain | 3558 | 22-41 | | |
| anti-HIV-1_HeavyChain | 3559 | 22-41 | 35-44 | |
| anti-HIV-1_HeavyChain | 3560 | 22-41 | | |
| anti-HIV-1_HeavyChain | 3561 | 22-41 | 35-44 | |
| anti-HIV-1_HeavyChain | 3562 | 22-41 | | |
| anti-HIV-1_HeavyChain | 3563 | 22-41 | | |
| anti-HIV-1_HeavyChain | 3564 | 22-41 | | |
| anti-HIV-1_HeavyChain | 3565 | 22-41 | 35-44 | |
| anti-HIV-1_HeavyChain | 3566 | 22-41 | | |
| anti-HIV-1_HeavyChain | 3567 | 22-41 | | |
| anti-HIV-1_HeavyChain | 3568 | 22-41 | | |
| anti-HIV-1_HeavyChain | 3569 | 22-41 | | |
| anti-HIV-1_HeavyChain | 3570 | 22-41 | | |
| anti-HIV-1_HeavyChain | 3571 | 22-41 | 35-44 | |
| anti-HIV-1_HeavyChain | 3572 | 22-41 | | |
| anti-HIV-1_HeavyChain | 3573 | 22-41 | | |
| anti-HIV-1_HeavyChain | 3574 | 22-41 | 35-44 | |
| anti-HIV-1_HeavyChain | 3575 | 22-41 | 35-44 | |
| anti-HIV-1_HeavyChain | 3576 | 22-41 | 36-45 | |
| anti-HIV-1_HeavyChain | 3577 | 22-41 | | |
| anti-HIV-1_HeavyChain | 3578 | 22-41 | 35-44 | |
| anti-HIV-1_HeavyChain | 3579 | 22-41 | 36-45 | |
| anti-HIV-1_HeavyChain | 3580 | 22-41 | | |
| anti-HIV-1_HeavyChain | 3581 | 22-41 | 35-44 | |
| anti-HIV-1_HeavyChain | 3582 | 22-41 | | |
| anti-HIV-1_HeavyChain | 3583 | 22-41 | 34-43 | |
| anti-HIV-1_HeavyChain | 3584 | 22-41 | 34-43 | |
| anti-HIV-1_HeavyChain | 3585 | 22-41 | 34-43 | |
| anti-HIV-1_HeavyChain | 3586 | 22-41 | 34-43 | |
| anti-HIV-1_HeavyChain | 3587 | 22-41 | 34-43 | |
| anti-HIV-1_HeavyChain | 3588 | 22-41 | | |
| anti-HIV-1_HeavyChain | 3589 | 22-41 | | |
| anti-HIV-1_HeavyChain | 3590 | 22-41 | | |
| anti-HIV-1_HeavyChain | 3591 | 22-41 | | |
| anti-HIV-1_HeavyChain | 3592 | 22-41 | | |
| anti-HIV-1_HeavyChain | 3593 | 22-41 | | |
| anti-HIV-1_HeavyChain | 3594 | 22-41 | | |
| anti-HIV-1_HeavyChain | 3595 | 22-41 | 137-139 | |
| anti-HIV-1_HeavyChain | 3596 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3597 | 22-41 | | |
| anti-HIV-1_HeavyChain | 3598 | 22-41 | | |
| anti-HIV-1_HeavyChain | 3599 | 22-41 | | |
| anti-HIV-1_HeavyChain | 3600 | 22-41 | | |
| anti-HIV-1_HeavyChain | 3601 | 22-41 | | |
| anti-HIV-1_HeavyChain | 3602 | 22-41 | | |
| anti-HIV-1_HeavyChain | 3603 | 22-41 | | |
| anti-HIV-1_HeavyChain | 3604 | 22-41 | | |
| anti-HIV-1_HeavyChain | 3605 | 22-41 | 136-138 | |
| anti-HIV-1_HeavyChain | 3606 | 22-41 | | |
| anti-HIV-1_HeavyChain | 3607 | 22-41 | | |
| anti-HIV-1_HeavyChain | 3608 | 22-41 | | |
| anti-HIV-1_HeavyChain | 3609 | 22-41 | 95-104 | |
| anti-HIV-1_HeavyChain | 3610 | 22-41 | | |
| anti-HIV-1_HeavyChain | 3611 | 22-41 | | |
| anti-HIV-1_HeavyChain | 3612 | 22-41 | | |
| anti-HIV-1_HeavyChain | 3613 | 22-41 | | |
| anti-HIV-1_HeavyChain | 3614 | 22-41 | | |
| anti-HIV-1_HeavyChain | 3615 | 22-41 | | |
| anti-HIV-1_HeavyChain | 3616 | 22-41 | | |
| anti-HIV-1_HeavyChain | 3617 | 22-41 | 137-139 | |
| anti-HIV-1_HeavyChain | 3618 | 22-41 | | |
| anti-HIV-1_HeavyChain | 3619 | 22-41 | 137-139 | |
| anti-HIV-1_HeavyChain | 3620 | 22-41 | 137-139 | |
| anti-HIV-1_HeavyChain | 3621 | 22-41 | 137-139 | |
| anti-HIV-1_HeavyChain | 3622 | 22-41 | | |
| anti-HIV-1_HeavyChain | 3623 | 22-41 | | |
| anti-HIV-1_HeavyChain | 3624 | 22-41 | | |
| anti-HIV-1_HeavyChain | 3625 | 22-41 | | |
| anti-HIV-1_HeavyChain | 3626 | 22-41 | | |
| anti-HIV-1_HeavyChain | 3627 | 22-41 | 137-139 | |
| anti-HIV-1_HeavyChain | 3628 | 22-41 | | |
| anti-HIV-1_HeavyChain | 3629 | 22-41 | | |
| anti-HIV-1_HeavyChain | 3630 | 22-41 | | |
| anti-HIV-1_HeavyChain | 3631 | 22-41 | | |
| anti-HIV-1_HeavyChain | 3632 | 22-41 | 137-139 | |
| anti-HIV-1_HeavyChain | 3633 | 22-41 | | |
| anti-HIV-1_HeavyChain | 3634 | 22-41 | | |
| anti-HIV-1_HeavyChain | 3635 | 22-41 | | |
| anti-HIV-1_HeavyChain | 3636 | 22-41 | | |
| anti-HIV-1_HeavyChain | 3637 | 22-41 | | |
| anti-HIV-1_HeavyChain | 3638 | 22-41 | | |
| anti-HIV-1_HeavyChain | 3639 | 22-41 | | |
| anti-HIV-1_HeavyChain | 3640 | 22-41 | | |
| anti-HIV-1_HeavyChain | 3641 | 22-41 | | |
| anti-HIV-1_HeavyChain | 3642 | 22-41 | | |
| anti-HIV-1_HeavyChain | 3643 | 22-41 | | |
| anti-HIV-1_HeavyChain | 3644 | 22-41 | 137-139 | |
| anti-HIV-1_HeavyChain | 3645 | 22-41 | | |
| anti-HIV-1_HeavyChain | 3646 | 22-41 | | |
| anti-HIV-1_HeavyChain | 3647 | 22-41 | | |
| anti-HIV-1_HeavyChain | 3648 | 22-41 | | |
| anti-HIV-1_HeavyChain | 3649 | 22-41 | | |
| anti-HIV-1_HeavyChain | 3650 | 22-41 | | |
| anti-HIV-1_HeavyChain | 3651 | 22-41 | | |
| anti-HIV-1_HeavyChain | 3652 | 22-41 | | |
| anti-HIV-1_HeavyChain | 3653 | 22-41 | | |
| anti-HIV-1_HeavyChain | 3654 | 22-41 | 137-139 | |
| anti-HIV-1_HeavyChain | 3655 | 22-41 | | |
| anti-HIV-1_HeavyChain | 3656 | 22-41 | | |
| anti-HIV-1_HeavyChain | 3657 | 22-41 | | |
| anti-HIV-1_HeavyChain | 3658 | 22-41 | | |
| anti-HIV-1_HeavyChain | 3659 | 22-41 | | |
| anti-HIV-1_HeavyChain | 3660 | 22-41 | | |
| anti-HIV-1_HeavyChain | 3661 | 22-41 | | |
| anti-HIV-1_HeavyChain | 3662 | 22-41 | | |
| anti-HIV-1_HeavyChain | 3663 | 22-41 | | |
| anti-HIV-1_HeavyChain | 3664 | 22-41 | 35-44 | |
| anti-HIV-1_HeavyChain | 3665 | 22-41 | | |
| anti-HIV-1_HeavyChain | 3666 | 22-41 | | |
| anti-HIV-1_HeavyChain | 3667 | 22-41 | | |
| anti-HIV-1_HeavyChain | 3668 | 22-41 | | |
| anti-HIV-1_HeavyChain | 3669 | 22-41 | 35-44 | |
| anti-HIV-1_HeavyChain | 3670 | 22-41 | | |
| anti-HIV-1_HeavyChain | 3671 | 22-41 | 95-104 | |
| anti-HIV-1_HeavyChain | 3672 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3673 | 22-41 | | |
| anti-HIV-1_HeavyChain | 3674 | 22-41 | | |
| anti-HIV-1_HeavyChain | 3675 | 22-41 | | |
| anti-HIV-1_HeavyChain | 3676 | 22-41 | | |
| anti-HIV-1_HeavyChain | 3677 | 22-41 | 35-44 | |
| anti-HIV-1_HeavyChain | 3678 | 22-41 | | |
| anti-HIV-1_HeavyChain | 3679 | 22-41 | | |
| anti-HIV-1_HeavyChain | 3680 | 22-41 | | |
| anti-HIV-1_HeavyChain | 3681 | 22-41 | | |
| anti-HIV-1_HeavyChain | 3682 | 22-41 | | |
| anti-HIV-1_HeavyChain | 3683 | 22-41 | | |
| anti-HIV-1_HeavyChain | 3684 | 22-41 | | |
| anti-HIV-1_HeavyChain | 3685 | 22-41 | | |
| anti-HIV-1_HeavyChain | 3686 | 22-41 | | |
| anti-HIV-1_HeavyChain | 3687 | 22-41 | 35-44 | |
| anti-HIV-1_HeavyChain | 3688 | 22-41 | | |
| anti-HIV-1_HeavyChain | 3689 | 22-41 | | |
| anti-HIV-1_HeavyChain | 3690 | 22-41 | | |
| anti-HIV-1_HeavyChain | 3691 | 22-41 | | |
| anti-HIV-1_HeavyChain | 3692 | 22-41 | | |
| anti-HIV-1_HeavyChain | 3693 | 22-41 | | |
| anti-HIV-1_HeavyChain | 3694 | 22-41 | | |
| anti-HIV-1_HeavyChain | 3695 | 22-41 | | |
| anti-HIV-1_HeavyChain | 3696 | 22-41 | | |
| anti-HIV-1_HeavyChain | 3697 | 22-41 | 35-44 | |
| anti-HIV-1_HeavyChain | 3698 | 22-41 | | |
| anti-HIV-1_HeavyChain | 3699 | 22-41 | | |
| anti-HIV-1_HeavyChain | 3700 | 22-41 | | |
| anti-HIV-1_HeavyChain | 3701 | 22-41 | | |
| anti-HIV-1_HeavyChain | 3702 | 22-41 | 138-140 | |
| anti-HIV-1_HeavyChain | 3703 | 22-41 | | |
| anti-HIV-1_HeavyChain | 3704 | 22-41 | | |
| anti-HIV-1_HeavyChain | 3705 | 22-41 | | |
| anti-HIV-1_HeavyChain | 3706 | 22-41 | | |
| anti-HIV-1_HeavyChain | 3707 | 22-41 | | |
| anti-HIV-1_HeavyChain | 3708 | 22-41 | | |
| anti-HIV-1_HeavyChain | 3709 | 22-41 | | |
| anti-HIV-1_HeavyChain | 3710 | 22-41 | 35-44 | |
| anti-HIV-1_HeavyChain | 3711 | 22-41 | | |
| anti-HIV-1_HeavyChain | 3712 | 22-41 | 35-44 | |
| anti-HIV-1_HeavyChain | 3713 | 22-41 | | |
| anti-HIV-1_HeavyChain | 3714 | 22-41 | 35-44 | |
| anti-HIV-1_HeavyChain | 3715 | 22-41 | | |
| anti-HIV-1_HeavyChain | 3716 | 22-41 | | |
| anti-HIV-1_HeavyChain | 3717 | 22-41 | | |
| anti-HIV-1_HeavyChain | 3718 | 22-41 | | |
| anti-HIV-1_HeavyChain | 3719 | 22-41 | | |
| anti-HIV-1_HeavyChain | 3720 | 22-41 | 94-103 | |
| anti-HIV-1_HeavyChain | 3721 | 22-41 | | |
| anti-HIV-1_HeavyChain | 3722 | 22-41 | 35-44 | |
| anti-HIV-1_HeavyChain | 3723 | 22-41 | | |
| anti-HIV-1_HeavyChain | 3724 | 22-41 | | |
| anti-HIV-1_HeavyChain | 3725 | 22-41 | | |
| anti-HIV-1_HeavyChain | 3726 | 22-41 | | |
| anti-HIV-1_HeavyChain | 3727 | 22-41 | | |
| anti-HIV-1_HeavyChain | 3728 | 22-41 | | |
| anti-HIV-1_HeavyChain | 3729 | 22-41 | | |
| anti-HIV-1_HeavyChain | 3730 | 22-41 | 137-139 | |
| anti-HIV-1_HeavyChain | 3731 | 22-41 | | |
| anti-HIV-1_HeavyChain | 3732 | 22-41 | | |
| anti-HIV-1_HeavyChain | 3733 | 22-41 | | |
| anti-HIV-1_HeavyChain | 3734 | 22-41 | | |
| anti-HIV-1_HeavyChain | 3735 | 22-41 | | |
| anti-HIV-1_HeavyChain | 3736 | 22-41 | | |
| anti-HIV-1_HeavyChain | 3737 | 22-41 | 138-140 | |
| anti-HIV-1_HeavyChain | 3738 | 22-41 | | |
| anti-HIV-1_HeavyChain | 3739 | 22-41 | | |
| anti-HIV-1_HeavyChain | 3740 | 22-41 | 137-139 | |
| anti-HIV-1_HeavyChain | 3741 | 22-41 | | |
| anti-HIV-1_HeavyChain | 3742 | 22-41 | | |
| anti-HIV-1_HeavyChain | 3743 | 22-41 | | |
| anti-HIV-1_HeavyChain | 3744 | 22-41 | 35-44 | |
| anti-HIV-1_HeavyChain | 3745 | 22-41 | 137-139 | |
| anti-HIV-1_HeavyChain | 3746 | 22-41 | | |
| anti-HIV-1_HeavyChain | 3747 | 22-41 | | |
| anti-HIV-1_HeavyChain | 3748 | 22-41 | 139-141 | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3749 | 22-41 | 139-141 | |
| anti-HIV-1_HeavyChain | 3750 | 22-41 | 139-141 | |
| anti-HIV-1_HeavyChain | 3751 | 22-41 | | |
| anti-HIV-1_HeavyChain | 3752 | 22-41 | | |
| anti-HIV-1_HeavyChain | 3753 | 22-41 | 35-44 | |
| anti-HIV-1_HeavyChain | 3754 | 22-41 | | |
| anti-HIV-1_HeavyChain | 3755 | 22-41 | | |
| anti-HIV-1_HeavyChain | 3756 | 22-41 | | |
| anti-HIV-1_HeavyChain | 3757 | 22-41 | 139-141 | |
| anti-HIV-1_HeavyChain | 3758 | 22-41 | | |
| anti-HIV-1_HeavyChain | 3759 | 22-41 | | |
| anti-HIV-1_HeavyChain | 3760 | 22-41 | 35-44 | |
| anti-HIV-1_HeavyChain | 3761 | 22-41 | | |
| anti-HIV-1_HeavyChain | 3762 | 22-41 | | |
| anti-HIV-1_HeavyChain | 3763 | 22-41 | | |
| anti-HIV-1_HeavyChain | 3764 | 22-41 | 139-141 | |
| anti-HIV-1_HeavyChain | 3765 | 22-41 | | |
| anti-HIV-1_HeavyChain | 3766 | 22-41 | | |
| anti-HIV-1_HeavyChain | 3767 | 22-41 | | |
| anti-HIV-1_HeavyChain | 3768 | 22-41 | | |
| anti-HIV-1_HeavyChain | 3769 | 22-41 | | |
| anti-HIV-1_HeavyChain | 3770 | 22-41 | | |
| anti-HIV-1_HeavyChain | 3771 | 22-41 | | |
| anti-HIV-1_HeavyChain | 3772 | 22-41 | | |
| anti-HIV-1_HeavyChain | 3773 | 22-41 | | |
| anti-HIV-1_HeavyChain | 3774 | 22-41 | | |
| anti-HIV-1_HeavyChain | 3775 | 22-41 | | |
| anti-HIV-1_HeavyChain | 3776 | 22-41 | | |
| anti-HIV-1_HeavyChain | 3777 | 22-41 | | |
| anti-HIV-1_HeavyChain | 3778 | 22-41 | | |
| anti-HIV-1_HeavyChain | 3779 | 22-41 | | |
| anti-HIV-1_HeavyChain | 3780 | 22-41 | | |
| anti-HIV-1_HeavyChain | 3781 | 22-41 | | |
| anti-HIV-1_HeavyChain | 3782 | 22-41 | | |
| anti-HIV-1_HeavyChain | 3783 | 22-41 | | |
| anti-HIV-1_HeavyChain | 3784 | 22-41 | | |
| anti-HIV-1_HeavyChain | 3785 | 22-41 | | |
| anti-HIV-1_HeavyChain | 3786 | 22-41 | | |
| anti-HIV-1_HeavyChain | 3787 | 22-41 | 35-44 | |
| anti-HIV-1_HeavyChain | 3788 | 22-41 | 35-44 | |
| anti-HIV-1_HeavyChain | 3789 | 22-41 | 35-44 | |
| anti-HIV-1_HeavyChain | 3790 | 22-41 | | |
| anti-HIV-1_HeavyChain | 3791 | 22-41 | 35-44 | |
| anti-HIV-1_HeavyChain | 3792 | 22-41 | | |
| anti-HIV-1_HeavyChain | 3793 | 22-41 | 35-44 | |
| anti-HIV-1_HeavyChain | 3794 | 22-41 | 35-44 | |
| anti-HIV-1_HeavyChain | 3795 | 22-41 | 35-44 | |
| anti-HIV-1_HeavyChain | 3796 | 22-41 | | |
| anti-HIV-1_HeavyChain | 3797 | 22-41 | | |
| anti-HIV-1_HeavyChain | 3798 | 22-41 | | |
| anti-HIV-1_HeavyChain | 3799 | 22-41 | 35-44 | |
| anti-HIV-1_HeavyChain | 3800 | 22-41 | | |
| anti-HIV-1_HeavyChain | 3801 | 22-41 | 35-44 | |
| anti-HIV-1_HeavyChain | 3802 | 22-41 | | |
| anti-HIV-1_HeavyChain | 3803 | 22-41 | | |
| anti-HIV-1_HeavyChain | 3804 | 22-41 | | |
| anti-HIV-1_HeavyChain | 3805 | 22-41 | 35-44 | |
| anti-HIV-1_HeavyChain | 3806 | 22-41 | | |
| anti-HIV-1_HeavyChain | 3807 | 22-41 | 35-44 | |
| anti-HIV-1_HeavyChain | 3808 | 22-41 | 139-141 | |
| anti-HIV-1_HeavyChain | 3809 | 22-41 | | |
| anti-HIV-1_HeavyChain | 3810 | 22-41 | 35-44 | |
| anti-HIV-1_HeavyChain | 3811 | 22-41 | | |
| anti-HIV-1_HeavyChain | 3812 | 22-41 | | |
| anti-HIV-1_HeavyChain | 3813 | 22-41 | 35-44 | |
| anti-HIV-1_HeavyChain | 3814 | 22-41 | | |
| anti-HIV-1_HeavyChain | 3815 | 22-41 | | |
| anti-HIV-1_HeavyChain | 3816 | 22-41 | 140-142 | |
| anti-HIV-1_HeavyChain | 3817 | 22-41 | | |
| anti-HIV-1_HeavyChain | 3818 | 22-41 | 35-44 | |
| anti-HIV-1_HeavyChain | 3819 | 22-41 | | |
| anti-HIV-1_HeavyChain | 3820 | 22-41 | 35-44 | |
| anti-HIV-1_HeavyChain | 3821 | 22-41 | | |
| anti-HIV-1_HeavyChain | 3822 | 22-41 | | |
| anti-HIV-1_HeavyChain | 3823 | 22-41 | | |
| anti-HIV-1_HeavyChain | 3824 | 22-41 | | |

TABLE 5-continued

CDRs of exemplified antibodies

| Name | Protein SEQ ID NO | CDR1 | CDR2 | CDR3 |
| --- | --- | --- | --- | --- |
| anti-HIV-1_HeavyChain | 3825 | 22-41 | 35-44 | |
| anti-HIV-1_HeavyChain | 3826 | 22-41 | 35-44 | |
| anti-HIV-1_HeavyChain | 3827 | 22-41 | 35-44 | |
| anti-HIV-1_HeavyChain | 3828 | 22-41 | | |
| anti-HIV-1_HeavyChain | 3829 | 22-41 | | |
| anti-HIV-1_HeavyChain | 3830 | 22-41 | | |
| anti-HIV-1_HeavyChain | 3831 | 22-41 | 35-44 | |
| anti-HIV-1_HeavyChain | 3832 | 22-41 | | |
| anti-HIV-1_HeavyChain | 3833 | 22-41 | 35-44 | |
| anti-HIV-1_HeavyChain | 3834 | 22-41 | 35-44 | |
| anti-HIV-1_HeavyChain | 3835 | 22-41 | | |
| anti-HIV-1_HeavyChain | 3836 | 22-41 | 35-44 | |
| anti-HIV-1_HeavyChain | 3837 | 22-41 | | |
| anti-HIV-1_HeavyChain | 3838 | 22-41 | | |
| anti-HIV-1_HeavyChain | 3839 | 22-41 | 35-44 | |
| anti-HIV-1_HeavyChain | 3840 | 22-41 | | |
| anti-HIV-1_HeavyChain | 3841 | 22-41 | | |
| anti-HIV-1_HeavyChain | 3842 | 22-41 | 35-44 | |
| anti-HIV-1_HeavyChain | 3843 | 22-41 | | |
| anti-HIV-1_HeavyChain | 3844 | 22-41 | 35-44 | |
| anti-HIV-1_HeavyChain | 3845 | 22-41 | 139-141 | |
| anti-HIV-1_HeavyChain | 3846 | 22-41 | | |
| anti-HIV-1_HeavyChain | 3847 | 22-41 | 35-44 | |
| anti-HIV-1_HeavyChain | 3848 | 22-41 | | |
| anti-HIV-1_HeavyChain | 3849 | 22-41 | 35-44 | |
| anti-HIV-1_HeavyChain | 3850 | 22-41 | | |
| anti-HIV-1_HeavyChain | 3851 | 22-41 | | |
| anti-HIV-1_HeavyChain | 3852 | 22-41 | | |
| anti-HIV-1_HeavyChain | 3853 | 22-41 | 35-44 | |
| anti-HIV-1_HeavyChain | 3854 | 22-41 | | |
| anti-HIV-1_HeavyChain | 3855 | 22-41 | | |
| anti-HIV-1_HeavyChain | 3856 | 22-41 | 35-44 | |
| anti-HIV-1_HeavyChain | 3857 | 22-41 | 35-44 | |
| anti-HIV-1_HeavyChain | 3858 | 22-41 | | |
| anti-HIV-1_HeavyChain | 3859 | 22-41 | 35-44 | |
| anti-HIV-1_HeavyChain | 3860 | 22-41 | | |
| anti-HIV-1_HeavyChain | 3861 | 22-41 | | |
| anti-HIV-1_HeavyChain | 3862 | 22-41 | 35-44 | |
| anti-HIV-1_HeavyChain | 3863 | 22-41 | | |
| anti-HIV-1_HeavyChain | 3864 | 22-41 | | |
| anti-HIV-1_HeavyChain | 3865 | 22-41 | 35-44 | |
| anti-HIV-1_HeavyChain | 3866 | 22-41 | | |
| anti-HIV-1_HeavyChain | 3867 | 22-41 | 35-44 | |
| anti-HIV-1_HeavyChain | 3868 | 22-41 | | |
| anti-HIV-1_HeavyChain | 3869 | 22-41 | | |
| anti-HIV-1_HeavyChain | 3870 | 22-41 | 35-44 | |
| anti-HIV-1_HeavyChain | 3871 | 22-41 | | |
| anti-HIV-1_HeavyChain | 3872 | 22-41 | 140-142 | |
| anti-HIV-1_HeavyChain | 3873 | 22-41 | 35-44 | |
| anti-HIV-1_HeavyChain | 3874 | 22-41 | | |
| anti-HIV-1_HeavyChain | 3875 | 22-41 | | |
| anti-HIV-1_HeavyChain | 3876 | 22-41 | | |
| anti-HIV-1_HeavyChain | 3877 | 22-41 | 35-44 | |
| anti-HIV-1_HeavyChain | 3878 | 22-41 | | |
| anti-HIV-1_HeavyChain | 3879 | 22-41 | | |
| anti-HIV-1_HeavyChain | 3880 | 22-41 | 35-44 | |
| anti-HIV-1_HeavyChain | 3881 | 22-41 | 35-44 | |
| anti-HIV-1_HeavyChain | 3882 | 22-41 | 35-44 | |
| anti-HIV-1_HeavyChain | 3883 | 22-41 | 35-44 | |
| anti-HIV-1_HeavyChain | 3884 | 22-41 | | |
| anti-HIV-1_HeavyChain | 3885 | 22-41 | 35-44 | |
| anti-HIV-1_HeavyChain | 3886 | 22-41 | | |
| anti-HIV-1_HeavyChain | 3887 | 22-41 | 35-44 | |
| anti-HIV-1_HeavyChain | 3888 | 22-41 | | |
| anti-HIV-1_HeavyChain | 3889 | 22-41 | 35-44 | |
| anti-HIV-1_HeavyChain | 3890 | 22-41 | 35-44 | |
| anti-HIV-1_HeavyChain | 3891 | 22-41 | | |
| anti-HIV-1_HeavyChain | 3892 | 22-41 | | |
| anti-HIV-1_HeavyChain | 3893 | 22-41 | | |
| anti-HIV-1_HeavyChain | 3894 | 22-41 | | |
| anti-HIV-1_HeavyChain | 3895 | 22-41 | 37-46 | |
| anti-HIV-1_HeavyChain | 3896 | 22-41 | | |
| anti-HIV-1_HeavyChain | 3897 | 22-41 | | |
| anti-HIV-1_HeavyChain | 3898 | 22-41 | | |
| anti-HIV-1_HeavyChain | 3899 | 22-41 | | |
| anti-HIV-1_HeavyChain | 3900 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3901 | 22-41 | | |
| anti-HIV-1_HeavyChain | 3902 | 22-41 | | |
| anti-HIV-1_HeavyChain | 3903 | 22-41 | | |
| anti-HIV-1_HeavyChain | 3904 | 22-41 | | |
| anti-HIV-1_HeavyChain | 3905 | 22-41 | | |
| anti-HIV-1_HeavyChain | 3906 | 22-41 | | |
| anti-HIV-1_HeavyChain | 3907 | 22-41 | 35-44 | |
| anti-HIV-1_HeavyChain | 3908 | 22-41 | | |
| anti-HIV-1_HeavyChain | 3909 | 22-41 | | |
| anti-HIV-1_HeavyChain | 3910 | 22-41 | | |
| anti-HIV-1_HeavyChain | 3911 | 22-41 | | |
| anti-HIV-1_HeavyChain | 3912 | 22-41 | | |
| anti-HIV-1_HeavyChain | 3913 | 22-41 | | |
| anti-HIV-1_HeavyChain | 3914 | 22-41 | | |
| anti-HIV-1_HeavyChain | 3915 | 22-41 | | |
| anti-HIV-1_HeavyChain | 3916 | 22-41 | | |
| anti-HIV-1_HeavyChain | 3917 | 22-41 | 93-102 | 94-113 |
| anti-HIV-1_HeavyChain | 3918 | 22-41 | | |
| anti-HIV-1_HeavyChain | 3919 | 22-41 | | |
| anti-HIV-1_HeavyChain | 3920 | 22-41 | | |
| anti-HIV-1_HeavyChain | 3921 | 22-41 | | |
| anti-HIV-1_HeavyChain | 3922 | 22-41 | | |
| anti-HIV-1_HeavyChain | 3923 | 22-41 | | |
| anti-HIV-1_HeavyChain | 3924 | 22-41 | | |
| anti-HIV-1_HeavyChain | 3925 | 22-41 | | |
| anti-HIV-1_HeavyChain | 3926 | 22-41 | 35-44 | |
| anti-HIV-1_HeavyChain | 3927 | 22-41 | 35-44 | |
| anti-HIV-1_HeavyChain | 3928 | 22-41 | | |
| anti-HIV-1_HeavyChain | 3929 | 22-41 | | |
| anti-HIV-1_HeavyChain | 3930 | 22-41 | | |
| anti-HIV-1_HeavyChain | 3931 | 22-41 | 35-44 | |
| anti-HIV-1_HeavyChain | 3932 | 22-41 | | |
| anti-HIV-1_HeavyChain | 3933 | 22-41 | 35-44 | |
| anti-HIV-1_HeavyChain | 3934 | 22-41 | 35-44 | |
| anti-HIV-1_HeavyChain | 3935 | 22-41 | | |
| anti-HIV-1_HeavyChain | 3936 | 22-41 | 35-44 | |
| anti-HIV-1_HeavyChain | 3937 | 22-41 | | |
| anti-HIV-1_HeavyChain | 3938 | 22-41 | | |
| anti-HIV-1_HeavyChain | 3939 | 22-41 | | |
| anti-HIV-1_HeavyChain | 3940 | 22-41 | | |
| anti-HIV-1_HeavyChain | 3941 | 22-41 | | |
| anti-HIV-1_HeavyChain | 3942 | 22-41 | 95-104 | |
| anti-HIV-1_HeavyChain | 3943 | 22-41 | 95-104 | |
| anti-HIV-1_HeavyChain | 3944 | 22-41 | | |
| anti-HIV-1_HeavyChain | 3945 | 22-41 | | |
| anti-HIV-1_HeavyChain | 3946 | 22-41 | 35-44 | |
| anti-HIV-1_HeavyChain | 3947 | 22-41 | | |
| anti-HIV-1_HeavyChain | 3948 | 22-41 | | |
| anti-HIV-1_HeavyChain | 3949 | 22-41 | | |
| anti-HIV-1_HeavyChain | 3950 | 22-41 | | |
| anti-HIV-1_HeavyChain | 3951 | 22-41 | | |
| anti-HIV-1_HeavyChain | 3952 | 22-41 | | |
| anti-HIV-1_HeavyChain | 3953 | 22-41 | | |
| anti-HIV-1_HeavyChain | 3954 | 22-41 | | |
| anti-HIV-1_HeavyChain | 3955 | 22-41 | | |
| anti-HIV-1_HeavyChain | 3956 | 22-41 | | |
| anti-HIV-1_HeavyChain | 3957 | 22-41 | | |
| anti-HIV-1_HeavyChain | 3958 | 22-41 | | |
| anti-HIV-1_HeavyChain | 3959 | 22-41 | | |
| anti-HIV-1_HeavyChain | 3960 | 22-41 | | |
| anti-HIV-1_HeavyChain | 3961 | 22-41 | | |
| anti-HIV-1_HeavyChain | 3962 | 22-41 | | |
| anti-HIV-1_HeavyChain | 3963 | 22-41 | | 96-115 |
| anti-HIV-1_HeavyChain | 3964 | 22-41 | | |
| anti-HIV-1_HeavyChain | 3965 | 22-41 | | |
| anti-HIV-1_HeavyChain | 3966 | 22-41 | | |
| anti-HIV-1_HeavyChain | 3967 | 22-41 | | |
| anti-HIV-1_HeavyChain | 3968 | 22-41 | | |
| anti-HIV-1_HeavyChain | 3969 | 22-41 | | 96-115 |
| anti-HIV-1_HeavyChain | 3970 | 22-41 | | 96-115 |
| anti-HIV-1_HeavyChain | 3971 | 22-41 | | 96-115 |
| anti-HIV-1_HeavyChain | 3972 | 22-41 | | |
| anti-HIV-1_HeavyChain | 3973 | 22-41 | | 95-114 |
| anti-HIV-1_HeavyChain | 3974 | 22-41 | | |
| anti-HIV-1_HeavyChain | 3975 | 22-41 | | 96-115 |
| anti-HIV-1_HeavyChain | 3976 | 22-41 | | |

TABLE 5-continued

CDRs of exemplified antibodies

| Name | Protein SEQ ID NO | CDR1 | CDR2 | CDR3 |
|---|---|---|---|---|
| anti-HIV-1_HeavyChain | 3977 | 22-41 | | 96-115 |
| anti-HIV-1_HeavyChain | 3978 | 22-41 | | |
| anti-HIV-1_HeavyChain | 3979 | 22-41 | | 96-115 |
| anti-HIV-1_HeavyChain | 3980 | 22-41 | | |
| anti-HIV-1_HeavyChain | 3981 | 22-41 | | |
| anti-HIV-1_HeavyChain | 3982 | 22-41 | | |
| anti-HIV-1_HeavyChain | 3983 | 22-41 | | 96-115 |
| anti-HIV-1_HeavyChain | 3984 | 22-41 | | |
| anti-HIV-1_HeavyChain | 3985 | 22-41 | | |
| anti-HIV-1_HeavyChain | 3989 | 22-41 | | 96-115 |
| anti-HIV-1_HeavyChain | 3987 | 22-41 | | |
| anti-HIV-1_HeavyChain | 3988 | 22-41 | | 96-115 |
| anti-HIV-1_HeavyChain | 3989 | 22-41 | | 95-114 |
| anti-HIV-1_HeavyChain | 3990 | 22-41 | | |
| anti-HIV-1_HeavyChain | 3991 | 22-41 | | |
| anti-HIV-1_HeavyChain | 3992 | 22-41 | | |
| anti-HIV-1_HeavyChain | 3993 | 22-41 | | |
| anti-HIV-1_HeavyChain | 3994 | 22-41 | | 96-115 |
| anti-HIV-1_HeavyChain | 3995 | 22-41 | | |
| anti-HIV-1_HeavyChain | 3996 | 22-41 | | 96-115 |
| anti-HIV-1_HeavyChain | 3997 | 22-41 | | 96-115 |
| anti-HIV-1_HeavyChain | 3998 | 22-41 | | |
| anti-HIV-1_HeavyChain | 3999 | 22-41 | | 95-114 |
| anti-HIV-1_HeavyChain | 4000 | 22-41 | | |
| anti-HIV_5CIN_LightChain | 4001 | 22-41 | 49-58 | 87-106 |
| anti-HIV_5CIN_HeavyChain | 4002 | 22-41 | | 93-112 |
| anti-HIV_5CIL_HeavyChain | 4003 | 22-41 | | 93-112 |
| anti-HIV_5CIP_A-Chain | 4004 | 22-41 | | 93-112 |
| anti-HIV_5CIP_HeavyChain | 4005 | 22-41 | | 93-112 |
| anti-HIV_4JKP_LightChain | 4006 | 22-41 | 46-55 | 84-103 |
| anti-HIV_3TNN_E-Chain | 4007 | 22-41 | | 94-113 |
| anti-HIV_3BQU_B-Chain | 4008 | 22-41 | 53-62 | |
| anti-HIV_3BQU_A-Chain | 4009 | 22-41 | 48-57 | 89-105 |
| anti-HIV_1gG_VR-Chain | 4010 | 22-41 | 69-78 | 107-126 |
| anti-HIV_1gG_HeavyChain | 4011 | 22-41 | 70-79 | 112-116 |
| anti-HIV_4P9M_HeavyChain | 4012 | 22-41 | | |
| anti-HIV_4P9M_LightChain | 4013 | 22-41 | 49-58 | |
| anti-HIV_4P9H_C-Chain | 4014 | 22-41 | | |
| anti-HIV_4YBL_A-Chain | 4015 | 22-41 | | |
| anti-HIV_4R4N_V-Chain | 4016 | 22-41 | 294-303 | |
| anti-HIV_4JKP_G-Chain | 4017 | 22-41 | | |
| anti-HIV_3BQU_D-Chain | 4018 | 22-41 | | 113-132 |
| anti-HIV_3BQU_C-Chain | 4019 | 22-41 | | 108-127 |
| anti-HIV_1g_LightChain | 4020 | 22-41 | | 90-109 |
| anti-HIV_1g_HeavyChain | 4021 | 22-41 | | 94-113 |
| anti-HIV_4P9H_G-Chain | 4022 | 22-41 | | |
| anti-HIV_Chain | 4023 | 22-41 | | |
| anti-HIV_Chain | 4024 | 22-41 | | |
| anti-HIV_Chain | 4025 | 22-41 | | |
| anti-HIV_Chain | 4026 | 22-41 | 53-62 | |
| anti-HIV_Chain | 4027 | 22-41 | | 65-84 |
| anti-HIV_Chain | 4028 | 22-41 | | 67-86 |
| anti-HIV_Chain | 4029 | 22-41 | | 65-84 |
| anti-HIV_Chain | 4030 | 22-41 | | |
| anti-HIV_Chain | 4031 | 22-41 | | |
| anti-HIV_Chain | 4032 | 22-41 | | |
| anti-HIV_Chain | 4033 | 22-41 | | 82-100 |
| anti-HIV_Chain | 4034 | 22-41 | | 82-100 |
| anti-HIV_Chain | 4035 | 22-41 | | 82-100 |
| anti-HIV_Chain | 4036 | 22-41 | | |
| anti-HIV_Chain | 4037 | 22-41 | | |
| anti-HIV_Chain | 4038 | 22-41 | | |
| anti-HIV_Chain | 4039 | 22-41 | | 84-102 |
| anti-HIV_Chain | 4040 | 22-41 | | 84-102 |
| anti-HIV_Chain | 4041 | 22-41 | | 82-101 |
| anti-HIV_Chain | 4042 | 22-41 | | |
| anti-HIV_Chain | 4043 | 22-41 | 44-53 | |
| anti-HIV_Chain | 4044 | 22-41 | 44-53 | |
| anti-HIV_Chain | 4045 | 22-41 | 44-53 | |
| anti-HIV_Chain | 4046 | 22-41 | 44-53 | |
| anti-HIV_Chain | 4047 | 22-41 | 44-53 | |
| anti-HIV_Chain | 4048 | 22-41 | 44-53 | |
| anti-HIV_Chain | 4049 | 22-41 | | 83-102 |
| anti-HIV_Chain | 4050 | 22-41 | | 83-102 |
| anti-HIV_Chain | 4051 | 22-41 | 44-53 | |
| anti-HIV_Chain | 4052 | 22-41 | 71-80 | 72-91 |

TABLE 5-continued

CDRs of exemplified antibodies

| Name | Protein SEQ ID NO | CDR1 | CDR2 | CDR3 |
|---|---|---|---|---|
| anti-HIV_Chain | 4053 | 22-41 | | |
| anti-HIV_Chain | 4054 | 22-41 | 40-49 | 81-100 |
| anti-HIV_Chain | 4055 | 22-41 | 40-49 | 81-100 |
| anti-HIV_Chain | 4056 | 22-41 | 40-49 | 81-100 |
| anti-HIV_Chain | 4057 | 22-41 | | 81-100 |
| anti-HIV_Chain | 4058 | 22-41 | | 83-102 |
| anti-HIV_Chain | 4059 | 22-41 | | |
| anti-HIV_Chain | 4060 | 22-41 | 32-41 | 74-93 |
| anti-HIV_Chain | 4061 | 22-41 | 42-51 | 83-102 |
| anti-HIV_Chain | 4062 | 22-41 | 42-51 | 83-102 |
| anti-HIV_Chain | 4063 | 22-41 | | |
| anti-HIV_Chain | 4064 | 22-41 | | |
| anti-HIV_Chain | 4065 | 22-41 | | |
| anti-HIV_Chain | 4066 | 22-41 | | |
| anti-HIV_Chain | 4067 | 22-41 | 46-55 | 84-103 |
| anti-HIV_Chain | 4068 | 22-41 | | |
| anti-HIV_Chain | 4069 | 22-41 | | |
| anti-HIV_Chain | 4070 | 22-41 | 43-52 | 84-103 |
| anti-HIV_LightChain | 4071 | 22-41 | 48-57 | 86-105 |
| anti-HIV_LightChain | 4072 | 22-41 | 48-57 | 86-105 |
| anti-HIV_Chain | 4073 | 22-41 | | 83-102 |
| anti-HIV_Chain | 4074 | 22-41 | 38-47 | 76-95 |
| anti-HIV_Chain | 4075 | 22-41 | 47-56 | 85-104 |
| anti-HIV_HeavyChain | 4076 | 22-41 | | |
| anti-HIV_Chain | 4077 | 22-41 | 47-56 | 85-104 |
| anti-HIV_Chain | 4078 | 22-41 | 38-47 | |
| anti-HIV_LightChain | 4079 | 22-41 | 54-63 | 92-111 |
| anti-HIV_LightChain | 4080 | 22-41 | 48-57 | 86-105 |
| anti-HIV_Chain | 4081 | 22-41 | 44-53 | |
| anti-HIV_Chain | 4082 | 22-41 | 49-58 | 87-106 |
| anti-HIV_Chain | 4083 | 22-41 | | 77-96 |
| anti-HIV_Chain | 4084 | 22-41 | 44-53 | |
| anti-HIV_Chain | 4085 | 22-41 | 44-53 | |
| anti-HIV_Chain | 4086 | 22-41 | 44-53 | |
| anti-HIV_Chain | 4087 | 22-41 | 44-53 | |
| anti-HIV_Chain | 4088 | 22-41 | | |
| anti-HIV_Chain | 4089 | 22-41 | 44-53 | |
| anti-HIV_Chain | 4090 | 22-41 | 44-53 | |
| anti-HIV_Chain | 4091 | 22-41 | 44-53 | |
| anti-HIV_Chain | 4092 | 22-41 | 44-53 | |
| anti-HIV_Chain | 4093 | 22-41 | 44-53 | |
| anti-HIV_Chain | 4094 | 22-41 | 44-53 | |
| anti-HIV_Chain | 4095 | 22-41 | 51-60 | 89-108 |
| anti-HIV_Chain | 4096 | 22-41 | | 83-102 |
| anti-HIV_Chain | 4097 | 22-41 | | 83-102 |
| anti-HIV_Chain | 4098 | 22-41 | | 83-102 |
| anti-HIV_Chain | 4099 | 22-41 | | 83-102 |
| anti-HIV_Chain | 4100 | 22-41 | | 83-102 |
| anti-HIV_Chain | 4101 | 22-41 | | 83-102 |
| anti-HIV_Chain | 4102 | 22-41 | | 83-102 |
| anti-HIV_Chain | 4103 | 22-41 | | 83-102 |
| anti-HIV_Chain | 4104 | 22-41 | | 83-102 |
| anti-HIV_Chain | 4105 | 22-41 | | 83-102 |
| anti-HIV_Chain | 4106 | 22-41 | 41-50 | 79-98 |
| anti-HIV_Chain | 4107 | 22-41 | 39-48 | 77-96 |
| anti-HIV_Chain | 4108 | 22-41 | 49-58 | |
| anti-HIV_Chain | 4109 | 22-41 | 41-50 | 83-102 |
| anti-HIV_Chain | 4110 | 22-41 | 79-88 | 80-99 |
| anti-HIV_Chain | 4111 | 22-41 | 42-51 | |
| anti-HIV_Chain | 4112 | 22-41 | 42-51 | 80-99 |
| anti-HIV_LightChain | 4113 | 22-41 | 49-58 | |
| anti-HIV_LightChain | 4114 | 22-41 | 49-58 | |
| anti-HIV_LightChain | 4115 | 22-41 | 49-58 | |
| anti-HIV_LightChain | 4116 | 22-41 | 49-58 | |
| anti-HIV_LightChain | 4117 | 22-41 | 49-58 | |
| anti-HIV_LightChain | 4118 | 22-41 | 49-58 | |
| anti-HIV_LightChain | 4119 | 22-41 | 49-58 | |
| anti-HIV_LightChain | 4120 | 22-41 | 49-58 | |
| anti-HIV_LightChain | 4121 | 22-41 | 49-58 | |
| anti-HIV_LightChain | 4122 | 22-41 | 49-58 | |
| anti-HIV_LightChain | 4123 | 22-41 | 49-58 | |
| anti-HIV_LightChain | 4124 | 22-41 | 49-58 | |
| anti-HIV_LightChain | 4125 | 22-41 | 49-58 | |
| anti-HIV_LightChain | 4126 | 22-41 | 49-58 | |
| anti-HIV_LightChain | 4127 | 22-41 | 49-58 | |
| anti-HIV_Chain | 4128 | 22-41 | | 102-117 |

TABLE 5-continued

CDRs of exemplified antibodies

| Name | Protein SEQ ID NO | CDR1 | CDR2 | CDR3 |
|---|---|---|---|---|
| anti-HIV_Chain | 4129 | 22-41 | 41-50 | 79-98 |
| anti-HIV_Chain | 4130 | 22-41 | | |
| anti-HIV_Chain | 4131 | 22-41 | | |
| anti-HIV_Chain | 4132 | 22-41 | | |
| anti-HIV_Chain | 4133 | 22-41 | | 82-101 |
| anti-HIV_Chain | 4134 | 22-41 | | |
| anti-HIV_Chain | 4135 | 22-41 | 43-52 | |
| anti-HIV_Chain | 4136 | 22-41 | | |
| anti-HIV_HeavyChain | 4137 | 22-41 | 51-60 | |
| anti-HIV_Chain | 4138 | 22-41 | 34-43 | |
| anti-HIV_Chain | 4139 | 22-41 | 34-43 | |
| anti-HIV_Chain | 4140 | 22-41 | | 88-107 |
| anti-HIV_Chain | 4141 | 22-41 | 49-58 | 87-106 |
| anti-HIV_Chain | 4142 | 22-41 | 38-47 | 76-95 |
| anti-HIV_Chain | 4143 | 22-41 | | |
| anti-HIV_Chain | 4144 | 22-41 | | |
| anti-HIV_Chain | 4145 | 22-41 | 50-59 | 88-107 |
| anti-HIV_Chain | 4146 | 22-41 | 50-59 | 88-107 |
| anti-HIV_Chain | 4147 | 22-41 | | |
| anti-HIV_Chain | 4148 | 22-41 | | |
| anti-HIV_Chain | 4149 | 22-41 | | |
| anti-HIV_Chain | 4150 | 22-41 | | |
| anti-HIV_Chain | 4151 | 22-41 | | |
| anti-HIV_Chain | 4152 | 22-41 | | |
| anti-HIV_Chain | 4153 | 22-41 | | |
| anti-HIV_Chain | 4154 | 22-41 | | |
| anti-HIV_Chain | 4155 | 22-41 | 48-57 | |
| anti-HIV_Chain | 4156 | 22-41 | | |
| anti-HIV_Chain | 4157 | 22-41 | 94-103 | 95-114 |
| anti-HIV_HeavyChain | 4158 | 22-41 | | 94-113 |
| anti-HIV_HeavyChain | 4159 | 22-41 | | 94-113 |
| anti-HIV_Chain | 4160 | 22-41 | 48-57 | |
| anti-HIV_Chain | 4161 | 22-41 | 48-57 | |
| anti-HIV_Chain | 4162 | 22-41 | | |
| anti-HIV_Chain | 4163 | 22-41 | 48-57 | 86-105 |
| anti-HIV_Chain | 4164 | 22-41 | | |
| anti-HIV_Chain | 4165 | 22-41 | 51-60 | |
| anti-HIV_Chain | 4166 | 22-41 | | 94-113 |
| anti-HIV_Chain | 4167 | 22-41 | 95-104 | 96-115 |
| anti-HIV_Chain | 4168 | 22-41 | 74-83 | |
| anti-HIV_Chain | 4169 | 22-41 | 48-57 | 86-105 |
| anti-HIV_Chain | 4170 | 22-41 | 49-58 | 87-106 |
| anti-HIV_Chain | 4171 | 22-41 | 48-57 | 86-105 |
| anti-HIV_Chain | 4172 | 22-41 | 48-57 | |
| anti-HIV_Chain | 4173 | 22-41 | | |
| anti-HIV_Chain | 4174 | 22-41 | | |
| anti-HIV_Chain | 4175 | 22-41 | | |
| anti-HIV_Chain | 4176 | 22-41 | 59-68 | 94-113 |
| anti-HIV_Chain | 4177 | 22-41 | | 94-113 |
| anti-HIV_Chain | 4178 | 22-41 | | 94-113 |
| anti-HIV_Chain | 4179 | 22-41 | | 94-113 |
| anti-HIV_Chain | 4180 | 22-41 | 97-106 | |
| anti-HIV_Chain | 4181 | 22-41 | 97-106 | |
| anti-HIV_Chain | 4182 | 22-41 | 97-106 | |
| anti-HIV_Chain | 4183 | 22-41 | | |
| anti-HIV_Chain | 4184 | 22-41 | | |
| anti-HIV_Chain | 4185 | 22-41 | | |
| anti-HIV_Chain | 4186 | 22-41 | 51-60 | 93-112 |
| anti-HIV_Chain | 4187 | 22-41 | 51-60 | |
| anti-HIV_Chain | 4188 | 22-41 | 48-57 | 86-105 |
| anti-HIV_Chain | 4189 | 22-41 | | |
| anti-HIV_Chain | 4190 | 22-41 | 48-57 | 86-105 |
| anti-HIV_Chain | 4191 | 22-41 | 48-57 | 86-105 |
| anti-HIV_Chain | 4192 | 22-41 | 49-58 | 87-106 |
| anti-HIV_Chain | 4193 | 22-41 | | |
| anti-HIV_Chain | 4194 | 22-41 | | |
| anti-HIV_Chain | 4195 | 22-41 | 84-93 | 85-104 |
| anti-HIV_Chain | 4196 | 22-41 | 47-56 | 85-104 |
| anti-HIV_Chain | 4197 | 22-41 | 47-56 | 85-104 |
| anti-HIV_Chain | 4198 | 22-41 | 84-93 | 85-104 |
| anti-HIV_Chain | 4199 | 22-41 | | 85-104 |
| anti-HIV_Chain | 4200 | 22-41 | 84-93 | 85-104 |
| anti-HIV_Chain | 4201 | 22-41 | 93-102 | 94-113 |
| anti-HIV_Chain | 4202 | 22-41 | | 94-113 |
| anti-HIV_Chain | 4203 | 22-41 | | 94-113 |
| anti-HIV_Chain | 4204 | 22-41 | | 91-110 |

TABLE 5-continued

CDRs of exemplified antibodies

| Name | Protein SEQ ID NO | CDR1 | CDR2 | CDR3 |
|---|---|---|---|---|
| anti-HIV_Chain | 4205 | 22-41 | | 94-113 |
| anti-HIV_HeavyChain | 4206 | 22-41 | 51-60 | 94-113 |
| anti-HIV_Chain | 4207 | 22-41 | | |
| anti-HIV_Chain | 4208 | 22-41 | | |
| anti-HIV_Chain | 4209 | 22-41 | 58-67 | 94-113 |
| anti-HIV_Chain | 4210 | 22-41 | 48-57 | 86-105 |
| anti-HIV_Chain | 4211 | 22-41 | 49-58 | 87-106 |
| anti-HIV_Chain | 4212 | 22-41 | 49-58 | 87-106 |
| anti-HIV_Chain | 4213 | 22-41 | | 85-104 |
| anti-HIV_Chain | 4214 | 22-41 | | |
| anti-HIV_Chain | 4215 | 22-41 | | |
| anti-HIV_Chain | 4216 | 22-41 | 48-57 | |
| anti-HIV_Chain | 4217 | 22-41 | 34-43 | |
| anti-HIV_Chain | 4218 | 22-41 | 34-43 | |
| anti-HIV_Chain | 4219 | 22-41 | 34-43 | |
| anti-HIV_Chain | 4220 | 22-41 | 34-43 | |
| anti-HIV_Chain | 4221 | 22-41 | 34-43 | |
| anti-HIV_Chain | 4222 | 22-41 | 34-43 | |
| anti-HIV_Chain | 4223 | 22-41 | 34-43 | |
| anti-HIV_Chain | 4224 | 22-41 | 34-43 | |
| anti-HIV_Chain | 4225 | 22-41 | 93-102 | |
| anti-HIV_Chain | 4226 | 22-41 | 34-43 | |
| anti-HIV_Chain | 4227 | 22-41 | 34-43 | |
| anti-HIV_Chain | 4228 | 22-41 | 34-43 | |
| anti-HIV_Chain | 4229 | 22-41 | 93-102 | |
| anti-HIV_Chain | 4230 | 22-41 | 34-43 | |
| anti-HIV_Chain | 4231 | 22-41 | 34-43 | |
| anti-HIV_Chain | 4232 | 22-41 | 34-43 | |
| anti-HIV_Chain | 4233 | 22-41 | 93-102 | |
| anti-HIV_Chain | 4234 | 22-41 | | 94-113 |
| anti-HIV_Chain | 4235 | 22-41 | 58-67 | 94-113 |
| anti-HIV_Chain | 4236 | 22-41 | | 94-113 |
| anti-HIV_Chain | 4237 | 22-41 | | |
| anti-HIV_Chain | 4238 | 22-41 | | 94-113 |
| anti-HIV_Chain | 4239 | 22-41 | | |
| anti-HIV_Chain | 4240 | 22-41 | | |
| anti-HIV_Chain | 4241 | 22-41 | | 94-113 |
| anti-HIV_Chain | 4242 | 22-41 | | 94-113 |
| anti-HIV_Chain | 4243 | 22-41 | | 96-115 |
| anti-HIV_Chain | 4244 | 22-41 | 48-57 | 86-105 |
| anti-HIV_Chain | 4245 | 22-41 | 50-59 | 88-107 |
| anti-HIV_Chain | 4246 | 22-41 | | |
| anti-HIV_Chain | 4247 | 22-41 | 49-58 | |
| anti-HIV_Chain | 4248 | 22-41 | 48-57 | 86-105 |
| anti-HIV_Chain | 4249 | 22-41 | 35-44 | |
| anti-HIV_Chain | 4250 | 22-41 | 93-102 | |
| anti-HIV_Chain | 4251 | 22-41 | | 94-113 |
| anti-HIV_Chain | 4252 | 22-41 | | 95-114 |
| anti-HIV_Chain | 4253 | 22-41 | | |
| anti-HIV_Chain | 4254 | 22-41 | | |
| anti-HIV_Chain | 4255 | 22-41 | | |
| anti-HIV_Chain | 4256 | 22-41 | 51-60 | 93-112 |
| anti-HIV_Chain | 4257 | 22-41 | 92-101 | 93-112 |
| anti-HIV_Chain | 4258 | 22-41 | | 93-112 |
| anti-HIV_Chain | 4259 | 22-41 | | 93-112 |
| anti-HIV_Chain | 4260 | 22-41 | | 94-113 |
| anti-HIV_Chain | 4261 | 22-41 | | |
| anti-HIV_Chain | 4262 | 22-41 | | 94-113 |
| anti-HIV_Chain | 4263 | 22-41 | 53-62 | 95-114 |
| anti-HIV_Chain | 4264 | 22-41 | | |
| anti-HIV_Chain | 4265 | 22-41 | | 94-113 |
| anti-HIV_Chain | 4266 | 22-41 | | 94-113 |
| anti-HIV_Chain | 4267 | 22-41 | | |
| anti-HIV_Chain | 4268 | 22-41 | 51-60 | 93-112 |
| anti-HIV_Chain | 4269 | 22-41 | | 94-113 |
| anti-HIV_Chain | 4270 | 22-41 | | 94-113 |
| anti-HIV_Chain | 4271 | 22-41 | | 94-113 |
| anti-HIV_Chain | 4272 | 22-41 | 49-58 | 87-106 |
| anti-HIV_Chain | 4273 | 22-41 | 49-58 | 87-106 |
| anti-HIV_Chain | 4274 | 22-41 | 49-58 | 87-106 |
| anti-HIV_Chain | 4275 | 22-41 | 93-102 | 94-113 |
| anti-HIV_Chain | 4276 | 22-41 | | |
| anti-HIV_Chain | 4277 | 22-41 | | |
| anti-HIV_Chain | 4278 | 22-41 | | 88-107 |
| anti-HIV_Chain | 4279 | 22-41 | 93-102 | 94-113 |
| anti-HIV_Chain | 4280 | 22-41 | 93-102 | 94-113 |

TABLE 5-continued

CDRs of exemplified antibodies

| Name | Protein SEQ ID NO | CDR1 | CDR2 | CDR3 |
|---|---|---|---|---|
| anti-HIV_Chain | 4281 | 22-41 | 93-102 | 94-113 |
| anti-HIV_Chain | 4282 | 22-41 | | 94-113 |
| anti-HIV_Chain | 4283 | 22-41 | | 93-112 |
| anti-HIV_Chain | 4284 | 22-41 | | 94-113 |
| anti-HIV_Chain | 4285 | 22-41 | | 94-113 |
| anti-HIV_Chain | 4286 | 22-41 | | |
| anti-HIV_Chain | 4287 | 22-41 | | |
| anti-HIV_Chain | 4288 | 22-41 | | 94-113 |
| anti-HIV_Chain | 4289 | 22-41 | | 94-113 |
| anti-HIV_Chain | 4290 | 22-41 | 58-67 | 94-113 |
| anti-HIV_Chain | 4291 | 22-41 | | |
| anti-HIV_Chain | 4292 | 22-41 | | 93-112 |
| anti-HIV_Chain | 4293 | 22-41 | 93-102 | 94-113 |
| anti-HIV_Chain | 4294 | 22-41 | 49-58 | 87-106 |
| anti-HIV_Chain | 4295 | 22-41 | | |
| anti-HIV_Chain | 4296 | 22-41 | | |
| anti-HIV_Chain | 4297 | 22-41 | | |
| anti-HIV_Chain | 4298 | 22-41 | | |
| anti-HIV_Chain | 4299 | 22-41 | 93-102 | 94-113 |
| anti-HIV_Chain | 4300 | 22-41 | 53-62 | 95-114 |
| anti-HIV_Chain | 4301 | 22-41 | | 94-113 |
| anti-HIV_Chain | 4302 | 22-41 | | 93-112 |
| anti-HIV_Chain | 4303 | 22-41 | | |
| anti-HIV_Chain | 4304 | 22-41 | 74-83 | 94-113 |
| anti-HIV_Chain | 4305 | 22-41 | | |
| anti-HIV_Chain | 4306 | 22-41 | 74-83 | |
| anti-HIV_Chain | 4307 | 22-41 | 74-83 | |
| anti-HIV_Chain | 4308 | 22-41 | | 94-113 |
| anti-HIV_Chain | 4309 | 22-41 | | 94-113 |
| anti-HIV_Chain | 4310 | 22-41 | | 94-113 |
| anti-HIV_Chain | 4311 | 22-41 | 74-83 | |
| anti-HIV_Chain | 4312 | 22-41 | 74-83 | |
| anti-HIV_Chain | 4313 | 22-41 | 74-83 | |
| anti-HIV_Chain | 4314 | 22-41 | 74-83 | 94-113 |
| anti-HIV_Chain | 4315 | 22-41 | 83-92 | 94-113 |
| anti-HIV_Chain | 4316 | 22-41 | 53-62 | 95-114 |
| anti-HIV_Chain | 4317 | 22-41 | 93-102 | 94-113 |
| anti-HIV_Chain | 4318 | 22-41 | 28-37 | |
| anti-HIV_Chain | 4319 | 22-41 | | 93-112 |
| anti-HIV_Chain | 4320 | 22-41 | | |
| anti-HIV_Chain | 4321 | 22-41 | 49-58 | |
| anti-HIV_Chain | 4322 | 22-41 | | |
| anti-HIV_Chain | 4323 | 22-41 | | |
| anti-HIV_Chain | 4324 | 22-41 | | |
| anti-HIV_Chain | 4325 | 22-41 | 97-106 | |
| anti-HIV_Chain | 4326 | 22-41 | | |
| anti-HIV_Chain | 4327 | 22-41 | | |
| anti-HIV_Chain | 4328 | 22-41 | | |
| anti-HIV_Chain | 4329 | 22-41 | 97-106 | |
| anti-HIV_Chain | 4330 | 22-41 | 97-106 | |
| anti-HIV_Chain | 4331 | 22-41 | | |
| anti-HIV_Chain | 4332 | 22-41 | 97-106 | |
| anti-HIV_Chain | 4333 | 22-41 | | |
| anti-HIV_Chain | 4334 | 22-41 | 97-106 | |
| anti-HIV_Chain | 4335 | 22-41 | | |
| anti-HIV_Chain | 4336 | 22-41 | | |
| anti-HIV_Chain | 4337 | 22-41 | | |
| anti-HIV_Chain | 4338 | 22-41 | | |
| anti-HIV_Chain | 4339 | 22-41 | | |
| anti-HIV_Chain | 4340 | 22-41 | | |
| anti-HIV_Chain | 4341 | 22-41 | 97-106 | |
| anti-HIV_Chain | 4342 | 22-41 | | |
| anti-HIV_Chain | 4343 | 22-41 | | |
| anti-HIV_Chain | 4344 | 22-41 | | |
| anti-HIV_Chain | 4345 | 22-41 | | |
| anti-HIV_Chain | 4346 | 22-41 | | |
| anti-HIV_Chain | 4347 | 22-41 | | |
| anti-HIV_Chain | 4348 | 22-41 | | |
| anti-HIV_Chain | 4349 | 22-41 | | |
| anti-HIV_Chain | 4350 | 22-41 | | |
| anti-HIV_Chain | 4351 | 22-41 | | |
| anti-HIV_Chain | 4352 | 22-41 | | 96-115 |
| anti-HIV_Chain | 4353 | 22-41 | | 94-113 |
| anti-HIV_Chain | 4354 | 22-41 | | 94-113 |
| anti-HIV_Chain | 4355 | 22-41 | | 96-115 |
| anti-HIV_Chain | 4356 | 22-41 | 92-101 | |

TABLE 5-continued

CDRs of exemplified antibodies

| Name | Protein SEQ ID NO | CDR1 | CDR2 | CDR3 |
|---|---|---|---|---|
| anti-HIV_Chain | 4357 | 22-41 | | |
| anti-HIV_Chain | 4358 | 22-41 | | 93-112 |
| anti-HIV_Chain | 4359 | 22-41 | 93-102 | |
| anti-HIV_Chain | 4360 | 22-41 | | 94-113 |
| anti-HIV_Chain | 4361 | 22-41 | | |
| anti-HIV_Chain | 4362 | 22-41 | | |
| anti-HIV_Chain | 4363 | 22-41 | | 93-112 |
| anti-HIV_Chain | 4364 | 22-41 | | 94-113 |
| anti-HIV_Chain | 4365 | 22-41 | | 94-113 |
| anti-HIV_Chain | 4366 | 22-41 | 59-68 | 94-113 |
| anti-HIV_Chain | 4367 | 22-41 | 59-68 | 94-113 |
| anti-HIV_Chain | 4368 | 22-41 | | 94-113 |
| anti-HIV_Chain | 4369 | 22-41 | | 94-113 |
| anti-HIV_Chain | 4370 | 22-41 | | 94-113 |
| anti-HIV_Chain | 4371 | 22-41 | | 94-113 |
| anti-HIV_Chain | 4372 | 22-41 | | 94-113 |
| anti-HIV_Chain | 4373 | 22-41 | | 94-113 |
| anti-HIV_Chain | 4374 | 22-41 | | 94-113 |
| anti-HIV_Chain | 4375 | 22-41 | | 93-112 |
| anti-HIV_Chain | 4376 | 22-41 | 50-59 | 88-107 |
| anti-HIV_Chain | 4377 | 22-41 | | 88-107 |
| anti-HIV_Chain | 4378 | 22-41 | | 93-112 |
| anti-HIV_Chain | 4379 | 22-41 | | |
| anti-HIV_Chain | 4380 | 22-41 | | |
| anti-HIV_Chain | 4381 | 22-41 | | |
| anti-HIV_Chain | 4382 | 22-41 | | |
| anti-HIV_Chain | 4383 | 22-41 | 86-95 | |
| anti-HIV_Chain | 4384 | 22-41 | | 94-113 |
| anti-HIV_Chain | 4385 | 22-41 | | |
| anti-HIV_Chain | 4386 | 22-41 | | |
| anti-HIV_Chain | 4387 | 22-41 | 49-58 | |
| anti-HIV_Chain | 4388 | 22-41 | | |
| anti-HIV_Chain | 4389 | 22-41 | | |
| anti-HIV_Chain | 4390 | 22-41 | | |
| anti-HIV_Chain | 4391 | 22-41 | | |
| anti-HIV_Chain | 4392 | 22-41 | | |
| anti-HIV_Chain | 4393 | 22-41 | 49-58 | |
| anti-HIV_Chain | 4394 | 22-41 | | |
| anti-HIV_Chain | 4395 | 22-41 | | |
| anti-HIV_Chain | 4396 | 22-41 | | 93-112 |
| anti-HIV_Chain | 4397 | 22-41 | | |
| anti-HIV_Chain | 4398 | 22-41 | | 93-112 |
| anti-HIV_Chain | 4399 | 22-41 | | 94-113 |
| anti-HIV_Chain | 4400 | 22-41 | | 93-112 |
| anti-HIV_Chain | 4401 | 22-41 | | 93-112 |
| anti-HIV_Chain | 4402 | 22-41 | | 93-112 |
| anti-HIV_Chain | 4403 | 22-41 | | 93-112 |
| anti-HIV_Chain | 4404 | 22-41 | | 93-112 |
| anti-HIV_Chain | 4405 | 22-41 | | 93-112 |
| anti-HIV_Chain | 4406 | 22-41 | | 93-112 |
| anti-HIV_Chain | 4407 | 22-41 | 59-68 | 94-113 |
| anti-HIV_Chain | 4408 | 22-41 | | 93-112 |
| anti-HIV_Chain | 4409 | 22-41 | | 93-112 |
| anti-HIV_Chain | 4410 | 22-41 | | |
| anti-HIV_Chain | 4411 | 22-41 | 93-102 | |
| anti-HIV_Chain | 4412 | 22-41 | 93-102 | |
| anti-HIV_Chain | 4413 | 22-41 | | |
| anti-HIV_Chain | 4414 | 22-41 | 74-83 | |
| anti-HIV_Chain | 4415 | 22-41 | | 93-112 |
| anti-HIV_Chain | 4416 | 22-41 | 93-102 | |
| anti-HIV_Chain | 4417 | 22-41 | 93-102 | |
| anti-HIV_Chain | 4418 | 22-41 | 74-83 | |
| anti-HIV_Chain | 4419 | 22-41 | | 93-112 |
| anti-HIV_Chain | 4420 | 22-41 | | 93-112 |
| anti-HIV_Chain | 4421 | 22-41 | | 93-112 |
| anti-HIV_Chain | 4422 | 22-41 | | 93-112 |
| anti-HIV_Chain | 4423 | 22-41 | | 93-112 |
| anti-HIV_Chain | 4424 | 22-41 | | 94-113 |
| anti-HIV_Chain | 4425 | 22-41 | 93-102 | 94-113 |
| anti-HIV_Chain | 4426 | 22-41 | | 94-113 |
| anti-HIV_Chain | 4427 | 22-41 | | |
| anti-HIV_Chain | 4428 | 22-41 | | |
| anti-HIV_Chain | 4429 | 22-41 | | |
| anti-HIV_Chain | 4430 | 22-41 | | 96-115 |
| anti-HIV_Chain | 4431 | 22-41 | 53-62 | 95-114 |
| anti-HIV_Chain | 4432 | 22-41 | | 94-113 |

TABLE 5-continued

| | CDRs of exemplified antibodies | | | |
|---|---|---|---|---|
| Name | Protein SEQ ID NO | CDR1 | CDR2 | CDR3 |
| anti-HIV_Chain | 4433 | 22-41 | 50-59 | 88-107 |
| anti-HIV_Chain | 4434 | 22-41 | 50-59 | 88-107 |
| anti-HIV_Chain | 4435 | 22-41 | | |
| anti-HIV_Chain | 4436 | 22-41 | | |
| anti-HIV_Chain | 4437 | 22-41 | | |
| anti-HIV_Chain | 4438 | 22-41 | | |
| anti-HIV_Chain | 4439 | 22-41 | | |
| anti-HIV_Chain | 4440 | 22-41 | | |
| anti-HIV_Chain | 4441 | 22-41 | | |
| anti-HIV_Chain | 4442 | 22-41 | | |
| anti-HIV_Chain | 4443 | 22-41 | | |
| anti-HIV_Chain | 4444 | 22-41 | | |
| anti-HIV_Chain | 4445 | 22-41 | 59-68 | 94-113 |
| anti-HIV_Chain | 4446 | 22-41 | | 94-113 |
| anti-HIV_Chain | 4447 | 22-41 | 93-102 | 94-113 |
| anti-HIV_Chain | 4448 | 22-41 | | 97-116 |
| anti-HIV_Chain | 4449 | 22-41 | 92-101 | |
| anti-HIV_Chain | 4450 | 22-41 | | |
| anti-HIV_Chain | 4451 | 22-41 | | |
| anti-HIV_Chain | 4452 | 22-41 | | |
| anti-HIV_Chain | 4453 | 22-41 | | |
| anti-HIV_Chain | 4454 | 22-41 | | |
| anti-HIV_Chain | 4455 | 22-41 | | |
| anti-HIV_Chain | 4456 | 22-41 | | |
| anti-HIV_Chain | 4457 | 22-41 | | |
| anti-HIV_Chain | 4458 | 22-41 | | |
| anti-HIV_Chain | 4459 | 22-41 | | |
| anti-HIV_Chain | 4460 | 22-41 | | |
| anti-HIV_Chain | 4461 | 22-41 | | |
| anti-HIV_Chain | 4462 | 22-41 | | |
| anti-HIV_Chain | 4463 | 22-41 | | |
| anti-HIV_Chain | 4464 | 22-41 | | 103-122 |
| anti-HIV_Chain | 4465 | 22-41 | | 93-112 |
| anti-HIV_Chain | 4466 | 22-41 | 58-67 | 94-113 |
| anti-HIV_Chain | 4467 | 22-41 | 108-117 | |
| anti-HIV_Chain | 4468 | 22-41 | 50-59 | 88-107 |
| anti-HIV_Chain | 4469 | 22-41 | | 93-112 |
| anti-HIV_Chain | 4470 | 22-41 | | 96-115 |
| anti-HIV_Chain | 4471 | 22-41 | 55-64 | |
| anti-HIV_LightChain | 4472 | 22-41 | 72-81 | 110-129 |
| anti-HIV_Chain | 4473 | 22-41 | 104-113 | 93-112 |
| anti-HIV_Chain | 4474 | 22-41 | 104-113 | |
| anti-HIV_Chain | 4475 | 22-41 | 104-113 | 93-112 |
| anti-HIV_Chain | 4476 | 22-41 | 104-113 | 93-112 |
| anti-HIV_Chain | 4477 | 22-41 | 104-113 | 93-112 |
| anti-HIV_Chain | 4478 | 22-41 | 104-113 | 93-112 |
| anti-HIV_Chain | 4479 | 22-41 | 104-113 | |
| anti-HIV_Chain | 4480 | 22-41 | 92-101 | |
| anti-HIV_Chain | 4481 | 22-41 | 104-113 | 93-112 |
| anti-HIV_Chain | 4482 | 22-41 | 104-113 | 93-112 |
| anti-HIV_Chain | 4483 | 22-41 | | |
| anti-HIV_Chain | 4484 | 22-41 | | |
| anti-HIV_Chain | 4485 | 22-41 | | |
| anti-HIV_Chain | 4486 | 22-41 | | |
| anti-HIV_Chain | 4487 | 22-41 | 59-68 | 94-113 |
| anti-HIV_Chain | 4488 | 22-41 | | 94-113 |
| anti-HIV_Chain | 4489 | 22-41 | | 94-113 |
| anti-HIV_Chain | 4490 | 22-41 | 92-101 | 93-112 |
| anti-HIV_Chain | 4491 | 22-41 | | 94-113 |
| anti-HIV_Chain | 4492 | 22-41 | 59-68 | 94-113 |
| anti-HIV_Chain | 4493 | 22-41 | | 94-113 |
| anti-HIV_Chain | 4494 | 22-41 | | 94-113 |
| anti-HIV_Chain | 4495 | 22-41 | 59-68 | 94-113 |
| anti-HIV_Chain | 4496 | 22-41 | | 94-113 |
| anti-HIV_Chain | 4497 | 22-41 | 59-68 | 94-113 |
| anti-HIV_Chain | 4498 | 22-41 | | 100-119 |
| anti-HIV_Chain | 4499 | 22-41 | | 100-119 |
| anti-HIV_Chain | 4500 | 22-41 | | |
| anti-HIV_Chain | 4501 | 22-41 | 93-102 | 94-113 |
| anti-HIV_Chain | 4502 | 22-41 | | 100-119 |
| anti-HIV_Chain | 4503 | 22-41 | | 94-113 |
| anti-HIV_Chain | 4504 | 22-41 | | 94-113 |
| anti-HIV_Chain | 4505 | 22-41 | 93-102 | 94-113 |
| anti-HIV_Chain | 4506 | 22-41 | | 97-116 |
| anti-HIV_Chain | 4507 | 22-41 | | 97-116 |
| anti-HIV_Chain | 4508 | 22-41 | | 94-113 |

TABLE 5-continued

CDRs of exemplified antibodies

| Name | Protein SEQ ID NO | CDR1 | CDR2 | CDR3 |
|---|---|---|---|---|
| anti-HIV_Chain | 4509 | 22-41 | | 94-113 |
| anti-HIV_Chain | 4510 | 22-41 | | 94-113 |
| anti-HIV_Chain | 4511 | 22-41 | | 94-113 |
| anti-HIV_Chain | 4512 | 22-41 | | 94-113 |
| anti-HIV_Chain | 4513 | 22-41 | | 97-116 |
| anti-HIV_Chain | 4514 | 22-41 | 59-68 | 94-113 |
| anti-HIV_Chain | 4515 | 22-41 | | 94-113 |
| anti-HIV_Chain | 4516 | 22-41 | | 97-116 |
| anti-HIV_Chain | 4517 | 22-41 | | 93-112 |
| anti-HIV_Chain | 4518 | 22-41 | | |
| anti-HIV_Chain | 4519 | 22-41 | | 96-115 |
| anti-HIV_Chain | 4520 | 22-41 | 93-102 | 94-113 |
| anti-HIV_Chain | 4521 | 22-41 | 56-65 | 98-117 |
| anti-HIV_Chain | 4522 | 22-41 | | 95-114 |
| anti-HIV_Chain | 4523 | 22-41 | | 95-114 |
| anti-HIV_Chain | 4524 | 22-41 | | 94-113 |
| anti-HIV_Chain | 4525 | 22-41 | | |
| anti-HIV_Chain | 4526 | 22-41 | | 94-113 |
| anti-HIV_Chain | 4527 | 22-41 | 93-102 | |
| anti-HIV_Chain | 4528 | 22-41 | | |
| anti-HIV_Chain | 4529 | 22-41 | 93-102 | |
| anti-HIV_Chain | 4530 | 22-41 | 93-102 | |
| anti-HIV_Chain | 4531 | 22-41 | | |
| anti-HIV_Chain | 4532 | 22-41 | 93-102 | |
| anti-HIV_Chain | 4533 | 22-41 | | |
| anti-HIV_Chain | 4534 | 22-41 | | 94-113 |
| anti-HIV_Chain | 4535 | 22-41 | | |
| anti-HIV_Chain | 4536 | 22-41 | | |
| anti-HIV_Chain | 4537 | 22-41 | | |
| anti-HIV_Chain | 4538 | 22-41 | | |
| anti-HIV_Chain | 4539 | 22-41 | | |
| anti-HIV_Chain | 4540 | 22-41 | | |
| anti-HIV_Chain | 4541 | 22-41 | | |
| anti-HIV_Chain | 4542 | 22-41 | | |
| anti-HIV_LightChain | 4543 | 22-41 | 72-81 | 110-129 |
| anti-HIV_Chain | 4544 | 22-41 | | |
| anti-HIV_Chain | 4545 | 22-41 | | |
| anti-HIV_Chain | 4546 | 22-41 | 57-66 | 99-118 |
| anti-HIV_Chain | 4547 | 22-41 | | 96-115 |
| anti-HIV_Chain | 4548 | 22-41 | | |
| anti-HIV_Chain | 4549 | 22-41 | 94-103 | 95-114 |
| anti-HIV_Chain | 4550 | 22-41 | | 97-116 |
| anti-HIV_Chain | 4551 | 22-41 | | 94-113 |
| anti-HIV_Chain | 4552 | 22-41 | | 94-113 |
| anti-HIV_Chain | 4553 | 22-41 | | |
| anti-HIV_Chain | 4554 | 22-41 | | |
| anti-HIV_Chain | 4555 | 22-41 | | |
| anti-HIV_Chain | 4556 | 22-41 | | |
| anti-HIV_Chain | 4557 | 22-41 | | 94-113 |
| anti-HIV_Chain | 4558 | 22-41 | | 94-113 |
| anti-HIV_Chain | 4559 | 22-41 | 58-67 | |
| anti-HIV_Chain | 4560 | 22-41 | | 94-113 |
| anti-HIV_Chain | 4561 | 22-41 | | 94-113 |
| anti-HIV_Chain | 4562 | 22-41 | 60-69 | 95-114 |
| anti-HIV_HeavyChain | 4563 | 22-41 | | |
| anti-HIV_HeavyChain | 4564 | 22-41 | | |
| anti-HIV_HeavyChain | 4565 | 22-41 | | |
| anti-HIV_Chain | 4566 | 22-41 | | |
| anti-HIV_Chain | 4567 | 22-41 | | 96-115 |
| anti-HIV_Chain | 4568 | 22-41 | | 101-120 |
| anti-HIV_Chain | 4569 | 22-41 | | 96-115 |
| anti-HIV_Chain | 4570 | 22-41 | 61-70 | 96-115 |
| anti-HIV_Chain | 4571 | 22-41 | 93-102 | 94-113 |
| anti-HIV_Chain | 4572 | 22-41 | 93-102 | 94-113 |
| anti-HIV_Chain | 4573 | 22-41 | | 94-113 |
| anti-HIV_Chain | 4574 | 22-41 | 55-64 | |
| anti-HIV_HeavyChain | 4575 | 22-41 | | |
| anti-HIV_HeavyChain | 4576 | 22-41 | | |
| anti-HIV_HeavyChain | 4577 | 22-41 | | |
| anti-HIV_HeavyChain | 4578 | 22-41 | | |
| anti-HIV_HeavyChain | 4579 | 22-41 | | |
| anti-HIV_HeavyChain | 4580 | 22-41 | | |
| anti-HIV_HeavyChain | 4581 | 22-41 | | |
| anti-HIV_HeavyChain | 4582 | 22-41 | | |
| anti-HIV_HeavyChain | 4583 | 22-41 | | |
| anti-HIV_HeavyChain | 4584 | 22-41 | | |

TABLE 5-continued

CDRs of exemplified antibodies

| Name | Protein SEQ ID NO | CDR1 | CDR2 | CDR3 |
| --- | --- | --- | --- | --- |
| anti-HIV_HeavyChain | 4585 | 22-41 | | |
| anti-HIV_HeavyChain | 4586 | 22-41 | | |
| anti-HIV_HeavyChain | 4587 | 22-41 | | |
| anti-HIV_Chain | 4588 | 22-41 | | |
| anti-HIV_Chain | 4589 | 22-41 | | |
| anti-HIV_Chain | 4590 | 22-41 | | 94-113 |
| anti-HIV_Chain | 4591 | 22-41 | | 94-113 |
| anti-HIV_Chain | 4592 | 22-41 | | 94-113 |
| anti-HIV_Chain | 4593 | 22-41 | | 94-113 |
| anti-HIV_Chain | 4594 | 22-41 | | 94-113 |
| anti-HIV_Chain | 4595 | 22-41 | | 94-113 |
| anti-HIV_Chain | 4596 | 22-41 | | 94-113 |
| anti-HIV_Chain | 4597 | 22-41 | | 94-113 |
| anti-HIV_Chain | 4598 | 22-41 | | 94-113 |
| anti-HIV_Chain | 4599 | 22-41 | | 100-119 |
| anti-HIV_Chain | 4600 | 22-41 | | 94-113 |
| anti-HIV_Chain | 4601 | 22-41 | 93-102 | 94-113 |
| anti-HIV_Chain | 4602 | 22-41 | | 94-113 |
| anti-HIV_Chain | 4603 | 22-41 | | 93-112 |
| anti-HIV_Chain | 4604 | 22-41 | | 81-100 |
| anti-HIV_Chain | 4605 | 22-41 | | 94-113 |
| anti-HIV_Chain | 4606 | 22-41 | | 94-113 |
| anti-HIV_HeavyChain | 4607 | 22-41 | 70-79 | 113-132 |
| anti-HIV_HeavyChain | 4608 | 22-41 | 70-79 | 113-132 |
| anti-HIV_Chain | 4609 | 22-41 | 60-69 | 96-115 |
| anti-HIV_Chain | 4610 | 22-41 | 62-71 | 100-119 |
| anti-HIV_Chain | 4611 | 22-41 | | |
| anti-HIV_Chain | 4612 | 22-41 | | |
| anti-HIV_Chain | 4613 | 22-41 | | 108-127 |
| anti-HIV_Chain | 4614 | 22-41 | 52-61 | |
| anti-HIV_HeavyChain | 4615 | 22-41 | 70-79 | 113-132 |
| anti-HIV_HeavyChain | 4616 | 22-41 | 70-79 | 113-132 |
| anti-HIV_Chain | 4617 | 22-41 | | 93-112 |
| anti-HIV_Chain | 4618 | 22-41 | | 93-112 |
| anti-HIV_Chain | 4619 | 22-41 | | 93-112 |
| anti-HIV_Chain | 4620 | 22-41 | 93-102 | |
| anti-HIV_Chain | 4621 | 22-41 | 59-68 | 94-113 |
| anti-HIV_Chain | 4622 | 22-41 | 59-68 | 94-113 |
| anti-HIV_Chain | 4623 | 22-41 | | |
| anti-HIV_Chain | 4624 | 22-41 | 59-68 | 94-113 |
| anti-HIV_LightChain | 4625 | 22-41 | 48-57 | 86-105 |
| anti-HIV_Chain | 4626 | 22-41 | 49-58 | |
| anti-HIV_Chain | 4627 | 22-41 | 54-63 | 92-111 |
| anti-HIV_SingleChain | 4628 | 22-41 | | 95-114 |
| anti-HIV_LightChain | 4629 | 22-41 | | |
| anti-HIV_Chain | 4630 | 22-41 | | |
| anti-HIV_Chain | 4631 | 22-41 | | 113-132 |
| anti-influenza_Fab | 4632 | 22-41 | 47-56 | 85-104 |
| anti-influenza_Fab | 4633 | 22-41 | | 93-112 |
| anti-influenza_Fab | 4634 | 22-41 | 226-235 | |
| anti-influenza_Fab | 4635 | 22-41 | | 94-113 |
| anti-influenza_Fab | 4636 | 22-41 | 48-57 | 86-105 |
| anti-influenza_Fab | 4637 | 22-41 | | |
| anti-influenza_Fab | 4638 | 22-41 | | |
| anti-influenza_Apo | 4639 | 22-41 | | 85-104 |
| anti-influenza_Apo | 4640 | 22-41 | | 94-113 |
| anti-influenza-A_kappa_LightChain_V-Region | 4641 | 22-41 | 52-61 | 90-109 |
| anti-influenza-A_kappa_LightChain_V-Region | 4642 | 22-41 | 52-61 | 90-109 |
| anti-influenza-A_kappa_LightChain_V-Region | 4643 | 22-41 | 52-61 | 90-109 |
| anti-influenza-A_kappa_LightChain_V-Region | 4644 | 22-41 | 52-61 | 90-109 |
| anti-influenza-A_kappa_LightChain_V-Region | 4645 | 22-41 | 54-63 | 92-111 |
| anti-influenza-A_kappa_LightChain_V-Region | 4646 | 22-41 | 52-61 | 90-109 |
| anti-influenza-A_HeavyChain_V-Region | 4647 | 22-41 | | 94-113 |
| anti-influenza-A_HeavyChain_V-Region | 4648 | 22-41 | | 94-113 |
| anti-influenza-A_HeavyChain_V-Region | 4649 | 22-41 | | 94-113 |
| anti-influenza-A_HeavyChain_V-Region | 4650 | 22-41 | | 94-113 |
| anti-influenza-A_HeavyChain_V-Region | 4651 | 22-41 | | 94-113 |
| anti-influenza-A_HeavyChain_V-Region | 4652 | 22-41 | | 94-113 |
| anti-influenza-A_HeavyChain_V-Region | 4653 | 22-41 | | 94-113 |
| anti-influenza-A_LightChain_V-Region | 4654 | 22-41 | 49-58 | 87-106 |
| anti-influenza-A_HeavyChain_V-Region | 4655 | 22-41 | | 94-113 |
| anti-influenza_Chain | 4656 | 22-41 | | |
| anti-influenza_Chain | 4657 | 22-41 | | |
| anti-influenza_Chain | 4658 | 22-41 | 51-60 | |
| anti-influenza_Chain | 4659 | 22-41 | | |
| anti-influenza_Chain | 4660 | 22-41 | | 84-100 |

TABLE 5-continued

CDRs of exemplified antibodies

| Name | Protein SEQ ID NO | CDR1 | CDR2 | CDR3 |
|---|---|---|---|---|
| anti-influenza_Chain | 4661 | 22-41 | 45-54 | 83-100 |
| anti-influenza_Chain | 4662 | 22-41 | 47-56 | 85-102 |
| anti-influenza_Chain | 4663 | 22-41 | 47-56 | 85-102 |
| anti-influenza_Chain | 4664 | 22-41 | 48-57 | 86-103 |
| anti-influenza_Chain | 4665 | 22-41 | 48-57 | 86-103 |
| anti-influenza_Chain | 4666 | 22-41 | 48-57 | 86-103 |
| anti-influenza_Chain | 4667 | 22-41 | 48-57 | 86-103 |
| anti-influenza_Chain | 4668 | 22-41 | 48-57 | 86-103 |
| anti-influenza_Chain | 4669 | 22-41 | 48-57 | 86-103 |
| anti-influenza_Chain | 4670 | 22-41 | 48-57 | 86-103 |
| anti-influenza_Chain | 4671 | 22-41 | 48-57 | 86-103 |
| anti-influenza_Chain | 4672 | 22-41 | 48-57 | 86-103 |
| anti-influenza_Chain | 4673 | 22-41 |  | 86-105 |
| anti-influenza_Chain | 4674 | 22-41 |  | 86-105 |
| anti-influenza_Chain | 4675 | 22-41 |  |  |
| anti-influenza_Chain | 4676 | 22-41 | 48-57 | 86-105 |
| anti-influenza_Chain | 4677 | 22-41 | 48-57 |  |
| anti-influenza_Chain | 4678 | 22-41 |  | 86-105 |
| anti-influenza_Chain | 4679 | 22-41 |  | 86-105 |
| anti-influenza_Chain | 4680 | 22-41 | 48-57 |  |
| anti-influenza_Chain | 4681 | 22-41 |  | 86-105 |
| anti-influenza_Chain | 4682 | 22-41 | 48-57 |  |
| anti-influenza_Chain | 4683 | 22-41 | 29-38 | 86-105 |
| anti-influenza_Chain | 4684 | 22-41 | 29-38 | 86-105 |
| anti-influenza_Chain | 4685 | 22-41 |  | 86-105 |
| anti-influenza_Chain | 4686 | 22-41 |  | 86-105 |
| anti-influenza_Chain | 4687 | 22-41 |  | 86-105 |
| anti-influenza_Chain | 4688 | 22-41 | 48-57 | 86-105 |
| anti-influenza_Chain | 4689 | 22-41 | 29-38 |  |
| anti-influenza_Chain | 4690 | 22-41 | 48-57 | 86-105 |
| anti-influenza_Chain | 4691 | 22-41 |  | 86-105 |
| anti-influenza_Chain | 4692 | 22-41 |  | 86-105 |
| anti-influenza_Chain | 4693 | 22-41 |  | 86-105 |
| anti-influenza_Chain | 4694 | 22-41 | 48-57 | 86-105 |
| anti-influenza_Chain | 4695 | 22-41 | 31-40 | 86-105 |
| anti-influenza_Chain | 4695 | 22-41 | 48-57 |  |
| anti-influenza_Chain | 4697 | 22-41 |  | 86-105 |
| anti-influenza_Chain | 4698 | 22-41 | 48-57 | 86-105 |
| anti-influenza_Chain | 4699 | 22-41 | 29-38 | 86-105 |
| anti-influenza_Chain | 4700 | 22-41 |  |  |
| anti-influenza_Chain | 4701 | 22-41 |  | 86-105 |
| anti-influenza_Chain | 4702 | 22-41 |  | 86-105 |
| anti-influenza_Chain | 4703 | 22-41 | 48-57 | 86-105 |
| anti-influenza_Chain | 4704 | 22-41 |  | 86-105 |
| anti-influenza_Chain | 4705 | 22-41 |  | 86-105 |
| anti-influenza_Chain | 4706 | 22-41 | 48-57 | 86-105 |
| anti-influenza_Chain | 4707 | 22-41 | 48-57 |  |
| anti-influenza_Chain | 4708 | 22-41 |  | 86-105 |
| anti-influenza_Chain | 4709 | 22-41 | 29-38 | 86-105 |
| anti-influenza_Chain | 4710 | 22-41 | 47-56 | 85-104 |
| anti-influenza_Chain | 4711 | 22-41 | 48-57 | 86-105 |
| anti-influenza_Chain | 4712 | 22-41 | 97-106 | 87-106 |
| anti-influenza_Chain | 4713 | 22-41 | 97-106 | 87-106 |
| anti-influenza_Chain | 4714 | 22-41 | 85-94 | 86-105 |
| anti-influenza_Chain | 4715 | 22-41 | 29-38 | 86-105 |
| anti-influenza_Chain | 4716 | 22-41 | 48-57 |  |
| anti-influenza_Chain | 4717 | 22-41 | 48-57 |  |
| anti-influenza_Chain | 4718 | 22-41 | 48-57 |  |
| anti-influenza_Chain | 4719 | 22-41 | 48-57 | 86-105 |
| anti-influenza_Chain | 4720 | 22-41 | 48-57 | 86-105 |
| anti-influenza_Chain | 4721 | 22-41 | 48-57 | 86-105 |
| anti-influenza_Chain | 4722 | 22-41 | 48-57 | 86-105 |
| anti-influenza_Chain | 4723 | 22-41 | 48-57 | 86-105 |
| anti-influenza_Chain | 4724 | 22-41 | 49-58 | 87-106 |
| anti-influenza_Chain | 4725 | 22-41 | 49-58 | 87-106 |
| anti-influenza_Chain | 4726 | 22-41 | 49-58 | 87-106 |
| anti-influenza_Chain | 4727 | 22-41 | 48-57 | 86-105 |
| anti-influenza_Chain | 4728 | 22-41 | 49-58 | 87-106 |
| anti-influenza_Chain | 4729 | 22-41 | 49-58 |  |
| anti-influenza_Chain | 4730 | 22-41 |  | 87-106 |
| anti-influenza_Chain | 4731 | 22-41 | 48-57 | 86-105 |
| anti-influenza_Chain | 4732 | 22-41 | 47-56 | 85-104 |
| anti-influenza_Chain | 4733 | 22-41 |  | 85-104 |
| anti-influenza_Chain | 4734 | 22-41 | 49-58 | 87-106 |
| anti-influenza_Chain | 4735 | 22-41 | 48-57 | 86-105 |
| anti-influenza_Chain | 4736 | 22-41 |  | 90-108 |

TABLE 5-continued

CDRs of exemplified antibodies

| Name | Protein SEQ ID NO | CDR1 | CDR2 | CDR3 |
|---|---|---|---|---|
| anti-influenza_Chain | 4737 | 22-41 | 48-57 | 86-105 |
| anti-influenza_Chain | 4738 | 22-41 |  | 87-106 |
| anti-influenza_Chain | 4739 | 22-41 | 48-57 | 85-105 |
| anti-influenza_Chain | 4740 | 22-41 | 47-56 |  |
| anti-influenza_Chain | 4741 | 22-41 | 47-56 |  |
| anti-influenza_Chain | 4742 | 22-41 | 98-107 | 88-107 |
| anti-influenza_Chain | 4743 | 22-41 |  | 89-108 |
| anti-influenza_Chain | 4744 | 22-41 |  |  |
| anti-influenza_Chain | 4745 | 22-41 |  | 86-105 |
| anti-influenza_Chain | 4746 | 22-41 | 49-58 | 87-106 |
| anti-influenza_Chain | 4747 | 22-41 | 48-57 | 86-105 |
| anti-influenza_Chain | 4748 | 22-41 | 49-58 | 87-106 |
| anti-influenza_Chain | 4749 | 22-41 | 49-58 |  |
| anti-influenza_Chain | 4750 | 22-41 | 49-58 |  |
| anti-influenza_Chain | 4751 | 22-41 | 48-57 | 86-105 |
| anti-influenza_Chain | 4752 | 22-41 |  | 88-107 |
| anti-influenza_Chain | 4753 | 22-41 | 48-57 | 86-105 |
| anti-influenza_Chain | 4754 | 22-41 | 48-57 | 86-105 |
| anti-influenza_Chain | 4755 | 22-41 | 48-57 | 86-105 |
| anti-influenza_Chain | 4756 | 22-41 | 48-57 | 86-105 |
| anti-influenza_Chain | 4757 | 22-41 | 48-57 | 86-105 |
| anti-influenza_Chain | 4758 | 22-41 | 49-58 | 87-106 |
| anti-influenza_Chain | 4759 | 22-41 |  | 85-104 |
| anti-influenza_Chain | 4760 | 22-41 | 49-58 | 87-106 |
| anti-influenza_Chain | 4761 | 22-41 |  | 85-104 |
| anti-influenza_Chain | 4762 | 22-41 | 49-58 | 87-106 |
| anti-influenza_Chain | 4763 | 22-41 |  | 85-104 |
| anti-influenza_Chain | 4764 | 22-41 |  | 85-104 |
| anti-influenza_Chain | 4765 | 22-41 |  | 87-106 |
| anti-influenza_Chain | 4766 | 22-41 |  | 85-104 |
| anti-influenza_Chain | 4767 | 22-41 |  | 85-104 |
| anti-influenza_Chain | 4768 | 22-41 | 49-58 | 87-106 |
| anti-influenza_Chain | 4769 | 22-41 |  | 86-105 |
| anti-influenza_Chain | 4770 | 22-41 |  | 86-105 |
| anti-influenza_Chain | 4771 | 22-41 |  | 86-105 |
| anti-influenza_Chain | 4772 | 22-41 |  | 86-105 |
| anti-influenza_Chain | 4773 | 22-41 |  | 86-105 |
| anti-influenza_Chain | 4774 | 22-41 |  | 86-105 |
| anti-influenza_Chain | 4775 | 22-41 |  | 86-105 |
| anti-influenza_Chain | 4776 | 22-41 |  | 86-105 |
| anti-influenza_Chain | 4777 | 22-41 |  | 86-105 |
| anti-influenza_Chain | 4778 | 22-41 | 48-57 | 86-105 |
| anti-influenza_Chain | 4779 | 22-41 | 48-57 | 86-105 |
| anti-influenza_Chain | 4780 | 22-41 | 48-57 | 86-105 |
| anti-influenza_Chain | 4781 | 22-41 | 48-57 | 86-105 |
| anti-influenza_Chain | 4782 | 22-41 | 48-57 | 86-105 |
| anti-influenza_Chain | 4783 | 22-41 | 48-57 | 86-105 |
| anti-influenza_Chain | 4784 | 22-41 | 48-57 | 86-105 |
| anti-influenza_Chain | 4785 | 22-41 | 48-57 | 86-105 |
| anti-influenza_Chain | 4786 | 22-41 | 48-57 | 86-105 |
| anti-influenza_Chain | 4787 | 22-41 | 48-57 | 86-105 |
| anti-influenza_Chain | 4788 | 22-41 | 48-57 | 86-105 |
| anti-influenza_Chain | 4789 | 22-41 | 48-57 |  |
| anti-influenza_Chain | 4790 | 22-41 | 29-38 | 86-105 |
| anti-influenza_Chain | 4791 | 22-41 | 48-57 | 86-105 |
| anti-influenza_Chain | 4792 | 22-41 | 48-57 | 86-105 |
| anti-influenza_Chain | 4793 | 22-41 |  | 86-105 |
| anti-influenza_Chain | 4794 | 22-41 |  | 87-106 |
| anti-influenza_Chain | 4795 | 22-41 | 49-58 | 87-106 |
| anti-influenza_Chain | 4796 | 22-41 | 48-57 | 86-105 |
| anti-influenza_Chain | 4797 | 22-41 | 49-58 | 87-106 |
| anti-influenza_Chain | 4798 | 22-41 | 50-59 |  |
| anti-influenza_Chain | 4799 | 22-41 | 50-59 | 88-107 |
| anti-influenza_Chain | 4800 | 22-41 | 50-59 | 88-107 |
| anti-influenza_Chain | 4801 | 22-41 | 49-58 | 87-106 |
| anti-influenza_Chain | 4802 | 22-41 |  |  |
| anti-influenza_Chain | 4803 | 22-41 | 50-59 | 89-108 |
| anti-influenza_Chain | 4804 | 22-41 | 48-57 | 86-105 |
| anti-influenza_Chain | 4805 | 22-41 | 49-58 | 87-106 |
| anti-influenza_Chain | 4806 | 22-41 |  | 88-107 |
| anti-influenza_Chain | 4807 | 22-41 | 49-58 | 87-106 |
| anti-influenza_Chain | 4808 | 22-41 | 48-57 | 86-105 |
| anti-influenza_Chain | 4809 | 22-41 |  | 85-104 |
| anti-influenza_Chain | 4810 | 22-41 |  | 87-106 |
| anti-influenza_Chain | 4811 | 22-41 | 48-57 | 86-105 |
| anti-influenza_Chain | 4812 | 22-41 | 48-57 | 86-105 |

TABLE 5-continued

CDRs of exemplified antibodies

| Name | Protein SEQ ID NO | CDR1 | CDR2 | CDR3 |
|---|---|---|---|---|
| anti-influenza_Chain | 4813 | 22-41 | 48-57 | |
| anti-influenza_Chain | 4814 | 22-41 | | 85-104 |
| anti-influenza_Chain | 4815 | 22-41 | | 86-105 |
| anti-influenza_Chain | 4816 | 22-41 | 50-59 | 88-107 |
| anti-influenza_Chain | 4817 | 22-41 | 50-59 | 88-107 |
| anti-influenza_Chain | 4818 | 22-41 | 50-59 | 88-107 |
| anti-influenza_Chain | 4819 | 22-41 | | 88-107 |
| anti-influenza_Chain | 4820 | 22-41 | 50-59 | 88-107 |
| anti-influenza_Chain | 4821 | 22-41 | 50-59 | 88-107 |
| anti-influenza_Chain | 4822 | 22-41 | 50-59 | 88-107 |
| anti-influenza_Chain | 4823 | 22-41 | | 88-107 |
| anti-influenza_Chain | 4824 | 22-41 | | 88-107 |
| anti-influenza_Chain | 4825 | 22-41 | | 88-107 |
| anti-influenza_Chain | 4826 | 22-41 | 52-61 | 90-109 |
| anti-influenza_Chain | 4827 | 22-41 | 50-59 | 88-107 |
| anti-influenza_Chain | 4828 | 22-41 | 49-58 | 87-106 |
| anti-influenza_Chain | 4829 | 22-41 | 49-58 | 87-106 |
| anti-influenza_Chain | 4830 | 22-41 | 50-59 | 88-107 |
| anti-influenza_Chain | 4831 | 22-41 | 49-58 | 89-108 |
| anti-influenza_Chain | 4832 | 22-41 | 49-58 | 87-106 |
| anti-influenza_Chain | 4833 | 22-41 | 48-57 | 86-105 |
| anti-influenza_Chain | 4834 | 22-41 | 49-58 | 87-106 |
| anti-influenza_Chain | 4835 | 22-41 | 50-59 | 88-107 |
| anti-influenza_Chain | 4836 | 22-41 | | 87-106 |
| anti-influenza_Chain | 4837 | 22-41 | 48-57 | 86-105 |
| anti-influenza_Chain | 4838 | 22-41 | 50-59 | 88-107 |
| anti-influenza_Chain | 4839 | 22-41 | 49-58 | 87-106 |
| anti-influenza_Chain | 4840 | 22-41 | 50-59 | 88-107 |
| anti-influenza_Chain | 4841 | 22-41 | 49-58 | 87-106 |
| anti-influenza_Chain | 4842 | 22-41 | 50-59 | 88-107 |
| anti-influenza_Chain | 4843 | 22-41 | | |
| anti-influenza_Chain | 4844 | 22-41 | | 87-106 |
| anti-influenza_Chain | 4845 | 22-41 | | |
| anti-influenza_Chain | 4846 | 22-41 | | |
| anti-influenza_Chain | 4847 | 22-41 | | |
| anti-influenza_Chain | 4848 | 22-41 | 31-40 | 90-109 |
| anti-influenza_Chain | 4849 | 22-41 | 31-40 | 90-109 |
| anti-influenza_Chain | 4850 | 22-41 | 48-57 | 86-105 |
| anti-influenza_Chain | 4851 | 22-41 | | 92-111 |
| anti-influenza_Chain | 4852 | 22-41 | 53-62 | 91-110 |
| anti-influenza_Chain | 4853 | 22-41 | | 91-110 |
| anti-influenza_Chain | 4854 | 22-41 | | 91-110 |
| anti-influenza_Chain | 4855 | 22-41 | 53-62 | 91-110 |
| anti-influenza_Chain | 4856 | 22-41 | 50-59 | 88-107 |
| anti-influenza_Chain | 4857 | 22-41 | | 88-107 |
| anti-influenza_Chain | 4858 | 22-41 | 49-58 | 87-106 |
| anti-influenza_Chain | 4859 | 22-41 | 49-58 | 87-106 |
| anti-influenza_Chain | 4860 | 22-41 | 53-62 | 91-110 |
| anti-influenza_Chain | 4861 | 22-41 | | 87-106 |
| anti-influenza_Chain | 4862 | 22-41 | 50-59 | 88-107 |
| anti-influenza_Chain | 4863 | 22-41 | | |
| anti-influenza_Chain | 4864 | 22-41 | | |
| anti-influenza_Chain | 4865 | 22-41 | | |
| anti-influenza_Chain | 4866 | 22-41 | | |
| anti-influenza_Chain | 4867 | 22-41 | 53-62 | 91-110 |
| anti-influenza_Chain | 4868 | 22-41 | 54-63 | 92-111 |
| anti-influenza_Chain | 4869 | 22-41 | 54-63 | 92-111 |
| anti-influenza_Chain | 4870 | 22-41 | 54-63 | 92-111 |
| anti-influenza_Chain | 4871 | 22-41 | 54-63 | |
| anti-influenza_Chain | 4872 | 22-41 | 53-62 | 91-110 |
| anti-influenza_Chain | 4873 | 22-41 | | 88-107 |
| anti-influenza_Chain | 4874 | 22-41 | 54-63 | 92-111 |
| anti-influenza_Chain | 4875 | 22-41 | 54-63 | 92-111 |
| anti-influenza_Chain | 4876 | 22-41 | 48-57 | 86-105 |
| anti-influenza_Chain | 4877 | 22-41 | 48-57 | |
| anti-influenza_Chain | 4878 | 22-41 | 53-62 | 91-110 |
| anti-influenza_Chain | 4879 | 22-41 | 53-62 | 91-110 |
| anti-influenza_Chain | 4880 | 22-41 | | 94-113 |
| anti-influenza_Chain | 4881 | 22-41 | | 94-113 |
| anti-influenza_Chain | 4882 | 22-41 | | 94-113 |
| anti-influenza_Chain | 4883 | 22-41 | | 94-113 |
| anti-influenza_Chain | 4884 | 22-41 | 36-45 | 91-110 |
| anti-influenza_Chain | 4885 | 22-41 | 50-59 | 88-107 |
| anti-influenza_Chain | 4886 | 22-41 | 54-63 | 92-111 |
| anti-influenza_Chain | 4887 | 22-41 | 53-62 | 91-110 |
| anti-influenza_Chain | 4888 | 22-41 | 89-98 | 90-109 |

TABLE 5-continued

CDRs of exemplified antibodies

| Name | Protein SEQ ID NO | CDR1 | CDR2 | CDR3 |
|---|---|---|---|---|
| anti-influenza_Chain | 4889 | 22-41 | | 94-113 |
| anti-influenza_Chain | 4890 | 22-41 | 51-60 | |
| anti-influenza_Chain | 4891 | 22-41 | 31-40 | 94-113 |
| anti-influenza_Chain | 4892 | 22-41 | 52-61 | 94-113 |
| anti-influenza_Chain | 4893 | 22-41 | | |
| anti-influenza_Chain | 4894 | 22-41 | | 94-113 |
| anti-influenza_Chain | 4895 | 22-41 | | 94-113 |
| anti-influenza_Chain | 4896 | 22-41 | | 94-113 |
| anti-influenza_Chain | 4897 | 22-41 | | 91-110 |
| anti-influenza_Chain | 4898 | 22-41 | | |
| anti-influenza_Chain | 4899 | 22-41 | | 94-113 |
| anti-influenza_Chain | 4900 | 22-41 | | 93-112 |
| anti-influenza_Chain | 4901 | 22-41 | | 93-112 |
| anti-influenza_Chain | 4902 | 22-41 | | 93-112 |
| anti-influenza_Chain | 4903 | 22-41 | | 95-114 |
| anti-influenza_Chain | 4904 | 22-41 | | 94-113 |
| anti-influenza_Chain | 4905 | 22-41 | | 94-113 |
| anti-influenza_Chain | 4906 | 22-41 | 51-60 | |
| anti-influenza_Chain | 4907 | 22-41 | 51-60 | 93-112 |
| anti-influenza_Chain | 4908 | 22-41 | 51-60 | 93-112 |
| anti-influenza_Chain | 4909 | 22-41 | 51-60 | 93-112 |
| anti-influenza_Chain | 4910 | 22-41 | | 93-112 |
| anti-influenza_Chain | 4911 | 22-41 | | 94-113 |
| anti-influenza_Chain | 4912 | 22-41 | | 94-113 |
| anti-influenza_Chain | 4913 | 22-41 | | 93-112 |
| anti-influenza_Chain | 4914 | 22-41 | | |
| anti-influenza_Chain | 4915 | 22-41 | 53-62 | 95-114 |
| anti-influenza_Chain | 4916 | 22-41 | 93-102 | |
| anti-influenza_Chain | 4917 | 22-41 | | 94-113 |
| anti-influenza_Chain | 4918 | 22-41 | | 93-112 |
| anti-influenza_Chain | 4919 | 22-41 | 51-60 | 93-112 |
| anti-influenza_Chain | 4920 | 22-41 | | 93-112 |
| anti-influenza_Chain | 4921 | 22-41 | 92-101 | 93-112 |
| anti-influenza_Chain | 4922 | 22-41 | 51-60 | 93-112 |
| anti-influenza_Chain | 4923 | 22-41 | 51-60 | |
| anti-influenza_Chain | 4924 | 22-41 | | |
| anti-influenza_Chain | 4925 | 22-41 | | 94-113 |
| anti-influenza_Chain | 4926 | 22-41 | | 94-113 |
| anti-influenza_Chain | 4927 | 22-41 | | 94-113 |
| anti-influenza_Chain | 4928 | 22-41 | | 94-113 |
| anti-influenza_Chain | 4929 | 22-41 | | 94-113 |
| anti-influenza_Chain | 4930 | 22-41 | | 94-113 |
| anti-influenza_Chain | 4931 | 22-41 | | 94-113 |
| anti-influenza_Chain | 4932 | 22-41 | | 94-113 |
| anti-influenza_Chain | 4933 | 22-41 | | 94-113 |
| anti-influenza_Chain | 4934 | 22-41 | 59-68 | 94-113 |
| anti-influenza_Chain | 4935 | 22-41 | | 94-113 |
| anti-influenza_Chain | 4936 | 22-41 | | 94-113 |
| anti-influenza_Chain | 4937 | 22-41 | | 95-114 |
| anti-influenza_Chain | 4938 | 22-41 | | 94-113 |
| anti-influenza_Chain | 4939 | 22-41 | | 94-113 |
| anti-influenza_Chain | 4940 | 22-41 | | |
| anti-influenza_Chain | 4941 | 22-41 | 34-43 | 94-113 |
| anti-influenza_Chain | 4942 | 22-41 | 51-60 | |
| anti-influenza_Chain | 4943 | 22-41 | | 92-111 |
| anti-influenza_Chain | 4944 | 22-41 | 100-109 | 94-113 |
| anti-influenza_Chain | 4945 | 22-41 | | 93-112 |
| anti-influenza_Chain | 4946 | 22-41 | | 93-112 |
| anti-influenza_Chain | 4947 | 22-41 | | |
| anti-influenza_Chain | 4948 | 22-41 | | 94-113 |
| anti-influenza_Chain | 4949 | 22-41 | | 94-113 |
| anti-influenza_Chain | 4950 | 22-41 | | 94-113 |
| anti-influenza_Chain | 4951 | 22-41 | 103-112 | 94-113 |
| anti-influenza_Chain | 4952 | 22-41 | | |
| anti-influenza_Chain | 4953 | 22-41 | | 94-113 |
| anti-influenza_Chain | 4954 | 22-41 | | 94-113 |
| anti-influenza_Chain | 4955 | 22-41 | 93-102 | 94-113 |
| anti-influenza_Chain | 4956 | 22-41 | | 94-113 |
| anti-influenza_Chain | 4957 | 22-41 | | 94-113 |
| anti-influenza_Chain | 4958 | 22-41 | 58-67 | 94-113 |
| anti-influenza_Chain | 4959 | 22-41 | 58-67 | 94-113 |
| anti-influenza_Chain | 4960 | 22-41 | 51-60 | 94-113 |
| anti-influenza_Chain | 4961 | 22-41 | | 94-113 |
| anti-influenza_Chain | 4962 | 22-41 | | 94-113 |
| anti-influenza_Chain | 4963 | 22-41 | | |
| anti-influenza_Chain | 4964 | 22-41 | | 94-113 |

TABLE 5-continued

CDRs of exemplified antibodies

| Name | Protein SEQ ID NO | CDR1 | CDR2 | CDR3 |
|---|---|---|---|---|
| anti-influenza_Chain | 4965 | 22-41 | | |
| anti-influenza_Chain | 4966 | 22-41 | 51-60 | 93-112 |
| anti-influenza_Chain | 4967 | 22-41 | | 94-113 |
| anti-influenza_Chain | 4968 | 22-41 | | |
| anti-influenza_Chain | 4969 | 22-41 | 93-102 | 94-113 |
| anti-influenza_Chain | 4970 | 22-41 | | 94-113 |
| anti-influenza_Chain | 4971 | 22-41 | | |
| anti-influenza_Chain | 4972 | 22-41 | 58-67 | 94-113 |
| anti-influenza_Chain | 4973 | 22-41 | | 94-113 |
| anti-influenza_Chain | 4974 | 22-41 | | 94-113 |
| anti-influenza_Chain | 4975 | 22-41 | | 94-113 |
| anti-influenza_Chain | 4976 | 22-41 | | 94-113 |
| anti-influenza_Chain | 4977 | 22-41 | | 94-113 |
| anti-influenza_Chain | 4978 | 22-41 | | 93-112 |
| anti-influenza_Chain | 4979 | 22-41 | | 93-112 |
| anti-influenza_Chain | 4980 | 22-41 | | 94-113 |
| anti-influenza_Chain | 4981 | 22-41 | | |
| anti-influenza_Chain | 4982 | 22-41 | | 94-113 |
| anti-influenza_Chain | 4983 | 22-41 | 53-62 | 95-114 |
| anti-influenza_Chain | 4984 | 22-41 | | 94-113 |
| anti-influenza_Chain | 4985 | 22-41 | 53-62 | 95-114 |
| anti-influenza_Chain | 4986 | 22-41 | | 94-113 |
| anti-influenza_Chain | 4987 | 22-41 | | |
| anti-influenza_Chain | 4988 | 22-41 | 51-60 | 94-113 |
| anti-influenza_Chain | 4989 | 22-41 | | 95-114 |
| anti-influenza_Chain | 4990 | 22-41 | 93-102 | 94-113 |
| anti-influenza_Chain | 4991 | 22-41 | 93-102 | 94-113 |
| anti-influenza_Chain | 4992 | 22-41 | 59-68 | 94-113 |
| anti-influenza_Chain | 4993 | 22-41 | 59-68 | 94-113 |
| anti-influenza_Chain | 4994 | 22-41 | 59-68 | 94-113 |
| anti-influenza_Chain | 4995 | 22-41 | 59-68 | 94-113 |
| anti-influenza_Chain | 4996 | 22-41 | 59-68 | 94-113 |
| anti-influenza_Chain | 4997 | 22-41 | 59-68 | 94-113 |
| anti-influenza_Chain | 4998 | 22-41 | 59-68 | 94-113 |
| anti-influenza_Chain | 4999 | 22-41 | 59-68 | 94-113 |
| anti-influenza_Chain | 5000 | 22-41 | 59-68 | 94-113 |
| anti-influenza_Chain | 5001 | 22-41 | | 94-113 |
| anti-influenza_Chain | 5002 | 22-41 | | 93-112 |
| anti-influenza_Chain | 5003 | 22-41 | 53-62 | 95-114 |
| anti-influenza_Chain | 5004 | 22-41 | 53-62 | 95-114 |
| anti-influenza_Chain | 5005 | 22-41 | | 94-113 |
| anti-influenza_Chain | 5006 | 22-41 | 93-102 | |
| anti-influenza_Chain | 5007 | 22-41 | 51-60 | 94-113 |
| anti-influenza_Chain | 5008 | 22-41 | 51-60 | |
| anti-influenza_Chain | 5009 | 22-41 | | 94-113 |
| anti-influenza_Chain | 5010 | 22-41 | 53-62 | 95-114 |
| anti-influenza_Chain | 5011 | 22-41 | 51-60 | |
| anti-influenza_Chain | 5012 | 22-41 | | 94-113 |
| anti-influenza_Chain | 5013 | 22-41 | 93-102 | 94-113 |
| anti-influenza_Chain | 5014 | 22-41 | 51-60 | 94-113 |
| anti-influenza_Chain | 5015 | 22-41 | | 94-113 |
| anti-influenza_Chain | 5016 | 22-41 | 53-62 | 95-114 |
| anti-influenza_Chain | 5017 | 22-41 | | 94-113 |
| anti-influenza_Chain | 5018 | 22-41 | 51-60 | 94-113 |
| anti-influenza_Chain | 5019 | 22-41 | 51-60 | 94-113 |
| anti-influenza_Chain | 5020 | 22-41 | | 94-113 |
| anti-influenza_Chain | 5021 | 22-41 | | 94-113 |
| anti-influenza_Chain | 5022 | 22-41 | | 94-113 |
| anti-influenza_Chain | 5023 | 22-41 | | 94-113 |
| anti-influenza_Chain | 5024 | 22-41 | | |
| anti-influenza_Chain | 5025 | 22-41 | | 94-113 |
| anti-influenza_Chain | 5026 | 22-41 | | |
| anti-influenza_Chain | 5027 | 22-41 | | 94-113 |
| anti-influenza_Chain | 5028 | 22-41 | | 98-117 |
| anti-influenza_Chain | 5029 | 22-41 | 51-60 | 93-112 |
| anti-influenza_Chain | 5030 | 22-41 | | 94-113 |
| anti-influenza_Chain | 5031 | 22-41 | | |
| anti-influenza_Chain | 5032 | 22-41 | | 92-111 |
| anti-influenza_Chain | 5033 | 22-41 | | 94-113 |
| anti-influenza_Chain | 5034 | 22-41 | | 94-113 |
| anti-influenza_Chain | 5035 | 22-41 | | 94-113 |
| anti-influenza_Chain | 5036 | 22-41 | | 94-113 |
| anti-influenza_Chain | 5037 | 22-41 | 53-62 | 95-114 |
| anti-influenza_Chain | 5038 | 22-41 | 54-63 | 94-113 |
| anti-influenza_Chain | 5039 | 22-41 | 31-40 | 94-113 |
| anti-influenza_Chain | 5040 | 22-41 | 96-105 | 97-116 |

TABLE 5-continued

CDRs of exemplified antibodies

| Name | Protein SEQ ID NO | CDR1 | CDR2 | CDR3 |
| --- | --- | --- | --- | --- |
| anti-influenza_Chain | 5041 | 22-41 | | 93-112 |
| anti-influenza_Chain | 5042 | 22-41 | 51-60 | 94-113 |
| anti-influenza_Chain | 5043 | 22-41 | | |
| anti-influenza_Chain | 5044 | 22-41 | | |
| anti-influenza_Chain | 5045 | 22-41 | 96-105 | 97-116 |
| anti-influenza_Chain | 5046 | 22-41 | 96-105 | 97-116 |
| anti-influenza_Chain | 5047 | 22-41 | 96-105 | 97-116 |
| anti-influenza_Chain | 5048 | 22-41 | | |
| anti-influenza_Chain | 5049 | 22-41 | | 97-116 |
| anti-influenza_Chain | 5050 | 22-41 | | 97-116 |
| anti-influenza_Chain | 5051 | 22-41 | | 97-116 |
| anti-influenza_Chain | 5052 | 22-41 | | 97-116 |
| anti-influenza_Chain | 5053 | 22-41 | | 94-113 |
| anti-influenza_Chain | 5054 | 22-41 | | 93-112 |
| anti-influenza_Chain | 5055 | 22-41 | 92-101 | 93-112 |
| anti-influenza_Chain | 5056 | 22-41 | | 93-112 |
| anti-influenza_Chain | 5057 | 22-41 | | 95-114 |
| anti-influenza_Chain | 5058 | 22-41 | | 94-113 |
| anti-influenza_Chain | 5059 | 22-41 | | 94-113 |
| anti-influenza_Chain | 5060 | 22-41 | | 94-113 |
| anti-influenza_Chain | 5061 | 22-41 | | 98-117 |
| anti-influenza_Chain | 5062 | 22-41 | | |
| anti-influenza_Chain | 5063 | 22-41 | | |
| anti-influenza_Chain | 5064 | 22-41 | | |
| anti-influenza_Chain | 5065 | 22-41 | 114-123 | 94-113 |
| anti-influenza_Chain | 5066 | 22-41 | | 94-113 |
| anti-influenza_Chain | 5067 | 22-41 | | 94-113 |
| anti-influenza_Chain | 5068 | 22-41 | | 94-113 |
| anti-influenza_Chain | 5069 | 22-41 | 51-60 | 93-112 |
| anti-influenza_Chain | 5070 | 22-41 | | 94-113 |
| anti-influenza_Chain | 5071 | 22-41 | | |
| anti-influenza_Chain | 5072 | 22-41 | | 96-115 |
| anti-influenza_Chain | 5073 | 22-41 | 51-60 | 94-113 |
| anti-influenza_Chain | 5074 | 22-41 | | 94-113 |
| anti-influenza_Chain | 5075 | 22-41 | | |
| anti-influenza_Chain | 5076 | 22-41 | | 94-113 |
| anti-influenza_Chain | 5077 | 22-41 | 53-62 | 95-114 |
| anti-influenza_Chain | 5078 | 22-41 | | 94-113 |
| anti-influenza_Chain | 5079 | 22-41 | | 95-114 |
| anti-influenza_Chain | 5080 | 22-41 | | |
| anti-influenza_Chain | 5081 | 22-41 | | 94-113 |
| anti-influenza_Chain | 5082 | 22-41 | | 94-113 |
| anti-influenza_Chain | 5083 | 22-41 | | 94-113 |
| anti-influenza_Chain | 5084 | 22-41 | | 95-114 |
| anti-influenza_Chain | 5085 | 22-41 | | 95-114 |
| anti-influenza_Chain | 5086 | 22-41 | | |
| anti-influenza_Chain | 5087 | 22-41 | 93-102 | 94-113 |
| anti-influenza_Chain | 5088 | 22-41 | | 96-115 |
| anti-influenza_Chain | 5089 | 22-41 | | 96-115 |
| anti-influenza_Chain | 5090 | 22-41 | | 96-115 |
| anti-influenza_Chain | 5091 | 22-41 | | 96-115 |
| anti-influenza_Chain | 5092 | 22-41 | | 96-115 |
| anti-influenza_Chain | 5093 | 22-41 | | 96-115 |
| anti-influenza_Chain | 5094 | 22-41 | | 96-115 |
| anti-influenza_Chain | 5095 | 22-41 | | 96-115 |
| anti-influenza_Chain | 5096 | 22-41 | | 96-115 |
| anti-influenza_Chain | 5097 | 22-41 | | 96-115 |
| anti-influenza_Chain | 5098 | 22-41 | | 96-115 |
| anti-influenza_Chain | 5099 | 22-41 | | 96-115 |
| anti-influenza_Chain | 5100 | 22-41 | | 99-118 |
| anti-influenza_Chain | 5101 | 22-41 | | |
| anti-influenza_Chain | 5102 | 22-41 | | |
| anti-influenza_Chain | 5103 | 22-41 | 122-131 | |
| anti-influenza_Chain | 5104 | 22-41 | 183-192 | |
| anti-influenza_Chain | 5105 | 22-41 | 48-57 | 86-105 |
| anti-influenza_Chain | 5106 | 22-41 | | 86-105 |
| anti-influenza_Chain | 5107 | 22-41 | 48-57 | 86-105 |
| anti-influenza_Chain | 5108 | 22-41 | 49-58 | 87-106 |
| anti-influenza_Chain | 5109 | 22-41 | 47-56 | 85-104 |
| anti-influenza_Chain | 5110 | 22-41 | 48-57 | |
| anti-influenza_Chain | 5111 | 22-41 | | |
| anti-influenza_Chain | 5112 | 22-41 | 48-57 | 86-105 |
| anti-influenza_Chain | 5113 | 22-41 | 97-106 | 87-106 |
| anti-influenza_Chain | 5114 | 22-41 | 97-106 | 87-106 |
| anti-influenza_Chain | 5115 | 22-41 | 47-56 | 85-104 |
| anti-influenza_Chain | 5116 | 22-41 | 50-59 | 88-107 |

TABLE 5-continued

CDRs of exemplified antibodies

| Name | Protein SEQ ID NO | CDR1 | CDR2 | CDR3 |
|---|---|---|---|---|
| anti-influenza_Chain | 5117 | 22-41 | | 86-105 |
| anti-influenza_Chain | 5118 | 22-41 | | 86-105 |
| anti-influenza_Chain | 5119 | 22-41 | | 86-105 |
| anti-influenza_Chain | 5120 | 22-41 | | 86-105 |
| anti-influenza_Chain | 5121 | 22-41 | | 86-105 |
| anti-influenza_Chain | 5122 | 22-41 | | 86-105 |
| anti-influenza_Chain | 5123 | 22-41 | | 86-105 |
| anti-influenza_Chain | 5124 | 22-41 | | 86-105 |
| anti-influenza_Chain | 5125 | 22-41 | | 86-105 |
| anti-influenza_Chain | 5126 | 22-41 | 48-57 | 86-105 |
| anti-influenza_Chain | 5127 | 22-41 | 48-57 | 86-105 |
| anti-influenza_Chain | 5128 | 22-41 | 48-57 | 86-105 |
| anti-influenza_Chain | 5129 | 22-41 | 48-57 | 86-105 |
| anti-influenza_Chain | 5130 | 22-41 | 48-57 | 86-105 |
| anti-influenza_Chain | 5131 | 22-41 | 48-57 | 86-105 |
| anti-influenza_Chain | 5132 | 22-41 | 48-57 | 86-105 |
| anti-influenza_Chain | 5133 | 22-41 | 48-57 | 86-105 |
| anti-influenza_Chain | 5134 | 22-41 | 53-62 | 91-110 |
| anti-influenza_Chain | 5135 | 22-41 | | 87-106 |
| anti-influenza_Chain | 5136 | 22-41 | 98-107 | 88-107 |
| anti-influenza_Chain | 5137 | 22-41 | 49-58 | 87-106 |
| anti-influenza_Chain | 5138 | 22-41 | 49-58 | 87-106 |
| anti-influenza_Chain | 5139 | 22-41 | 49-58 | 87-106 |
| anti-influenza_Chain | 5140 | 22-41 | | 85-104 |
| anti-influenza_Chain | 5141 | 22-41 | | 85-104 |
| anti-influenza_Chain | 5142 | 22-41 | | |
| anti-influenza_Chain | 5143 | 22-41 | 49-58 | 87-106 |
| anti-influenza_Chain | 5144 | 22-41 | 53-62 | 91-110 |
| anti-influenza_Chain | 5145 | 22-41 | 49-58 | 87-106 |
| anti-influenza_Chain | 5146 | 22-41 | 50-59 | 88-107 |
| anti-influenza_Chain | 5147 | 22-41 | | 87-106 |
| anti-influenza_Chain | 5148 | 22-41 | 49-58 | 87-106 |
| anti-influenza_Chain | 5149 | 22-41 | 50-59 | 88-107 |
| anti-influenza_Chain | 5150 | 22-41 | 49-58 | 87-106 |
| anti-influenza_Chain | 5151 | 22-41 | 49-58 | 87-106 |
| anti-influenza_Chain | 5152 | 22-41 | 145-154 | |
| anti-influenza_Chain | 5153 | 22-41 | | |
| anti-influenza_Chain | 5154 | 22-41 | | |
| anti-influenza_Chain | 5155 | 22-41 | | 106-125 |
| anti-influenza_Chain | 5156 | 22-41 | 68-77 | |
| anti-influenza_Chain | 5157 | 22-41 | 105-114 | |
| anti-influenza_Chain | 5158 | 22-41 | 69-78 | 107-126 |
| anti-influenza_Chain | 5159 | 22-41 | 69-78 | 107-126 |
| anti-influenza_Chain | 5160 | 22-41 | 68-77 | |
| anti-influenza_Chain | 5161 | 22-41 | | |
| anti-influenza_Chain | 5162 | 22-41 | 183-192 | 94-113 |
| anti-influenza_Chain | 5163 | 22-41 | 184-193 | 94-113 |
| anti-influenza_Chain | 5164 | 22-41 | | |
| anti-influenza_Chain | 5165 | 22-41 | 184-193 | 222-241 |
| anti-influenza_Chain | 5166 | 22-41 | 185-194 | 94-113 |
| anti-influenza_Chain | 5167 | 22-41 | | 94-113 |
| anti-influenza_Chain | 5168 | 22-41 | 185-194 | 94-113 |
| anti-influenza_Chain | 5169 | 22-41 | | 94-113 |
| anti-influenza_Chain | 5170 | 22-41 | | 94-113 |
| anti-influenza_Chain | 5171 | 22-41 | | 94-113 |
| anti-influenza_Chain | 5172 | 22-41 | 58-67 | 94-113 |
| anti-influenza_Chain | 5173 | 22-41 | | 94-113 |
| anti-influenza_Chain | 5174 | 22-41 | 186-195 | 94-113 |
| anti-influenza_Chain | 5175 | 22-41 | 31-40 | 94-113 |
| anti-influenza_Chain | 5176 | 22-41 | | 222-241 |
| anti-influenza_Chain | 5177 | 22-41 | 186-195 | 94-113 |
| anti-influenza_Chain | 5178 | 22-41 | | 94-113 |
| anti-influenza_Chain | 5179 | 22-41 | 186-195 | 94-113 |
| anti-influenza_Chain | 5180 | 22-41 | 186-195 | 94-113 |
| anti-influenza_Chain | 5181 | 22-41 | 187-196 | 94-113 |
| anti-influenza_Chain | 5182 | 22-41 | | 94-113 |
| anti-influenza_Chain | 5183 | 22-41 | 186-195 | 94-113 |
| anti-influenza_Chain | 5184 | 22-41 | 103-112 | 94-113 |
| anti-influenza_Chain | 5185 | 22-41 | | |
| anti-influenza_Chain | 5186 | 22-41 | 186-195 | 94-113 |
| anti-influenza_Chain | 5187 | 22-41 | 188-197 | 94-113 |
| anti-influenza_Chain | 5188 | 22-41 | | 94-113 |
| anti-influenza_Chain | 5189 | 22-41 | 196-205 | 92-111 |
| anti-influenza_Chain | 5190 | 22-41 | 196-205 | 92-111 |
| anti-influenza_Chain | 5191 | 22-41 | | |
| anti-influenza_Chain | 5192 | 22-41 | | |

TABLE 5-continued

CDRs of exemplified antibodies

| Name | Protein SEQ ID NO | CDR1 | CDR2 | CDR3 |
|---|---|---|---|---|
| anti-influenza_Chain | 5193 | 22-41 | | |
| anti-influenza_Chain | 5194 | 22-41 | | |
| anti-influenza_Chain | 5195 | 22-41 | 48-57 | 223-242 |
| anti-influenza_Chain | 5196 | 22-41 | 48-57 | 223-242 |
| anti-influenza_Chain | 5197 | 22-41 | | |
| anti-influenza_Chain | 5198 | 22-41 | | |
| anti-influenza_Chain | 5199 | 22-41 | 118-127 | |
| anti-influenza_Chain | 5200 | 22-41 | 118-127 | |
| anti-influenza_Chain | 5201 | 22-41 | | |
| anti-influenza_Chain | 5202 | 22-41 | | |
| anti-influenza_Chain | 5203 | 22-41 | | |
| anti-influenza_Chain | 5204 | 22-41 | | |
| anti-influenza_Chain | 5205 | 22-41 | | |
| anti-influenza_Chain | 5206 | 22-41 | | |
| anti-influenza_Chain | 5207 | 22-41 | 298-307 | |
| anti-influenza_Chain | 5208 | 22-41 | 298-307 | |
| anti-influenza_Chain | 5209 | 22-41 | | |
| anti-influenza_Chain | 5210 | 22-41 | | |
| anti-influenza_Chain | 5211 | 22-41 | | |
| anti-influenza_Chain | 5212 | 22-41 | | |
| anti-influenza_Chain | 5213 | 22-41 | | |
| anti-influenza_Chain | 5214 | 22-41 | | |
| anti-influenza_Chain | 5215 | 22-41 | 189-198 | |
| anti-influenza_Chain | 5216 | 22-41 | 189-198 | |
| anti-influenza_Chain | 5217 | 22-41 | | |
| anti-influenza_Chain | 5218 | 22-41 | | |
| anti-influenza_Chain | 5219 | 22-41 | | |
| anti-influenza_Chain | 5220 | 22-41 | | |
| anti-influenza_Chain | 5221 | 22-41 | 240-249 | |
| anti-influenza_Chain | 5222 | 22-41 | 51-60 | 94-113 |
| anti-influenza_Chain | 5223 | 22-41 | 51-60 | 94-113 |
| anti-influenza_Chain | 5224 | 22-41 | 240-249 | |
| anti-influenza_Chain | 5225 | 22-41 | 267-276 | |
| anti-influenza_Chain | 5226 | 22-41 | 267-276 | |
| anti-influenza_Chain | 5227 | 22-41 | | |
| anti-influenza_Chain | 5228 | 22-41 | | |
| anti-influenza_Chain | 5229 | 22-41 | | |
| anti-influenza_Chain | 5230 | 22-41 | | |
| anti-influenza_Chain | 5231 | 22-41 | | |
| anti-influenza_Chain | 5232 | 22-41 | | |
| anti-influenza_Chain | 5233 | 22-41 | | |
| anti-influenza_Chain | 5234 | 22-41 | | |
| anti-influenza_Chain | 5235 | 22-41 | | |
| anti-influenza_Chain | 5236 | 22-41 | | |
| anti-influenza_Chain | 5237 | 22-41 | 204-213 | |
| anti-influenza_Chain | 5238 | 22-41 | 204-213 | |
| anti-influenza_Chain | 5239 | 22-41 | | 96-115 |
| anti-influenza_Chain | 5240 | 22-41 | | 96-115 |
| anti-influenza_Chain | 5241 | 22-41 | | 94-113 |
| anti-influenza_Chain | 5242 | 22-41 | | 94-113 |
| anti-influenza_Chain | 5243 | 22-41 | | |
| anti-influenza_Chain | 5244 | 22-41 | | |
| anti-influenza_Chain | 5245 | 22-41 | | 95-114 |
| anti-influenza_Chain | 5246 | 22-41 | | 95-114 |
| anti-influenza_Chain | 5247 | 22-41 | | 94-113 |
| anti-influenza_Chain | 5248 | 22-41 | | |
| anti-influenza_Chain | 5249 | 22-41 | | 94-113 |
| anti-influenza_Chain | 5250 | 22-41 | | 94-113 |
| anti-influenza_Chain | 5251 | 22-41 | | 94-113 |
| anti-influenza_Chain | 5252 | 22-41 | | 94-113 |
| anti-influenza_Chain | 5253 | 22-41 | | 94-113 |
| anti-influenza_Chain | 5254 | 22-41 | | 94-113 |
| anti-influenza_Chain | 5255 | 22-41 | | 94-113 |
| anti-influenza_Chain | 5256 | 22-41 | | 94-113 |
| anti-influenza_Chain | 5257 | 22-41 | | 94-113 |
| anti-influenza_Chain | 5258 | 22-41 | | |
| anti-influenza_Chain | 5259 | 22-41 | | 94-113 |
| anti-influenza_Chain | 5260 | 22-41 | | 94-113 |
| anti-influenza_Chain | 5261 | 22-41 | | 94-113 |
| anti-influenza_Chain | 5262 | 22-41 | | 94-113 |
| anti-influenza_Chain | 5263 | 22-41 | | 94-113 |
| anti-influenza_Chain | 5264 | 22-41 | 103-112 | 94-113 |
| anti-influenza_Chain | 5265 | 22-41 | | 94-113 |
| anti-influenza_Chain | 5266 | 22-41 | | 94-113 |
| anti-influenza_Chain | 5267 | 22-41 | 103-112 | 94-113 |
| anti-influenza_Chain | 5268 | 22-41 | 58-67 | 94-113 |

TABLE 5-continued

CDRs of exemplified antibodies

| Name | Protein SEQ ID NO | CDR1 | CDR2 | CDR3 |
|---|---|---|---|---|
| anti-influenza_Chain | 5269 | 22-41 | | 94-113 |
| anti-influenza_Chain | 5270 | 22-41 | 93-102 | 94-113 |
| anti-influenza_Chain | 5271 | 22-41 | | 94-113 |
| anti-influenza_Chain | 5272 | 22-41 | 58-67 | 94-113 |
| anti-influenza_Chain | 5273 | 22-41 | 93-102 | 94-113 |
| anti-influenza_Chain | 5274 | 22-41 | | 94-113 |
| anti-influenza_Chain | 5275 | 22-41 | 93-102 | 94-113 |
| anti-influenza_Chain | 5276 | 22-41 | 93-102 | 94-113 |
| anti-influenza_Chain | 5277 | 22-41 | 59-68 | 94-113 |
| anti-influenza_Chain | 5278 | 22-41 | 59-68 | 94-113 |
| anti-influenza_Chain | 5279 | 22-41 | 59-68 | 94-113 |
| anti-influenza_Chain | 5280 | 22-41 | 59-68 | 94-113 |
| anti-influenza_Chain | 5281 | 22-41 | 59-68 | 94-113 |
| anti-influenza_Chain | 5282 | 22-41 | 59-68 | 94-113 |
| anti-influenza_Chain | 5283 | 22-41 | 59-68 | 94-113 |
| anti-influenza_Chain | 5284 | 22-41 | 59-68 | 94-113 |
| anti-influenza_Chain | 5285 | 22-41 | 59-68 | 94-113 |
| anti-influenza_Chain | 5286 | 22-41 | | 94-113 |
| anti-influenza_Chain | 5287 | 22-41 | 93-102 | 94-113 |
| anti-influenza_Chain | 5288 | 22-41 | 93-102 | 94-113 |
| anti-influenza_Chain | 5289 | 22-41 | 59-68 | 94-113 |
| anti-influenza_Chain | 5290 | 22-41 | 59-68 | 94-113 |
| anti-influenza_Chain | 5291 | 22-41 | 59-68 | 94-113 |
| anti-influenza_Chain | 5292 | 22-41 | 59-68 | 94-113 |
| anti-influenza_Chain | 5293 | 22-41 | 59-68 | 94-113 |
| anti-influenza_Chain | 5294 | 22-41 | 59-68 | 94-113 |
| anti-influenza_Chain | 5295 | 22-41 | 59-68 | 94-113 |
| anti-influenza_Chain | 5296 | 22-41 | 59-68 | 94-113 |
| anti-influenza_Chain | 5297 | 22-41 | 59-68 | 94-113 |
| anti-influenza_Chain | 5298 | 22-41 | 51-60 | 94-113 |
| anti-influenza_Chain | 5299 | 22-41 | 51-60 | 94-113 |
| anti-influenza_Chain | 5300 | 22-41 | | 94-113 |
| anti-influenza_Chain | 5301 | 22-41 | | 94-113 |
| anti-influenza_Chain | 5302 | 22-41 | | 94-113 |
| anti-influenza_Chain | 5303 | 22-41 | | 94-113 |
| anti-influenza_Chain | 5304 | 22-41 | | |
| anti-influenza_Chain | 5305 | 22-41 | 51-60 | 94-113 |
| anti-influenza_Chain | 5306 | 22-41 | 51-60 | 94-113 |
| anti-influenza_Chain | 5307 | 22-41 | | 94-113 |
| anti-influenza_Chain | 5308 | 22-41 | | 94-113 |
| anti-influenza_Chain | 5309 | 22-41 | | 94-113 |
| anti-influenza_Chain | 5310 | 22-41 | | 94-113 |
| anti-influenza_Chain | 5311 | 22-41 | | |
| anti-influenza_Chain | 5312 | 22-41 | | 94-113 |
| anti-influenza_Chain | 5313 | 22-41 | | |
| anti-influenza_Chain | 5314 | 22-41 | | |
| anti-influenza_Chain | 5315 | 22-41 | | 115-134 |
| anti-influenza_Chain | 5316 | 22-41 | | 115-134 |
| anti-influenza_Chain | 5317 | 22-41 | | 113-132 |
| anti-influenza_Chain | 5318 | 22-41 | | |
| anti-influenza_Chain | 5319 | 22-41 | | |
| anti-influenza_Chain | 5320 | 22-41 | | 113-132 |
| anti-influenza_Chain | 5321 | 22-41 | 445-454 | |
| anti-influenza_Chain | 5322 | 22-41 | 445-454 | |
| anti-influenza_Chain | 5323 | 22-41 | | |
| anti-influenza_Chain | 5324 | 22-41 | | |
| anti-influenza_Chain | 5325 | 22-41 | | |
| anti-influenza_Chain | 5326 | 22-41 | | |
| anti-influenza_Chain | 5327 | 22-41 | | |
| anti-influenza_Chain | 5328 | 22-41 | | 113-132 |
| anti-influenza_Chain | 5329 | 22-41 | | 113-132 |
| anti-influenza_Chain | 5330 | 22-41 | | 113-132 |
| anti-influenza_Chain | 5331 | 22-41 | | |
| anti-influenza_Chain | 5332 | 22-41 | | |
| anti-influenza_Chain | 5333 | 22-41 | | |
| anti-influenza_Chain | 5334 | 22-41 | | |
| anti-influenza_Chain | 5335 | 22-41 | | 113-132 |
| anti-influenza_Chain | 5336 | 22-41 | | 113-132 |
| anti-influenza_Chain | 5337 | 22-41 | | 113-132 |
| anti-influenza_Chain | 5338 | 22-41 | | |
| anti-influenza_Chain | 5339 | 22-41 | | |
| anti-influenza_Chain | 5340 | 22-41 | 263-272 | |
| anti-influenza_Chain | 5341 | 22-41 | 263-272 | |
| anti-influenza_Chain | 5342 | 22-41 | | |
| anti-influenza_Chain | 5343 | 22-41 | | |
| anti-influenza_Chain | 5344 | 22-41 | 264-273 | |

TABLE 5-continued

CDRs of exemplified antibodies

| Name | Protein SEQ ID NO | CDR1 | CDR2 | CDR3 |
|---|---|---|---|---|
| anti-influenza_Chain | 5345 | 22-41 | 264-273 | |
| anti-influenza_Chain | 5346 | 22-41 | 96-105 | |
| anti-influenza_Chain | 5347 | 22-41 | 96-105 | |
| anti-influenza_Chain | 5348 | 22-41 | 96-105 | |
| anti-influenza_Chain | 5349 | 22-41 | 96-105 | |
| anti-influenza_Chain | 5350 | 22-41 | 96-105 | |
| anti-influenza_Chain | 5351 | 22-41 | 96-105 | |
| anti-influenza_Chain | 5352 | 22-41 | 275-284 | |
| anti-influenza_Chain | 5353 | 22-41 | 275-284 | |
| anti-influenza_Chain | 5354 | 22-41 | 34-43 | |
| anti-influenza_Chain | 5355 | 22-41 | 34-43 | |
| anti-influenza_Chain | 5356 | 22-41 | | |
| anti-influenza_Chain | 5357 | 22-41 | | |
| anti-influenza_Chain | 5358 | 22-41 | 509-518 | |
| anti-influenza_Chain | 5359 | 22-41 | 509-518 | |
| anti-influenza_Chain | 5360 | 22-41 | 509-518 | |
| anti-influenza_Chain | 5361 | 22-41 | 509-518 | |
| anti-influenza_Chain | 5362 | 22-41 | 509-518 | |
| anti-influenza_Chain | 5363 | 22-41 | 509-518 | |
| anti-influenza_Chain | 5364 | 22-41 | 509-518 | |
| anti-influenza_Chain | 5365 | 22-41 | 509-518 | |
| anti-influenza_Chain | 5366 | 22-41 | 513-522 | |
| anti-influenza_Chain | 5367 | 22-41 | 513-522 | |
| anti-influenza_Chain | 5368 | 22-41 | 513-522 | |
| anti-influenza_Chain | 5369 | 22-41 | 513-522 | |
| anti-influenza_Chain | 5370 | 22-41 | 232-241 | |
| anti-influenza_Chain | 5371 | 22-41 | 232-241 | |
| anti-influenza_Chain | 5372 | 22-41 | 209-218 | |
| anti-influenza_Chain | 5373 | 22-41 | | |
| anti-influenza_Chain | 5374 | 22-41 | | |
| anti-influenza_Chain | 5375 | 22-41 | 209-218 | |
| anti-influenza_Chain | 5376 | 22-41 | 517-526 | |
| anti-influenza_Chain | 5377 | 22-41 | 517-526 | |
| anti-influenza_Chain | 5378 | 22-41 | | |
| anti-influenza_Chain | 5379 | 22-41 | | |
| anti-influenza_Chain | 5380 | 22-41 | | |
| anti-influenza_Chain | 5381 | 22-41 | 519-528 | |
| anti-influenza_Chain | 5382 | 22-41 | 519-528 | |
| anti-influenza_Chain | 5383 | 22-41 | | |
| anti-influenza_Chain | 5384 | 22-41 | | |
| anti-influenza_Chain | 5385 | 22-41 | | |
| anti-influenza_Chain | 5386 | 22-41 | 519-528 | |
| anti-influenza_Chain | 5387 | 22-41 | 519-528 | |
| anti-influenza_Chain | 5388 | 22-41 | 164-173 | |
| anti-influenza_Chain | 5389 | 22-41 | | |
| anti-influenza_Chain | 5390 | 22-41 | | |
| anti-influenza_Chain | 5391 | 22-41 | 535-544 | |
| anti-influenza_Chain | 5392 | 22-41 | 164-173 | |
| anti-influenza_Chain | 5393 | 22-41 | | |
| anti-influenza_Chain | 5394 | 22-41 | | |
| anti-influenza_Chain | 5395 | 22-41 | 535-544 | |
| anti-influenza_Chain | 5396 | 22-41 | | |
| anti-influenza_Chain | 5397 | 22-41 | 14-23 | |
| anti-influenza_Chain | 5398 | 22-41 | | |
| anti-influenza_Chain | 5399 | 22-41 | 14-23 | |
| anti-influenza_Chain | 5400 | 22-41 | 525-534 | |
| anti-influenza_Chain | 5401 | 22-41 | 525-534 | |
| anti-influenza_Chain | 5402 | 22-41 | 531-540 | |
| anti-influenza_Chain | 5403 | 22-41 | 531-540 | |
| anti-influenza_Chain | 5404 | 22-41 | 529-538 | |
| anti-influenza_Chain | 5405 | 22-41 | 529-538 | |
| anti-influenza_Chain | 5406 | 22-41 | 529-538 | |
| anti-influenza_Chain | 5407 | 22-41 | 151-160 | |
| anti-influenza_Chain | 5408 | 22-41 | 532-541 | |
| anti-influenza_Chain | 5409 | 22-41 | 532-541 | |
| anti-influenza_Chain | 5410 | 22-41 | 532-541 | |
| anti-influenza_Chain | 5411 | 22-41 | 532-541 | |
| anti-influenza_Chain | 5412 | 22-41 | 532-541 | |
| anti-influenza_Chain | 5413 | 22-41 | 532-541 | |
| anti-influenza_Chain | 5414 | 22-41 | 61-70 | |
| anti-influenza_Chain | 5415 | 22-41 | 61-70 | |
| anti-influenza_Chain | 5416 | 22-41 | 151-160 | |
| anti-influenza_Chain | 5417 | 22-41 | 529-538 | |
| anti-influenza_Chain | 5418 | 22-41 | 529-538 | |
| anti-influenza_Chain | 5419 | 22-41 | 529-538 | |
| anti-influenza_Chain | 5420 | 22-41 | 532-541 | |

TABLE 5-continued

CDRs of exemplified antibodies

| Name | Protein SEQ ID NO | CDR1 | CDR2 | CDR3 |
|---|---|---|---|---|
| anti-influenza_Chain | 5421 | 22-41 | 532-541 | |
| anti-influenza_Chain | 5422 | 22-41 | 532-541 | |
| anti-influenza_Chain | 5423 | 22-41 | 532-541 | |
| anti-influenza_Chain | 5424 | 22-41 | 532-541 | |
| anti-influenza_Chain | 5425 | 22-41 | 532-541 | |
| anti-influenza_Chain | 5426 | 22-41 | 248-257 | |
| anti-influenza_Chain | 5427 | 22-41 | 248-257 | |
| anti-influenza_Chain | 5428 | 22-41 | 248-257 | |
| anti-influenza_Chain | 5429 | 22-41 | 248-257 | |
| anti-influenza_Chain | 5430 | 22-41 | 248-257 | |
| anti-influenza_Chain | 5431 | 22-41 | 248-257 | |
| anti-influenza_Chain | 5432 | 22-41 | 248-257 | |
| anti-influenza_Chain | 5433 | 22-41 | 533-542 | |
| anti-influenza_Chain | 5434 | 22-41 | 527-536 | |
| anti-influenza_Chain | 5435 | 22-41 | 527-536 | |
| anti-influenza_Chain | 5436 | 22-41 | 533-542 | |
| anti-influenza_Chain | 5437 | 22-41 | 248-257 | |
| anti-influenza_Chain | 5438 | 22-41 | 527-536 | |
| anti-influenza_Chain | 5439 | 22-41 | 527-536 | |
| anti-influenza_Chain | 5440 | 22-41 | 248-257 | |
| anti-influenza_Chain | 5441 | 22-41 | 248-257 | |
| anti-influenza_Chain | 5442 | 22-41 | 248-257 | |
| anti-influenza_Chain | 5443 | 22-41 | 248-257 | |
| anti-influenza_Chain | 5444 | 22-41 | 248-257 | |
| anti-influenza_Chain | 5445 | 22-41 | 248-257 | |
| anti-influenza_Chain | 5446 | 22-41 | 529-538 | |
| anti-influenza_Chain | 5447 | 22-41 | 529-538 | |
| anti-influenza_Chain | 5448 | 22-41 | 534-543 | |
| anti-influenza_Chain | 5449 | 22-41 | 534-543 | |
| anti-influenza_Chain | 5450 | 22-41 | | |
| anti-influenza_Chain | 5451 | 22-41 | 534-543 | |
| anti-influenza_Chain | 5452 | 22-41 | | |
| anti-influenza_Chain | 5453 | 22-41 | 529-538 | |
| anti-influenza_Chain | 5454 | 22-41 | 529-538 | |
| anti-influenza_Chain | 5455 | 22-41 | 534-543 | |
| anti-influenza_Chain | 5456 | 22-41 | 534-543 | |
| anti-influenza_Chain | 5457 | 22-41 | 534-543 | |
| anti-influenza_Chain | 5458 | 22-41 | 529-538 | |
| anti-influenza_Chain | 5459 | 22-41 | 535-544 | |
| anti-influenza_Chain | 5460 | 22-41 | 529-538 | |
| anti-influenza_Chain | 5461 | 22-41 | 529-538 | |
| anti-influenza_Chain | 5462 | 22-41 | 535-544 | |
| anti-influenza_Chain | 5463 | 22-41 | 529-538 | |
| anti-influenza_Chain | 5464 | 22-41 | | |
| anti-influenza_Chain | 5465 | 22-41 | | |
| anti-influenza_Chain | 5466 | 22-41 | | |
| anti-influenza_Chain | 5467 | 22-41 | 232-241 | |
| anti-influenza_Chain | 5468 | 22-41 | | |
| anti-influenza_Chain | 5469 | 22-41 | 232-241 | |
| anti-influenza_Chain | 5470 | 22-41 | | |
| anti-influenza_Chain | 5471 | 22-41 | 488-497 | |
| anti-influenza_Chain | 5472 | 22-41 | 190-199 | |
| anti-influenza_Chain | 5473 | 22-41 | | |
| anti-influenza_Chain | 5474 | 22-41 | 488-497 | |
| anti-influenza_Chain | 5475 | 22-41 | 190-199 | |
| anti-influenza_Chain | 5476 | 22-41 | 510-519 | |
| anti-influenza_Chain | 5477 | 22-41 | 61-70 | |
| anti-influenza_Chain | 5478 | 22-41 | 510-519 | |
| anti-influenza_Chain | 5479 | 22-41 | 61-70 | |
| anti-influenza_Chain | 5480 | 22-41 | | |
| anti-influenza_Chain | 5481 | 22-41 | | |
| anti-influenza_Chain | 5482 | 22-41 | | |
| anti-influenza_Chain | 5483 | 22-41 | | |
| anti-influenza_Chain | 5484 | 22-41 | | |
| anti-influenza_Chain | 5485 | 22-41 | | |
| anti-influenza_Chain | 5486 | 22-41 | 513-522 | |
| anti-influenza_Chain | 5487 | 22-41 | | |
| anti-influenza_Chain | 5488 | 22-41 | 190-199 | |
| anti-influenza_Chain | 5489 | 22-41 | 513-522 | |
| anti-influenza_Chain | 5490 | 22-41 | | |
| anti-influenza_Chain | 5491 | 22-41 | 190-199 | |
| anti-influenza_Chain | 5492 | 22-41 | | |
| anti-influenza_Chain | 5493 | 22-41 | | |
| anti-influenza_Chain | 5494 | 22-41 | | |
| anti-influenza_Chain | 5495 | 22-41 | | |
| anti-influenza_Chain | 5496 | 22-41 | 538-547 | |

TABLE 5-continued

CDRs of exemplified antibodies

| Name | Protein SEQ ID NO | CDR1 | CDR2 | CDR3 |
|---|---|---|---|---|
| anti-influenza_Chain | 5497 | 22-41 | 538-547 | |
| anti-influenza_Chain | 5498 | 22-41 | | |
| anti-influenza_Chain | 5499 | 22-41 | | |
| anti-influenza_Chain | 5500 | 22-41 | | |
| anti-influenza_Chain | 5501 | 22-41 | | |
| anti-influenza_Chain | 5502 | 22-41 | | |
| anti-influenza_Chain | 5503 | 22-41 | | |
| anti-influenza_Chain | 5504 | 22-41 | | |
| anti-influenza_Chain | 5505 | 22-41 | | |
| anti-influenza_Chain | 5506 | 22-41 | | |
| anti-influenza_Chain | 5507 | 22-41 | | |
| anti-influenza_Chain | 5508 | 22-41 | | |
| anti-influenza_Chain | 5509 | 22-41 | | |
| anti-influenza_Chain | 5510 | 22-41 | | |
| anti-influenza_Chain | 5511 | 22-41 | | |
| anti-influenza_Chain | 5512 | 22-41 | | |
| anti-influenza_Chain | 5513 | 22-41 | | |
| anti-influenza_Chain | 5514 | 22-41 | | |
| anti-influenza_Chain | 5515 | 22-41 | 565-574 | |
| anti-influenza_Chain | 5516 | 22-41 | | |
| anti-influenza_Chain | 5517 | 22-41 | 565-574 | |
| anti-influenza_Chain | 5518 | 22-41 | 108-117 | |
| anti-influenza_Chain | 5519 | 22-41 | 108-117 | |
| anti-influenza_Chain | 5520 | 22-41 | 5-14 | |
| anti-influenza_Chain | 5521 | 22-41 | 5-14 | |
| anti-influenza_Chain | 5522 | 22-41 | 116-125 | |
| anti-influenza_Chain | 5523 | 22-41 | 116-125 | |
| anti-influenza_Chain | 5524 | 22-41 | 129-138 | |
| anti-influenza_Chain | 5525 | 22-41 | 129-138 | |
| anti-influenza_Chain | 5526 | 22-41 | | |
| anti-influenza_Chain | 5527 | 22-41 | | |
| anti-influenza_Chain | 5528 | 22-41 | 178-187 | |
| anti-influenza_Chain | 5529 | 22-41 | 178-187 | |
| anti-influenza_Chain | 5530 | 22-41 | 114-123 | |
| anti-influenza_Chain | 5531 | 22-41 | 114-123 | |
| anti-influenza_Chain | 5532 | 22-41 | 184-193 | |
| anti-influenza_Chain | 5533 | 22-41 | 184-193 | |
| anti-influenza_Chain | 5534 | 22-41 | | |
| anti-influenza_Chain | 5535 | 22-41 | | |
| anti-influenza_Chain | 5536 | 22-41 | 554-563 | |
| anti-influenza_Chain | 5537 | 22-41 | 554-563 | |
| anti-influenza_Chain | 5538 | 22-41 | 206-215 | |
| anti-influenza_Chain | 5539 | 22-41 | 206-215 | |
| anti-OX40_LightChain | 5540 | 22-41 | 48-57 | 86-105 |
| anti-OX40_LightChain | 5541 | 22-41 | 48-57 | 86-105 |
| anti-OX40_LightChain | 5542 | 22-41 | 48-57 | 86-105 |
| anti-OX40_LightChain | 5543 | 22-41 | 48-57 | 86-105 |
| anti-OX40_LightChain | 5544 | 22-41 | 48-57 | |
| anti-OX40_LightChain | 5545 | 22-41 | 48-57 | 86-105 |
| anti-OX40_LightChain | 5546 | 22-41 | 48-57 | 86-105 |
| anti-OX40_LightChain | 5547 | 22-41 | 48-57 | 86-105 |
| anti-OX40_LightChain | 5548 | 22-41 | 48-57 | 86-105 |
| anti-OX40_LightChain | 5549 | 22-41 | 48-57 | 86-105 |
| anti-OX40_LightChain | 5550 | 22-41 | 48-57 | 86-105 |
| anti-OX40_LightChain | 5551 | 22-41 | 48-57 | 86-105 |
| anti-OX40_LightChain | 5552 | 22-41 | 48-57 | 86-105 |
| anti-OX40_LightChain | 5553 | 22-41 | 48-57 | 86-105 |
| anti-OX40_HeavyChain | 5554 | 22-41 | | 94-113 |
| anti-OX40_HeavyChain | 5555 | 22-41 | | 94-113 |
| anti-OX40_HeavyChain | 5556 | 22-41 | | 94-113 |
| anti-OX40_HeavyChain | 5557 | 22-41 | | 94-113 |
| anti-OX40_HeavyChain | 5558 | 22-41 | | 94-113 |
| anti-OX40_HeavyChain | 5559 | 22-41 | | 94-113 |
| anti-OX40_HeavyChain | 5560 | 22-41 | | 94-113 |
| anti-OX40_HeavyChain | 5561 | 22-41 | | 94-113 |
| anti-OX40_HeavyChain | 5562 | 22-41 | | 94-113 |
| anti-OX40_HeavyChain | 5563 | 22-41 | | 94-113 |
| anti-OX40_HeavyChain | 5564 | 22-41 | | 94-113 |
| anti-OX40_HeavyChain | 5565 | 22-41 | | 94-113 |
| anti-OX40_HeavyChain | 5566 | 22-41 | | 94-113 |
| anti-OX40_HeavyChain | 5567 | 22-41 | | 94-113 |
| anti-OX40_HeavyChain | 5568 | 22-41 | | 94-113 |
| anti-OX40_HeavyChain | 5569 | 22-41 | | 94-113 |
| anti-OX40_HeavyChain | 5570 | 22-41 | | 93-112 |
| anti-OX40_HeavyChain | 5571 | 22-41 | | 93-112 |
| anti-OX40_HeavyChain | 5572 | 22-41 | | |

TABLE 5-continued

CDRs of exemplified antibodies

| Name | Protein SEQ ID NO | CDR1 | CDR2 | CDR3 |
|---|---|---|---|---|
| anti-OX40_HeavyChain | 5573 | 22-41 | | |
| anti-OX40_HeavyChain | 5574 | 22-41 | | |
| anti-OX40_HeavyChain | 5575 | 22-41 | | 93-112 |
| anti-OX40_HeavyChain | 5576 | 22-41 | | 93-112 |
| anti-OX40_HeavyChain | 5577 | 22-41 | | |
| anti-OX40_HeavyChain | 5578 | 22-41 | | |
| anti-OX40_HeavyChain | 5579 | 22-41 | | 93-112 |
| anti-OX40_HeavyChain | 5580 | 22-41 | | 93-112 |
| anti-OX40_HeavyChain | 5581 | 22-41 | | 93-112 |
| anti-OX40_HeavyChain | 5582 | 22-41 | | 93-112 |
| anti-OX40_HeavyChain | 5583 | 22-41 | | 93-112 |
| anti-OX40_HeavyChain | 5584 | 22-41 | | 93-112 |
| anti-OX40_HeavyChain | 5585 | 22-41 | | 93-112 |
| anti-OX40_HeavyChain | 5586 | 22-41 | | |
| anti-OX40_HeavyChain | 5587 | 22-41 | | 93-112 |
| anti-OX40_HeavyChain | 5588 | 22-41 | | 94-113 |
| anti-OX40_LightChain | 5589 | 22-41 | 69-78 | 107-126 |
| anti-OX40_LightChain | 5590 | 22-41 | 68-77 | 106-125 |
| anti-OX40_LightChain | 5591 | 22-41 | 68-77 | 106-125 |
| anti-OX40_LightChain | 5592 | 22-41 | 69-78 | 107-126 |
| anti-OX40_LightChain | 5593 | 22-41 | 70-79 | 108-127 |
| anti-OX40_HeavyChain | 5594 | 22-41 | | 114-133 |
| anti-OX40_HeavyChain | 5595 | 22-41 | 72-81 | 114-133 |
| anti-OX40_HeavyChain | 5596 | 22-41 | 77-86 | 113-132 |
| anti-OX40_HeavyChain | 5597 | 22-41 | 72-81 | 114-133 |
| anti-OX40_HeavyChain | 5598 | 22-41 | | 129-148 |
| anti-OX40_LightChain | 5599 | 22-41 | 48-57 | 86-105 |
| anti-OX40_HeavyChain | 5600 | 22-41 | | 94-113 |

Accordingly, it is preferred that the at least one coding sequence encodes a complementarity determining region (CDR) of an antibody. Preferably, the CDR encoded by the at least one coding sequence comprises or consists of an amino acid sequence as described in Table 5 above.

It is also preferred that the CDR encoded by the at least one coding sequence comprises or consists of an amino acid sequence as described in Table 6 below (referred to as "protein SEQ ID NO"). Particularly preferably, the at least one coding sequence comprises or consists of a nucleic acid sequence (RNA sequence) as described in Table 6 below (referred to as "RNA SEQ ID NO").

TABLE 6

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_VRC01_VRC02_NIH45-46_LightChain_CDR | 5601 | 13243, 20885, 28527, 36169, 43811, 51453, 59095 |
| anti-HIV_VRC01_HeavyChain_CDR | 5602 | 13244, 20886, 28528, 36170, 43812, 51454, 59096 |
| anti-HIV_3BNC60_LightChain_CDR | 5603 | 13245, 20887, 28529, 36171, 43813, 51455, 59097 |
| anti-HIV_3BNC60_HeavyChain_CDR | 5604 | 13246, 20888, 28530, 36172, 43814, 51456, 59098 |
| anti-HIV_5H/I1-BMV-D5_HeavyChain_CDR | 5605 | 13247, 20889, 28531, 36173, 43815, 51457, 59099 |
| anti-HIV_8ANC195_LightChain_CDR | 5606 | 13248, 20890, 28532, 36174, 43816, 51458, 59100 |
| anti-HIV_CH01_CH02_CH03_LightChain_CDR | 5607 | 13249, 20891, 28533, 36175, 43817, 51459, 59101 |
| anti-HIV_CH01_HeavyChain_CDR | 5608 | 13250, 20892, 28534, 36176, 43818, 51460, 59102 |
| anti-HIV_CH02_HeavyChain_CDR | 5609 | 13251, 20893, 28535, 36177, 43819, 51461, 59103 |
| anti-HIV_CH03_HeavyChain_CDR | 5610 | 13252, 20894, 28536, 36178, 43820, 51462, 59104 |
| anti-HIV_CH04_LightChain_CDR | 5611 | 13253, 20895, 28537, 36179, 43821, 51463, 59105 |
| anti-HIV_CH04_HeavyChain_CDR | 5612 | 13254, 20896, 28538, 36180, 43822, 51464, 59106 |
| anti-HIV_NIH45-46_HeavyChain_CDR | 5613 | 13255, 20897, 28539, 36181, 43823, 51465, 59107 |
| anti-HIV_PG16_HeavyChain_CDR | 5614 | 13256, 20898, 28540, 36182, 43824, 51466, 59108 |
| anti-HIV_PGT122_LightChain_CDR | 5615 | 13257, 20899, 28541, 36183, 43825, 51467, 59109 |
| anti-HIV_PGT122_HeavyChain_CDR | 5616 | 13258, 20900, 28542, 36184, 43826, 51468, 59110 |
| anti-HIV_PGT123_LightChain_CDR | 5617 | 13259, 20901, 28543, 36185, 43827, 51469, 59111 |
| anti-HIV_PGT123_HeavyChain_CDR | 5618 | 13260, 20902, 28544, 36186, 43828, 51470, 59112 |
| anti-HIV_PGT125_PGT128_LightChain_CDR | 5619 | 13261, 20903, 28545, 36187, 43829, 51471, 59113 |
| anti-HIV_PGT125_HeavyChain_CDR | 5620 | 13262, 20904, 28546, 36188, 43830, 51472, 59114 |
| anti-HIV_PGT126_PGT127_LightChain_CDR | 5621 | 13263, 20905, 28547, 36189, 43831, 51473, 59115 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_PGT126_HeavyChain_CDR | 5622 | 13264, 20906, 28548, 36190, 43832, 51474, 59116 |
| anti-HIV_PGT127_HeavyChain_CDR | 5623 | 13265, 20907, 28549, 36191, 43833, 51475, 59117 |
| anti-HIV_PGT128_HeavyChain_CDR | 5624 | 13266, 20908, 28550, 36192, 43834, 51476, 59118 |
| anti-HIV_PGT130_LightChain_CDR | 5625 | 13267, 20909, 28551, 36193, 43835, 51477, 59119 |
| anti-HIV_PGT130_HeavyChain_CDR | 5626 | 13268, 20910, 28552, 36194, 43836, 51478, 59120 |
| anti-HIV_PGT131_LightChain_CDR | 5627 | 13269, 20911, 28553, 36195, 43837, 51479, 59121 |
| anti-HIV_PGT131_HeavyChain_CDR | 5628 | 13270, 20912, 28554, 36196, 43838, 51480, 59122 |
| anti-HIV_PGT135_PGT136_PGT137_LightChain_CDR | 5629 | 13271, 20913, 28555, 36197, 43839, 51481, 59123 |
| anti-HIV_PGT135_HeavyChain_CDR | 5630 | 13272, 20914, 28556, 36198, 43840, 51482, 59124 |
| anti-HIV_PGT136_HeavyChain_CDR | 5631 | 13273, 20915, 28557, 36199, 43841, 51483, 59125 |
| anti-HIV_PGT137_HeavyChain_CDR | 5632 | 13274, 20916, 28558, 36200, 43842, 51484, 59126 |
| anti-HIV_PGT141_PGT142_PGT143_PGT144_LightChain_CDR | 5633 | 13275, 20917, 28559, 36201, 43843, 51485, 59127 |
| anti-HIV_PGT141_HeavyChain_CDR | 5634 | 13276, 20918, 28560, 36202, 43844, 51486, 59128 |
| anti-HIV_PGT144_HeavyChain_CDR | 5635 | 13277, 20919, 28561, 36203, 43845, 51487, 59129 |
| anti-HIV_PGT145_LightChain_CDR | 5636 | 13278, 20920, 28562, 36204, 43846, 51488, 59130 |
| anti-HIV_PGT145_HeavyChain_CDR | 5637 | 13279, 20921, 28563, 36205, 43847, 51489, 59131 |
| anti-HIV_VRC-CH30_VRC-CH31_VRC-CH32_VRC-CH33_VRC-CH34_LightChain_CDR | 5638 | 13280, 20922, 28564, 36206, 43848, 51490, 59132 |
| anti-HIV_VRC-CH30_VRC-CH31_VRC-CH32_VRC-CH34_HeavyChain_CDR | 5639 | 13281, 20923, 28565, 36207, 43849, 51491, 59133 |
| anti-HIV_VRC-CH33_HeavyChain_CDR | 5640 | 13282, 20924, 28566, 36208, 43850, 51492, 59134 |
| anti-HIV_VRC-PG04_LightChain_CDR | 5641 | 13283, 20925, 28567, 36209, 43851, 51493, 59135 |
| anti-HIV_VRC-PG04_HeavyChain_CDR | 5642 | 13284, 20926, 28568, 36210, 43852, 51494, 59136 |
| anti-HIV_VRC-PG04b_LightChain_CDR | 5643 | 13285, 20927, 28569, 36211, 43853, 51495, 59137 |
| anti-HIV_VRC-PG04b_HeavyChain_CDR | 5644 | 13286, 20928, 28570, 36212, 43854, 51496, 59138 |
| anti-HIV_VRC03_LightChain_CDR | 5645 | 13287, 20929, 28571, 36213, 43855, 51497, 59139 |
| anti-HIV_VRC03_HeavyChain_CDR | 5646 | 13288, 20930, 28572, 36214, 43856, 51498, 59140 |
| anti-HIV_1TJG_P-Chain | 5647 | 13289, 20931, 28573, 36215, 43857, 51499, 59141 |
| anti-HIV_2B1H_P-Chain | 5648 | 13290, 20932, 28574, 36216, 43858, 51500, 59142 |
| anti-HIV_2B1A_P-Chain | 5649 | 13291, 20933, 28575, 36217, 43859, 51501, 59143 |
| anti-HIV_2B0S_P-Chain | 5650 | 13292, 20934, 28576, 36218, 43860, 51502, 59144 |
| anti-HIV_3UJJ_P-Chain | 5651 | 13293, 20935, 28577, 36219, 43861, 51503, 59145 |
| anti-HIV_3UJI_P-Chain | 5652 | 13294, 20936, 28578, 36220, 43862, 51504, 59146 |
| anti-HIV_3MLZ_P-Chain | 5653 | 13295, 20937, 28579, 36221, 43863, 51505, 59147 |
| anti-HIV_3MLV_Q-Chain | 5654 | 13296, 20938, 28580, 36222, 43864, 51506, 59148 |
| anti-HIV_3MLU_P-Chain | 5655 | 13297, 20939, 28581, 36223, 43865, 51507, 59149 |
| anti-HIV_3MLR_P-Chain | 5656 | 13298, 20940, 28582, 36224, 43866, 51508, 59150 |
| anti-HIV_4XCF_P-Chain | 5657 | 13299, 20941, 28583, 36225, 43867, 51509, 59151 |
| anti-HIV_4XBE_P-Chain | 5658 | 13300, 20942, 28584, 36226, 43868, 51510, 59152 |
| anti-HIV_4XAW_P-Chain | 5659 | 13301, 20943, 28585, 36227, 43869, 51511, 59153 |
| anti-HIV_2QSC_P-Chain | 5660 | 13302, 20944, 28586, 36228, 43870, 51512, 59154 |
| anti-HIV_3MLS_S-Chain | 5661 | 13303, 20945, 28587, 36229, 43871, 51513, 59155 |
| anti-HIV_3G01_P-Chain | 5662 | 13304, 20946, 28588, 36230, 43872, 51514, 59156 |
| anti-HIV_4MID_Q-Chain | 5663 | 13305, 20947, 28589, 36231, 43873, 51515, 59157 |
| anti-HIV_3C2A_Q-Chain | 5664 | 13306, 20948, 28590, 36232, 43874, 51516, 59158 |
| anti-HIV_CDR | 5665 | 13307, 20949, 28591, 36233, 43875, 51517, 59159 |
| anti-HIV_CDR | 5666 | 13308, 20950, 28592, 36234, 43876, 51518, 59160 |
| anti-HIV_CDR | 5667 | 13309, 20951, 28593, 36235, 43877, 51519, 59161 |
| anti-HIV_CDR | 5668 | 13310, 20952, 28594, 36236, 43878, 51520, 59162 |
| anti-HIV_CDR | 5669 | 13311, 20953, 28595, 36237, 43879, 51521, 59163 |
| anti-HIV_CDR | 5670 | 13312, 20954, 28596, 36238, 43880, 51522, 59164 |
| anti-HIV_CDR | 5671 | 13313, 20955, 28597, 36239, 43881, 51523, 59165 |
| anti-HIV_CDR | 5672 | 13314, 20956, 28598, 36240, 43882, 51524, 59166 |
| anti-HIV_CDR | 5673 | 13315, 20957, 28599, 36241, 43883, 51525, 59167 |
| anti-HIV_CDR | 5674 | 13316, 20958, 28600, 36242, 43884, 51526, 59168 |
| anti-HIV_CDR | 5675 | 13317, 20959, 28601, 36243, 43885, 51527, 59169 |
| anti-HIV_CDR | 5676 | 13318, 20960, 28602, 36244, 43886, 51528, 59170 |
| anti-HIV_CDR | 5677 | 13319, 20961, 28603, 36245, 43887, 51529, 59171 |
| anti-HIV_CDR | 5678 | 13320, 20962, 28604, 36246, 43888, 51530, 59172 |
| anti-HIV_CDR | 5679 | 13321, 20963, 28605, 36247, 43889, 51531, 59173 |
| anti-HIV_CDR | 5680 | 13322, 20964, 28606, 36248, 43890, 51532, 59174 |
| anti-HIV_CDR | 5681 | 13323, 20965, 28607, 36249, 43891, 51533, 59175 |
| anti-HIV_CDR | 5682 | 13324, 20966, 28608, 36250, 43892, 51534, 59176 |
| anti-HIV_CDR | 5683 | 13325, 20967, 28609, 36251, 43893, 51535, 59177 |
| anti-HIV_CDR | 5684 | 13326, 20968, 28610, 36252, 43894, 51536, 59178 |
| anti-HIV_CDR | 5685 | 13327, 20969, 28611, 36253, 43895, 51537, 59179 |
| anti-HIV_CDR | 5686 | 13328, 20970, 28612, 36254, 43896, 51538, 59180 |
| anti-HIV_CDR | 5687 | 13329, 20971, 28613, 36255, 43897, 51539, 59181 |
| anti-HIV_CDR | 5688 | 13330, 20972, 28614, 36256, 43898, 51540, 59182 |
| anti-HIV_CDR | 5689 | 13331, 20973, 28615, 36257, 43899, 51541, 59183 |
| anti-HIV_CDR | 5690 | 13332, 20974, 28616, 36258, 43900, 51542, 59184 |
| anti-HIV_CDR | 5691 | 13333, 20975, 28617, 36259, 43901, 51543, 59185 |
| anti-HIV_CDR | 5692 | 13334, 20976, 28618, 36260, 43902, 51544, 59186 |
| anti-HIV_CDR | 5693 | 13335, 20977, 28619, 36261, 43903, 51545, 59187 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_CDR | 5694 | 13336, 20978, 28620, 36262, 43904, 51546, 59188 |
| anti-HIV_CDR | 5695 | 13337, 20979, 28621, 36263, 43905, 51547, 59189 |
| anti-HIV_CDR | 5696 | 13338, 20980, 28622, 36264, 43906, 51548, 59190 |
| anti-HIV_CDR | 5697 | 13339, 20981, 28623, 36265, 43907, 51549, 59191 |
| anti-HIV_CDR | 5698 | 13340, 20982, 28624, 36266, 43908, 51550, 59192 |
| anti-HIV_CDR | 5699 | 13341, 20983, 28625, 36267, 43909, 51551, 59193 |
| anti-HIV_CDR | 5700 | 13342, 20984, 28626, 36268, 43910, 51552, 59194 |
| anti-HIV_CDR | 5701 | 13343, 20985, 28627, 36269, 43911, 51553, 59195 |
| anti-HIV_CDR | 5702 | 13344, 20986, 28628, 36270, 43912, 51554, 59196 |
| anti-HIV_CDR | 5703 | 13345, 20987, 28629, 36271, 43913, 51555, 59197 |
| anti-HIV_CDR | 5704 | 13346, 20988, 28630, 36272, 43914, 51556, 59198 |
| anti-HIV_CDR | 5705 | 13347, 20989, 28631, 36273, 43915, 51557, 59199 |
| anti-HIV_CDR | 5706 | 13348, 20990, 28632, 36274, 43916, 51558, 59200 |
| anti-HIV_CDR | 5707 | 13349, 20991, 28633, 36275, 43917, 51559, 59201 |
| anti-HIV_CDR | 5708 | 13350, 20992, 28634, 36276, 43918, 51560, 59202 |
| anti-HIV_CDR | 5709 | 13351, 20993, 28635, 36277, 43919, 51561, 59203 |
| anti-HIV_CDR | 5710 | 13352, 20994, 28636, 36278, 43920, 51562, 59204 |
| anti-HIV_CDR | 5711 | 13353, 20995, 28637, 36279, 43921, 51563, 59205 |
| anti-HIV_CDR | 5712 | 13354, 20996, 28638, 36280, 43922, 51564, 59206 |
| anti-HIV_CDR | 5713 | 13355, 20997, 28639, 36281, 43923, 51565, 59207 |
| anti-HIV_CDR | 5714 | 13356, 20998, 28640, 36282, 43924, 51566, 59208 |
| anti-HIV_CDR | 5715 | 13357, 20999, 28641, 36283, 43925, 51567, 59209 |
| anti-HIV_CDR | 5716 | 13358, 21000, 28642, 36284, 43926, 51568, 59210 |
| anti-HIV_CDR | 5717 | 13359, 21001, 28643, 36285, 43927, 51569, 59211 |
| anti-HIV_CDR | 5718 | 13360, 21002, 28644, 36286, 43928, 51570, 59212 |
| anti-HIV_CDR | 5719 | 13361, 21003, 28645, 36287, 43929, 51571, 59213 |
| anti-HIV_CDR | 5720 | 13362, 21004, 28646, 36288, 43930, 51572, 59214 |
| anti-HIV_CDR | 5721 | 13363, 21005, 28647, 36289, 43931, 51573, 59215 |
| anti-HIV_CDR | 5722 | 13364, 21006, 28648, 36290, 43932, 51574, 59216 |
| anti-HIV_CDR | 5723 | 13365, 21007, 28649, 36291, 43933, 51575, 59217 |
| anti-HIV_CDR | 5724 | 13366, 21008, 28650, 36292, 43934, 51576, 59218 |
| anti-HIV_CDR | 5725 | 13367, 21009, 28651, 36293, 43935, 51577, 59219 |
| anti-HIV_CDR | 5726 | 13368, 21010, 28652, 36294, 43936, 51578, 59220 |
| anti-HIV_CDR | 5727 | 13369, 21011, 28653, 36295, 43937, 51579, 59221 |
| anti-HIV_CDR | 5728 | 13370, 21012, 28654, 36296, 43938, 51580, 59222 |
| anti-HIV_CDR | 5729 | 13371, 21013, 28655, 36297, 43939, 51581, 59223 |
| anti-HIV_CDR | 5730 | 13372, 21014, 28656, 36298, 43940, 51582, 59224 |
| anti-HIV_CDR | 5731 | 13373, 21015, 28657, 36299, 43941, 51583, 59225 |
| anti-HIV_CDR | 5732 | 13374, 21016, 28658, 36300, 43942, 51584, 59226 |
| anti-HIV_CDR | 5733 | 13375, 21017, 28659, 36301, 43943, 51585, 59227 |
| anti-HIV_CDR | 5734 | 13376, 21018, 28660, 36302, 43944, 51586, 59228 |
| anti-HIV_CDR | 5735 | 13377, 21019, 28661, 36303, 43945, 51587, 59229 |
| anti-HIV_CDR | 5736 | 13378, 21020, 28662, 36304, 43946, 51588, 59230 |
| anti-HIV_CDR | 5737 | 13379, 21021, 28663, 36305, 43947, 51589, 59231 |
| anti-HIV_CDR | 5738 | 13380, 21022, 28664, 36306, 43948, 51590, 59232 |
| anti-HIV_CDR | 5739 | 13381, 21023, 28665, 36307, 43949, 51591, 59233 |
| anti-HIV_CDR | 5740 | 13382, 21024, 28666, 36308, 43950, 51592, 59234 |
| anti-HIV_CDR | 5741 | 13383, 21025, 28667, 36309, 43951, 51593, 59235 |
| anti-HIV_CDR | 5742 | 13384, 21026, 28668, 36310, 43952, 51594, 59236 |
| anti-HIV_CDR | 5743 | 13385, 21027, 28669, 36311, 43953, 51595, 59237 |
| anti-HIV_CDR | 5744 | 13386, 21028, 28670, 36312, 43954, 51596, 59238 |
| anti-HIV_CDR | 5745 | 13387, 21029, 28671, 36313, 43955, 51597, 59239 |
| anti-HIV_CDR | 5746 | 13388, 21030, 28672, 36314, 43956, 51598, 59240 |
| anti-HIV_CDR | 5747 | 13389, 21031, 28673, 36315, 43957, 51599, 59241 |
| anti-HIV_CDR | 5748 | 13390, 21032, 28674, 36316, 43958, 51600, 59242 |
| anti-HIV_CDR | 5749 | 13391, 21033, 28675, 36317, 43959, 51601, 59243 |
| anti-HIV_CDR | 5750 | 13392, 21034, 28676, 36318, 43960, 51602, 59244 |
| anti-HIV_CDR | 5751 | 13393, 21035, 28677, 36319, 43961, 51603, 59245 |
| anti-HIV_CDR | 5752 | 13394, 21036, 28678, 36320, 43962, 51604, 59246 |
| anti-HIV_CDR | 5753 | 13395, 21037, 28679, 36321, 43963, 51605, 59247 |
| anti-HIV_CDR | 5754 | 13396, 21038, 28680, 36322, 43964, 51606, 59248 |
| anti-HIV_CDR | 5755 | 13397, 21039, 28681, 36323, 43965, 51607, 59249 |
| anti-HIV_CDR | 5756 | 13398, 21040, 28682, 36324, 43966, 51608, 59250 |
| anti-HIV_CDR | 5757 | 13399, 21041, 28683, 36325, 43967, 51609, 59251 |
| anti-HIV_CDR | 5758 | 13400, 21042, 28684, 36326, 43968, 51610, 59252 |
| anti-HIV_CDR | 5759 | 13401, 21043, 28685, 36327, 43969, 51611, 59253 |
| anti-HIV_CDR | 5760 | 13402, 21044, 28686, 36328, 43970, 51612, 59254 |
| anti-HIV_CDR | 5761 | 13403, 21045, 28687, 36329, 43971, 51613, 59255 |
| anti-HIV_CDR | 5762 | 13404, 21046, 28688, 36330, 43972, 51614, 59256 |
| anti-HIV_CDR | 5763 | 13405, 21047, 28689, 36331, 43973, 51615, 59257 |
| anti-HIV_CDR | 5764 | 13406, 21048, 28690, 36332, 43974, 51616, 59258 |
| anti-HIV_CDR | 5765 | 13407, 21049, 28691, 36333, 43975, 51617, 59259 |
| anti-HIV_CDR | 5766 | 13408, 21050, 28692, 36334, 43976, 51618, 59260 |
| anti-HIV_CDR | 5767 | 13409, 21051, 28693, 36335, 43977, 51619, 59261 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_CDR | 5768 | 13410, 21052, 28694, 36336, 43978, 51620, 59262 |
| anti-HIV_CDR | 5769 | 13411, 21053, 28695, 36337, 43979, 51621, 59263 |
| anti-HIV_CDR | 5770 | 13412, 21054, 28696, 36338, 43980, 51622, 59264 |
| anti-HIV_CDR | 5771 | 13413, 21055, 28697, 36339, 43981, 51623, 59265 |
| anti-HIV_CDR | 5772 | 13414, 21056, 28698, 36340, 43982, 51624, 59266 |
| anti-HIV_CDR | 5773 | 13415, 21057, 28699, 36341, 43983, 51625, 59267 |
| anti-HIV_CDR | 5774 | 13416, 21058, 28700, 36342, 43984, 51626, 59268 |
| anti-HIV_CDR | 5775 | 13417, 21059, 28701, 36343, 43985, 51627, 59269 |
| anti-HIV_CDR | 5776 | 13418, 21060, 28702, 36344, 43986, 51628, 59270 |
| anti-HIV_CDR | 5777 | 13419, 21061, 28703, 36345, 43987, 51629, 59271 |
| anti-HIV_CDR | 5778 | 13420, 21062, 28704, 36346, 43988, 51630, 59272 |
| anti-HIV_CDR | 5779 | 13421, 21063, 28705, 36347, 43989, 51631, 59273 |
| anti-HIV_CDR | 5780 | 13422, 21064, 28706, 36348, 43990, 51632, 59274 |
| anti-HIV_CDR | 5781 | 13423, 21065, 28707, 36349, 43991, 51633, 59275 |
| anti-HIV_CDR | 5782 | 13424, 21066, 28708, 36350, 43992, 51634, 59276 |
| anti-HIV_CDR | 5783 | 13425, 21067, 28709, 36351, 43993, 51635, 59277 |
| anti-HIV_CDR | 5784 | 13426, 21068, 28710, 36352, 43994, 51636, 59278 |
| anti-HIV_CDR | 5785 | 13427, 21069, 28711, 36353, 43995, 51637, 59279 |
| anti-HIV_CDR | 5786 | 13428, 21070, 28712, 36354, 43996, 51638, 59280 |
| anti-HIV_CDR | 5787 | 13429, 21071, 28713, 36355, 43997, 51639, 59281 |
| anti-HIV_CDR | 5788 | 13430, 21072, 28714, 36356, 43998, 51640, 59282 |
| anti-HIV_CDR | 5789 | 13431, 21073, 28715, 36357, 43999, 51641, 59283 |
| anti-HIV_CDR | 5790 | 13432, 21074, 28716, 36358, 44000, 51642, 59284 |
| anti-HIV_CDR | 5791 | 13433, 21075, 28717, 36359, 44001, 51643, 59285 |
| anti-HIV_CDR | 5792 | 13434, 21076, 28718, 36360, 44002, 51644, 59286 |
| anti-HIV_CDR | 5793 | 13435, 21077, 28719, 36361, 44003, 51645, 59287 |
| anti-HIV_CDR | 5794 | 13436, 21078, 28720, 36362, 44004, 51646, 59288 |
| anti-HIV_CDR | 5795 | 13437, 21079, 28721, 36363, 44005, 51647, 59289 |
| anti-HIV_CDR | 5796 | 13438, 21080, 28722, 36364, 44006, 51648, 59290 |
| anti-HIV_CDR | 5797 | 13439, 21081, 28723, 36365, 44007, 51649, 59291 |
| anti-HIV_CDR | 5798 | 13440, 21082, 28724, 36366, 44008, 51650, 59292 |
| anti-HIV_CDR | 5799 | 13441, 21083, 28725, 36367, 44009, 51651, 59293 |
| anti-HIV_CDR | 5800 | 13442, 21084, 28726, 36368, 44010, 51652, 59294 |
| anti-HIV_CDR | 5801 | 13443, 21085, 28727, 36369, 44011, 51653, 59295 |
| anti-HIV_CDR | 5802 | 13444, 21086, 28728, 36370, 44012, 51654, 59296 |
| anti-HIV_CDR | 5803 | 13445, 21087, 28729, 36371, 44013, 51655, 59297 |
| anti-HIV_CDR | 5804 | 13446, 21088, 28730, 36372, 44014, 51656, 59298 |
| anti-HIV_CDR | 5805 | 13447, 21089, 28731, 36373, 44015, 51657, 59299 |
| anti-HIV_CDR | 5806 | 13448, 21090, 28732, 36374, 44016, 51658, 59300 |
| anti-HIV_CDR | 5807 | 13449, 21091, 28733, 36375, 44017, 51659, 59301 |
| anti-HIV_CDR | 5808 | 13450, 21092, 28734, 36376, 44018, 51660, 59302 |
| anti-HIV_CDR | 5809 | 13451, 21093, 28735, 36377, 44019, 51661, 59303 |
| anti-HIV_CDR | 5810 | 13452, 21094, 28736, 36378, 44020, 51662, 59304 |
| anti-HIV_CDR | 5811 | 13453, 21095, 28737, 36379, 44021, 51663, 59305 |
| anti-HIV_CDR | 5812 | 13454, 21096, 28738, 36380, 44022, 51664, 59306 |
| anti-HIV_CDR | 5813 | 13455, 21097, 28739, 36381, 44023, 51665, 59307 |
| anti-HIV_CDR | 5814 | 13456, 21098, 28740, 36382, 44024, 51666, 59308 |
| anti-HIV_CDR | 5815 | 13457, 21099, 28741, 36383, 44025, 51667, 59309 |
| anti-HIV_CDR | 5816 | 13458, 21100, 28742, 36384, 44026, 51668, 59310 |
| anti-HIV_CDR | 5817 | 13459, 21101, 28743, 36385, 44027, 51669, 59311 |
| anti-HIV_CDR | 5818 | 13460, 21102, 28744, 36386, 44028, 51670, 59312 |
| anti-HIV_CDR | 5819 | 13461, 21103, 28745, 36387, 44029, 51671, 59313 |
| anti-HIV_CDR | 5820 | 13462, 21104, 28746, 36388, 44030, 51672, 59314 |
| anti-HIV_CDR | 5821 | 13463, 21105, 28747, 36389, 44031, 51673, 59315 |
| anti-HIV_CDR | 5822 | 13464, 21106, 28748, 36390, 44032, 51674, 59316 |
| anti-HIV_CDR | 5823 | 13465, 21107, 28749, 36391, 44033, 51675, 59317 |
| anti-HIV_CDR | 5824 | 13466, 21108, 28750, 36392, 44034, 51676, 59318 |
| anti-HIV_CDR | 5825 | 13467, 21109, 28751, 36393, 44035, 51677, 59319 |
| anti-HIV_CDR | 5826 | 13468, 21110, 28752, 36394, 44036, 51678, 59320 |
| anti-HIV_CDR | 5827 | 13469, 21111, 28753, 36395, 44037, 51679, 59321 |
| anti-HIV_CDR | 5828 | 13470, 21112, 28754, 36396, 44038, 51680, 59322 |
| anti-HIV_CDR | 5829 | 13471, 21113, 28755, 36397, 44039, 51681, 59323 |
| anti-HIV_CDR | 5830 | 13472, 21114, 28756, 36398, 44040, 51682, 59324 |
| anti-HIV_CDR | 5831 | 13473, 21115, 28757, 36399, 44041, 51683, 59325 |
| anti-HIV_CDR | 5832 | 13474, 21116, 28758, 36400, 44042, 51684, 59326 |
| anti-HIV_CDR | 5833 | 13475, 21117, 28759, 36401, 44043, 51685, 59327 |
| anti-HIV_CDR | 5834 | 13476, 21118, 28760, 36402, 44044, 51686, 59328 |
| anti-HIV_CDR | 5835 | 13477, 21119, 28761, 36403, 44045, 51687, 59329 |
| anti-HIV_CDR | 5836 | 13478, 21120, 28762, 36404, 44046, 51688, 59330 |
| anti-HIV_CDR | 5837 | 13479, 21121, 28763, 36405, 44047, 51689, 59331 |
| anti-HIV_CDR | 5838 | 13480, 21122, 28764, 36406, 44048, 51690, 59332 |
| anti-HIV_CDR | 5839 | 13481, 21123, 28765, 36407, 44049, 51691, 59333 |
| anti-HIV_CDR | 5840 | 13482, 21124, 28766, 36408, 44050, 51692, 59334 |
| anti-HIV_CDR | 5841 | 13483, 21125, 28767, 36409, 44051, 51693, 59335 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_CDR | 5842 | 13484, 21126, 28768, 36410, 44052, 51694, 59336 |
| anti-HIV_CDR | 5843 | 13485, 21127, 28769, 36411, 44053, 51695, 59337 |
| anti-HIV_CDR | 5844 | 13486, 21128, 28770, 36412, 44054, 51696, 59338 |
| anti-HIV_CDR | 5845 | 13487, 21129, 28771, 36413, 44055, 51697, 59339 |
| anti-HIV_CDR | 5846 | 13488, 21130, 28772, 36414, 44056, 51698, 59340 |
| anti-HIV_CDR | 5847 | 13489, 21131, 28773, 36415, 44057, 51699, 59341 |
| anti-HIV_CDR | 5848 | 13490, 21132, 28774, 36416, 44058, 51700, 59342 |
| anti-HIV_CDR | 5849 | 13491, 21133, 28775, 36417, 44059, 51701, 59343 |
| anti-HIV_CDR | 5850 | 13492, 21134, 28776, 36418, 44060, 51702, 59344 |
| anti-HIV_CDR | 5851 | 13493, 21135, 28777, 36419, 44061, 51703, 59345 |
| anti-HIV_CDR | 5852 | 13494, 21136, 28778, 36420, 44062, 51704, 59346 |
| anti-HIV_CDR | 5853 | 13495, 21137, 28779, 36421, 44063, 51705, 59347 |
| anti-HIV_CDR | 5854 | 13496, 21138, 28780, 36422, 44064, 51706, 59348 |
| anti-HIV_CDR | 5855 | 13497, 21139, 28781, 36423, 44065, 51707, 59349 |
| anti-HIV_CDR | 5856 | 13498, 21140, 28782, 36424, 44066, 51708, 59350 |
| anti-HIV_CDR | 5857 | 13499, 21141, 28783, 36425, 44067, 51709, 59351 |
| anti-HIV_CDR | 5858 | 13500, 21142, 28784, 36426, 44068, 51710, 59352 |
| anti-HIV_CDR | 5859 | 13501, 21143, 28785, 36427, 44069, 51711, 59353 |
| anti-HIV_CDR | 5860 | 13502, 21144, 28786, 36428, 44070, 51712, 59354 |
| anti-HIV_CDR | 5861 | 13503, 21145, 28787, 36429, 44071, 51713, 59355 |
| anti-HIV_CDR | 5862 | 13504, 21146, 28788, 36430, 44072, 51714, 59356 |
| anti-HIV_CDR | 5863 | 13505, 21147, 28789, 36431, 44073, 51715, 59357 |
| anti-HIV_CDR | 5864 | 13506, 21148, 28790, 36432, 44074, 51716, 59358 |
| anti-HIV_CDR | 5865 | 13507, 21149, 28791, 36433, 44075, 51717, 59359 |
| anti-HIV_CDR | 5866 | 13508, 21150, 28792, 36434, 44076, 51718, 59360 |
| anti-HIV_CDR | 5867 | 13509, 21151, 28793, 36435, 44077, 51719, 59361 |
| anti-HIV_CDR | 5868 | 13510, 21152, 28794, 36436, 44078, 51720, 59362 |
| anti-HIV_CDR | 5869 | 13511, 21153, 28795, 36437, 44079, 51721, 59363 |
| anti-HIV_CDR | 5870 | 13512, 21154, 28796, 36438, 44080, 51722, 59364 |
| anti-HIV_CDR | 5871 | 13513, 21155, 28797, 36439, 44081, 51723, 59365 |
| anti-HIV_CDR | 5872 | 13514, 21156, 28798, 36440, 44082, 51724, 59366 |
| anti-HIV_CDR | 5873 | 13515, 21157, 28799, 36441, 44083, 51725, 59367 |
| anti-HIV_CDR | 5874 | 13516, 21158, 28800, 36442, 44084, 51726, 59368 |
| anti-HIV_CDR | 5875 | 13517, 21159, 28801, 36443, 44085, 51727, 59369 |
| anti-HIV_CDR | 5876 | 13518, 21160, 28802, 36444, 44086, 51728, 59370 |
| anti-HIV_CDR | 5877 | 13519, 21161, 28803, 36445, 44087, 51729, 59371 |
| anti-HIV_CDR | 5878 | 13520, 21162, 28804, 36446, 44088, 51730, 59372 |
| anti-HIV_CDR | 5879 | 13521, 21163, 28805, 36447, 44089, 51731, 59373 |
| anti-HIV_CDR | 5880 | 13522, 21164, 28806, 36448, 44090, 51732, 59374 |
| anti-HIV_CDR | 5881 | 13523, 21165, 28807, 36449, 44091, 51733, 59375 |
| anti-HIV_CDR | 5882 | 13524, 21166, 28808, 36450, 44092, 51734, 59376 |
| anti-HIV_CDR | 5883 | 13525, 21167, 28809, 36451, 44093, 51735, 59377 |
| anti-HIV_CDR | 5884 | 13526, 21168, 28810, 36452, 44094, 51736, 59378 |
| anti-HIV_CDR | 5885 | 13527, 21169, 28811, 36453, 44095, 51737, 59379 |
| anti-HIV_CDR | 5886 | 13528, 21170, 28812, 36454, 44096, 51738, 59380 |
| anti-HIV_CDR | 5887 | 13529, 21171, 28813, 36455, 44097, 51739, 59381 |
| anti-HIV_CDR | 5888 | 13530, 21172, 28814, 36456, 44098, 51740, 59382 |
| anti-HIV_CDR | 5889 | 13531, 21173, 28815, 36457, 44099, 51741, 59383 |
| anti-HIV_CDR | 5890 | 13532, 21174, 28816, 36458, 44100, 51742, 59384 |
| anti-HIV_CDR | 5891 | 13533, 21175, 28817, 36459, 44101, 51743, 59385 |
| anti-HIV_CDR | 5892 | 13534, 21176, 28818, 36460, 44102, 51744, 59386 |
| anti-HIV_CDR | 5893 | 13535, 21177, 28819, 36461, 44103, 51745, 59387 |
| anti-HIV_CDR | 5894 | 13536, 21178, 28820, 36462, 44104, 51746, 59388 |
| anti-HIV_CDR | 5895 | 13537, 21179, 28821, 36463, 44105, 51747, 59389 |
| anti-HIV_CDR | 5896 | 13538, 21180, 28822, 36464, 44106, 51748, 59390 |
| anti-HIV_CDR | 5897 | 13539, 21181, 28823, 36465, 44107, 51749, 59391 |
| anti-HIV_CDR | 5898 | 13540, 21182, 28824, 36466, 44108, 51750, 59392 |
| anti-HIV_CDR | 5899 | 13541, 21183, 28825, 36467, 44109, 51751, 59393 |
| anti-HIV_CDR | 5900 | 13542, 21184, 28826, 36468, 44110, 51752, 59394 |
| anti-HIV_CDR | 5901 | 13543, 21185, 28827, 36469, 44111, 51753, 59395 |
| anti-HIV_CDR | 5902 | 13544, 21186, 28828, 36470, 44112, 51754, 59396 |
| anti-HIV_CDR | 5903 | 13545, 21187, 28829, 36471, 44113, 51755, 59397 |
| anti-HIV_CDR | 5904 | 13546, 21188, 28830, 36472, 44114, 51756, 59398 |
| anti-HIV_CDR | 5905 | 13547, 21189, 28831, 36473, 44115, 51757, 59399 |
| anti-HIV_CDR | 5906 | 13548, 21190, 28832, 36474, 44116, 51758, 59400 |
| anti-HIV_CDR | 5907 | 13549, 21191, 28833, 36475, 44117, 51759, 59401 |
| anti-HIV_CDR | 5908 | 13550, 21192, 28834, 36476, 44118, 51760, 59402 |
| anti-HIV_CDR | 5909 | 13551, 21193, 28835, 36477, 44119, 51761, 59403 |
| anti-HIV_CDR | 5910 | 13552, 21194, 28836, 36478, 44120, 51762, 59404 |
| anti-HIV_CDR | 5911 | 13553, 21195, 28837, 36479, 44121, 51763, 59405 |
| anti-HIV_CDR | 5912 | 13554, 21196, 28838, 36480, 44122, 51764, 59406 |
| anti-HIV_CDR | 5913 | 13555, 21197, 28839, 36481, 44123, 51765, 59407 |
| anti-HIV_CDR | 5914 | 13556, 21198, 28840, 36482, 44124, 51766, 59408 |
| anti-HIV_CDR | 5915 | 13557, 21199, 28841, 36483, 44125, 51767, 59409 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_CDR | 5916 | 13558, 21200, 28842, 36484, 44126, 51768, 59410 |
| anti-HIV_CDR | 5917 | 13559, 21201, 28843, 36485, 44127, 51769, 59411 |
| anti-HIV_CDR | 5918 | 13560, 21202, 28844, 36486, 44128, 51770, 59412 |
| anti-HIV_CDR | 5919 | 13561, 21203, 28845, 36487, 44129, 51771, 59413 |
| anti-HIV_CDR | 5920 | 13562, 21204, 28846, 36488, 44130, 51772, 59414 |
| anti-HIV_CDR | 5921 | 13563, 21205, 28847, 36489, 44131, 51773, 59415 |
| anti-HIV_CDR | 5922 | 13564, 21206, 28848, 36490, 44132, 51774, 59416 |
| anti-HIV_CDR | 5923 | 13565, 21207, 28849, 36491, 44133, 51775, 59417 |
| anti-HIV_CDR | 5924 | 13566, 21208, 28850, 36492, 44134, 51776, 59418 |
| anti-HIV_CDR | 5925 | 13567, 21209, 28851, 36493, 44135, 51777, 59419 |
| anti-HIV_CDR | 5926 | 13568, 21210, 28852, 36494, 44136, 51778, 59420 |
| anti-HIV_CDR | 5927 | 13569, 21211, 28853, 36495, 44137, 51779, 59421 |
| anti-HIV_CDR | 5928 | 13570, 21212, 28854, 36496, 44138, 51780, 59422 |
| anti-HIV_CDR | 5929 | 13571, 21213, 28855, 36497, 44139, 51781, 59423 |
| anti-HIV_CDR | 5930 | 13572, 21214, 28856, 36498, 44140, 51782, 59424 |
| anti-HIV_CDR | 5931 | 13573, 21215, 28857, 36499, 44141, 51783, 59425 |
| anti-HIV_CDR | 5932 | 13574, 21216, 28858, 36500, 44142, 51784, 59426 |
| anti-HIV_CDR | 5933 | 13575, 21217, 28859, 36501, 44143, 51785, 59427 |
| anti-HIV_CDR | 5934 | 13576, 21218, 28860, 36502, 44144, 51786, 59428 |
| anti-HIV_CDR | 5935 | 13577, 21219, 28861, 36503, 44145, 51787, 59429 |
| anti-HIV_CDR | 5936 | 13578, 21220, 28862, 36504, 44146, 51788, 59430 |
| anti-HIV_CDR | 5937 | 13579, 21221, 28863, 36505, 44147, 51789, 59431 |
| anti-HIV_CDR | 5938 | 13580, 21222, 28864, 36506, 44148, 51790, 59432 |
| anti-HIV_CDR | 5939 | 13581, 21223, 28865, 36507, 44149, 51791, 59433 |
| anti-HIV_CDR | 5940 | 13582, 21224, 28866, 36508, 44150, 51792, 59434 |
| anti-HIV_CDR | 5941 | 13583, 21225, 28867, 36509, 44151, 51793, 59435 |
| anti-HIV_CDR | 5942 | 13584, 21226, 28868, 36510, 44152, 51794, 59436 |
| anti-HIV_CDR | 5943 | 13585, 21227, 28869, 36511, 44153, 51795, 59437 |
| anti-HIV_CDR | 5944 | 13586, 21228, 28870, 36512, 44154, 51796, 59438 |
| anti-HIV_CDR | 5945 | 13587, 21229, 28871, 36513, 44155, 51797, 59439 |
| anti-HIV_CDR | 5946 | 13588, 21230, 28872, 36514, 44156, 51798, 59440 |
| anti-HIV_CDR | 5947 | 13589, 21231, 28873, 36515, 44157, 51799, 59441 |
| anti-HIV_CDR | 5948 | 13590, 21232, 28874, 36516, 44158, 51800, 59442 |
| anti-HIV_CDR | 5949 | 13591, 21233, 28875, 36517, 44159, 51801, 59443 |
| anti-HIV_CDR | 5950 | 13592, 21234, 28876, 36518, 44160, 51802, 59444 |
| anti-HIV_CDR | 5951 | 13593, 21235, 28877, 36519, 44161, 51803, 59445 |
| anti-HIV_CDR | 5952 | 13594, 21236, 28878, 36520, 44162, 51804, 59446 |
| anti-HIV_CDR | 5953 | 13595, 21237, 28879, 36521, 44163, 51805, 59447 |
| anti-HIV_CDR | 5954 | 13596, 21238, 28880, 36522, 44164, 51806, 59448 |
| anti-HIV_CDR | 5955 | 13597, 21239, 28881, 36523, 44165, 51807, 59449 |
| anti-HIV_CDR | 5956 | 13598, 21240, 28882, 36524, 44166, 51808, 59450 |
| anti-HIV_CDR | 5957 | 13599, 21241, 28883, 36525, 44167, 51809, 59451 |
| anti-HIV_CDR | 5958 | 13600, 21242, 28884, 36526, 44168, 51810, 59452 |
| anti-HIV_CDR | 5959 | 13601, 21243, 28885, 36527, 44169, 51811, 59453 |
| anti-HIV_CDR | 5960 | 13602, 21244, 28886, 36528, 44170, 51812, 59454 |
| anti-HIV_CDR | 5961 | 13603, 21245, 28887, 36529, 44171, 51813, 59455 |
| anti-HIV_CDR | 5962 | 13604, 21246, 28888, 36530, 44172, 51814, 59456 |
| anti-HIV_CDR | 5963 | 13605, 21247, 28889, 36531, 44173, 51815, 59457 |
| anti-HIV_CDR | 5964 | 13606, 21248, 28890, 36532, 44174, 51816, 59458 |
| anti-HIV_CDR | 5965 | 13607, 21249, 28891, 36533, 44175, 51817, 59459 |
| anti-HIV_CDR | 5966 | 13608, 21250, 28892, 36534, 44176, 51818, 59460 |
| anti-HIV_CDR | 5967 | 13609, 21251, 28893, 36535, 44177, 51819, 59461 |
| anti-HIV_CDR | 5968 | 13610, 21252, 28894, 36536, 44178, 51820, 59462 |
| anti-HIV_CDR | 5969 | 13611, 21253, 28895, 36537, 44179, 51821, 59463 |
| anti-HIV_CDR | 5970 | 13612, 21254, 28896, 36538, 44180, 51822, 59464 |
| anti-HIV_CDR | 5971 | 13613, 21255, 28897, 36539, 44181, 51823, 59465 |
| anti-HIV_CDR | 5972 | 13614, 21256, 28898, 36540, 44182, 51824, 59466 |
| anti-HIV_CDR | 5973 | 13615, 21257, 28899, 36541, 44183, 51825, 59467 |
| anti-HIV_CDR | 5974 | 13616, 21258, 28900, 36542, 44184, 51826, 59468 |
| anti-HIV_CDR | 5975 | 13617, 21259, 28901, 36543, 44185, 51827, 59469 |
| anti-HIV_CDR | 5976 | 13618, 21260, 28902, 36544, 44186, 51828, 59470 |
| anti-HIV_CDR | 5977 | 13619, 21261, 28903, 36545, 44187, 51829, 59471 |
| anti-HIV_CDR | 5978 | 13620, 21262, 28904, 36546, 44188, 51830, 59472 |
| anti-HIV_CDR | 5979 | 13621, 21263, 28905, 36547, 44189, 51831, 59473 |
| anti-HIV_CDR | 5980 | 13622, 21264, 28906, 36548, 44190, 51832, 59474 |
| anti-HIV_CDR | 5981 | 13623, 21265, 28907, 36549, 44191, 51833, 59475 |
| anti-HIV_CDR | 5982 | 13624, 21266, 28908, 36550, 44192, 51834, 59476 |
| anti-HIV_CDR | 5983 | 13625, 21267, 28909, 36551, 44193, 51835, 59477 |
| anti-HIV_CDR | 5984 | 13626, 21268, 28910, 36552, 44194, 51836, 59478 |
| anti-HIV_CDR | 5985 | 13627, 21269, 28911, 36553, 44195, 51837, 59479 |
| anti-HIV_CDR | 5986 | 13628, 21270, 28912, 36554, 44196, 51838, 59480 |
| anti-HIV_CDR | 5987 | 13629, 21271, 28913, 36555, 44197, 51839, 59481 |
| anti-HIV_CDR | 5988 | 13630, 21272, 28914, 36556, 44198, 51840, 59482 |
| anti-HIV_CDR | 5989 | 13631, 21273, 28915, 36557, 44199, 51841, 59483 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_CDR | 5990 | 13632, 21274, 28916, 36558, 44200, 51842, 59484 |
| anti-HIV_CDR | 5991 | 13633, 21275, 28917, 36559, 44201, 51843, 59485 |
| anti-HIV_CDR | 5992 | 13634, 21276, 28918, 36560, 44202, 51844, 59486 |
| anti-HIV_CDR | 5993 | 13635, 21277, 28919, 36561, 44203, 51845, 59487 |
| anti-HIV_CDR | 5994 | 13636, 21278, 28920, 36562, 44204, 51846, 59488 |
| anti-HIV_CDR | 5995 | 13637, 21279, 28921, 36563, 44205, 51847, 59489 |
| anti-HIV_CDR | 5996 | 13638, 21280, 28922, 36564, 44206, 51848, 59490 |
| anti-HIV_CDR | 5997 | 13639, 21281, 28923, 36565, 44207, 51849, 59491 |
| anti-HIV_CDR | 5998 | 13640, 21282, 28924, 36566, 44208, 51850, 59492 |
| anti-HIV_CDR | 5999 | 13641, 21283, 28925, 36567, 44209, 51851, 59493 |
| anti-HIV_CDR | 6000 | 13642, 21284, 28926, 36568, 44210, 51852, 59494 |
| anti-HIV_CDR | 6001 | 13643, 21285, 28927, 36569, 44211, 51853, 59495 |
| anti-HIV_CDR | 6002 | 13644, 21286, 28928, 36570, 44212, 51854, 59496 |
| anti-HIV_CDR | 6003 | 13645, 21287, 28929, 36571, 44213, 51855, 59497 |
| anti-HIV_CDR | 6004 | 13646, 21288, 28930, 36572, 44214, 51856, 59498 |
| anti-HIV_CDR | 6005 | 13647, 21289, 28931, 36573, 44215, 51857, 59499 |
| anti-HIV_CDR | 6006 | 13648, 21290, 28932, 36574, 44216, 51858, 59500 |
| anti-HIV_CDR | 6007 | 13649, 21291, 28933, 36575, 44217, 51859, 59501 |
| anti-HIV_CDR | 6008 | 13650, 21292, 28934, 36576, 44218, 51860, 59502 |
| anti-HIV_CDR | 6009 | 13651, 21293, 28935, 36577, 44219, 51861, 59503 |
| anti-HIV_CDR | 6010 | 13652, 21294, 28936, 36578, 44220, 51862, 59504 |
| anti-HIV_CDR | 6011 | 13653, 21295, 28937, 36579, 44221, 51863, 59505 |
| anti-HIV_CDR | 6012 | 13654, 21296, 28938, 36580, 44222, 51864, 59506 |
| anti-HIV_CDR | 6013 | 13655, 21297, 28939, 36581, 44223, 51865, 59507 |
| anti-HIV_CDR | 6014 | 13656, 21298, 28940, 36582, 44224, 51866, 59508 |
| anti-HIV_CDR | 6015 | 13657, 21299, 28941, 36583, 44225, 51867, 59509 |
| anti-HIV_CDR | 6016 | 13658, 21300, 28942, 36584, 44226, 51868, 59510 |
| anti-HIV_CDR | 6017 | 13659, 21301, 28943, 36585, 44227, 51869, 59511 |
| anti-HIV_CDR | 6018 | 13660, 21302, 28944, 36586, 44228, 51870, 59512 |
| anti-HIV_CDR | 6019 | 13661, 21303, 28945, 36587, 44229, 51871, 59513 |
| anti-HIV_CDR | 6020 | 13662, 21304, 28946, 36588, 44230, 51872, 59514 |
| anti-HIV_CDR | 6021 | 13663, 21305, 28947, 36589, 44231, 51873, 59515 |
| anti-HIV_CDR | 6022 | 13664, 21306, 28948, 36590, 44232, 51874, 59516 |
| anti-HIV_CDR | 6023 | 13665, 21307, 28949, 36591, 44233, 51875, 59517 |
| anti-HIV_CDR | 6024 | 13666, 21308, 28950, 36592, 44234, 51876, 59518 |
| anti-HIV_CDR | 6025 | 13667, 21309, 28951, 36593, 44235, 51877, 59519 |
| anti-HIV_CDR | 6026 | 13668, 21310, 28952, 36594, 44236, 51878, 59520 |
| anti-HIV_CDR | 6027 | 13669, 21311, 28953, 36595, 44237, 51879, 59521 |
| anti-HIV_CDR | 6028 | 13670, 21312, 28954, 36596, 44238, 51880, 59522 |
| anti-HIV_CDR | 6029 | 13671, 21313, 28955, 36597, 44239, 51881, 59523 |
| anti-HIV_CDR | 6030 | 13672, 21314, 28956, 36598, 44240, 51882, 59524 |
| anti-HIV_CDR | 6031 | 13673, 21315, 28957, 36599, 44241, 51883, 59525 |
| anti-HIV_CDR | 6032 | 13674, 21316, 28958, 36600, 44242, 51884, 59526 |
| anti-HIV_CDR | 6033 | 13675, 21317, 28959, 36601, 44243, 51885, 59527 |
| anti-HIV_CDR | 6034 | 13676, 21318, 28960, 36602, 44244, 51886, 59528 |
| anti-HIV_CDR | 6035 | 13677, 21319, 28961, 36603, 44245, 51887, 59529 |
| anti-HIV_CDR | 6036 | 13678, 21320, 28962, 36604, 44246, 51888, 59530 |
| anti-HIV_CDR | 6037 | 13679, 21321, 28963, 36605, 44247, 51889, 59531 |
| anti-HIV_CDR | 6038 | 13680, 21322, 28964, 36606, 44248, 51890, 59532 |
| anti-HIV_CDR | 6039 | 13681, 21323, 28965, 36607, 44249, 51891, 59533 |
| anti-HIV_CDR | 6040 | 13682, 21324, 28966, 36608, 44250, 51892, 59534 |
| anti-HIV_CDR | 6041 | 13683, 21325, 28967, 36609, 44251, 51893, 59535 |
| anti-HIV_CDR | 6042 | 13684, 21326, 28968, 36610, 44252, 51894, 59536 |
| anti-HIV_CDR | 6043 | 13685, 21327, 28969, 36611, 44253, 51895, 59537 |
| anti-HIV_CDR | 6044 | 13686, 21328, 28970, 36612, 44254, 51896, 59538 |
| anti-HIV_CDR | 6045 | 13687, 21329, 28971, 36613, 44255, 51897, 59539 |
| anti-HIV_CDR | 6046 | 13688, 21330, 28972, 36614, 44256, 51898, 59540 |
| anti-HIV_CDR | 6047 | 13689, 21331, 28973, 36615, 44257, 51899, 59541 |
| anti-HIV_CDR | 6048 | 13690, 21332, 28974, 36616, 44258, 51900, 59542 |
| anti-HIV_CDR | 6049 | 13691, 21333, 28975, 36617, 44259, 51901, 59543 |
| anti-HIV_CDR | 6050 | 13692, 21334, 28976, 36618, 44260, 51902, 59544 |
| anti-HIV_CDR | 6051 | 13693, 21335, 28977, 36619, 44261, 51903, 59545 |
| anti-HIV_CDR | 6052 | 13694, 21336, 28978, 36620, 44262, 51904, 59546 |
| anti-HIV_CDR | 6053 | 13695, 21337, 28979, 36621, 44263, 51905, 59547 |
| anti-HIV_CDR | 6054 | 13696, 21338, 28980, 36622, 44264, 51906, 59548 |
| anti-HIV_CDR | 6055 | 13697, 21339, 28981, 36623, 44265, 51907, 59549 |
| anti-HIV_CDR | 6056 | 13698, 21340, 28982, 36624, 44266, 51908, 59550 |
| anti-HIV_CDR | 6057 | 13699, 21341, 28983, 36625, 44267, 51909, 59551 |
| anti-HIV_CDR | 6058 | 13700, 21342, 28984, 36626, 44268, 51910, 59552 |
| anti-HIV_CDR | 6059 | 13701, 21343, 28985, 36627, 44269, 51911, 59553 |
| anti-HIV_CDR | 6060 | 13702, 21344, 28986, 36628, 44270, 51912, 59554 |
| anti-HIV_CDR | 6061 | 13703, 21345, 28987, 36629, 44271, 51913, 59555 |
| anti-HIV_CDR | 6062 | 13704, 21346, 28988, 36630, 44272, 51914, 59556 |
| anti-HIV_CDR | 6063 | 13705, 21347, 28989, 36631, 44273, 51915, 59557 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
| --- | --- | --- |
| anti-HIV_CDR | 6064 | 13706, 21348, 28990, 36632, 44274, 51916, 59558 |
| anti-HIV_CDR | 6065 | 13707, 21349, 28991, 36633, 44275, 51917, 59559 |
| anti-HIV_CDR | 6066 | 13708, 21350, 28992, 36634, 44276, 51918, 59560 |
| anti-HIV_CDR | 6067 | 13709, 21351, 28993, 36635, 44277, 51919, 59561 |
| anti-HIV_CDR | 6068 | 13710, 21352, 28994, 36636, 44278, 51920, 59562 |
| anti-HIV_CDR | 6069 | 13711, 21353, 28995, 36637, 44279, 51921, 59563 |
| anti-HIV_CDR | 6070 | 13712, 21354, 28996, 36638, 44280, 51922, 59564 |
| anti-HIV_CDR | 6071 | 13713, 21355, 28997, 36639, 44281, 51923, 59565 |
| anti-HIV_CDR | 6072 | 13714, 21356, 28998, 36640, 44282, 51924, 59566 |
| anti-HIV_CDR | 6073 | 13715, 21357, 28999, 36641, 44283, 51925, 59567 |
| anti-HIV_CDR | 6074 | 13716, 21358, 29000, 36642, 44284, 51926, 59568 |
| anti-HIV_CDR | 6075 | 13717, 21359, 29001, 36643, 44285, 51927, 59569 |
| anti-HIV_CDR | 6076 | 13718, 21360, 29002, 36644, 44286, 51928, 59570 |
| anti-HIV_CDR | 6077 | 13719, 21361, 29003, 36645, 44287, 51929, 59571 |
| anti-HIV_CDR | 6078 | 13720, 21362, 29004, 36646, 44288, 51930, 59572 |
| anti-HIV_CDR | 6079 | 13721, 21363, 29005, 36647, 44289, 51931, 59573 |
| anti-HIV_CDR | 6080 | 13722, 21364, 29006, 36648, 44290, 51932, 59574 |
| anti-HIV_CDR | 6081 | 13723, 21365, 29007, 36649, 44291, 51933, 59575 |
| anti-HIV_CDR | 6082 | 13724, 21366, 29008, 36650, 44292, 51934, 59576 |
| anti-HIV_CDR | 6083 | 13725, 21367, 29009, 36651, 44293, 51935, 59577 |
| anti-HIV_CDR | 6084 | 13726, 21368, 29010, 36652, 44294, 51936, 59578 |
| anti-HIV_CDR | 6085 | 13727, 21369, 29011, 36653, 44295, 51937, 59579 |
| anti-HIV_CDR | 6086 | 13728, 21370, 29012, 36654, 44296, 51938, 59580 |
| anti-HIV_CDR | 6087 | 13729, 21371, 29013, 36655, 44297, 51939, 59581 |
| anti-HIV_CDR | 6088 | 13730, 21372, 29014, 36656, 44298, 51940, 59582 |
| anti-HIV_CDR | 6089 | 13731, 21373, 29015, 36657, 44299, 51941, 59583 |
| anti-HIV_CDR | 6090 | 13732, 21374, 29016, 36658, 44300, 51942, 59584 |
| anti-HIV_CDR | 6091 | 13733, 21375, 29017, 36659, 44301, 51943, 59585 |
| anti-HIV_CDR | 6092 | 13734, 21376, 29018, 36660, 44302, 51944, 59586 |
| anti-HIV_CDR | 6093 | 13735, 21377, 29019, 36661, 44303, 51945, 59587 |
| anti-HIV_CDR | 6094 | 13736, 21378, 29020, 36662, 44304, 51946, 59588 |
| anti-HIV_CDR | 6095 | 13737, 21379, 29021, 36663, 44305, 51947, 59589 |
| anti-HIV_CDR | 6096 | 13738, 21380, 29022, 36664, 44306, 51948, 59590 |
| anti-HIV_CDR | 6097 | 13739, 21381, 29023, 36665, 44307, 51949, 59591 |
| anti-HIV_CDR | 6098 | 13740, 21382, 29024, 36666, 44308, 51950, 59592 |
| anti-HIV_CDR | 6099 | 13741, 21383, 29025, 36667, 44309, 51951, 59593 |
| anti-HIV_CDR | 6100 | 13742, 21384, 29026, 36668, 44310, 51952, 59594 |
| anti-HIV_CDR | 6101 | 13743, 21385, 29027, 36669, 44311, 51953, 59595 |
| anti-HIV_CDR | 6102 | 13744, 21386, 29028, 36670, 44312, 51954, 59596 |
| anti-HIV_CDR | 6103 | 13745, 21387, 29029, 36671, 44313, 51955, 59597 |
| anti-HIV_CDR | 6104 | 13746, 21388, 29030, 36672, 44314, 51956, 59598 |
| anti-HIV_CDR | 6105 | 13747, 21389, 29031, 36673, 44315, 51957, 59599 |
| anti-HIV_CDR | 6106 | 13748, 21390, 29032, 36674, 44316, 51958, 59600 |
| anti-HIV_CDR | 6107 | 13749, 21391, 29033, 36675, 44317, 51959, 59601 |
| anti-HIV_CDR | 6108 | 13750, 21392, 29034, 36676, 44318, 51960, 59602 |
| anti-HIV_CDR | 6109 | 13751, 21393, 29035, 36677, 44319, 51961, 59603 |
| anti-HIV_CDR | 6110 | 13752, 21394, 29036, 36678, 44320, 51962, 59604 |
| anti-HIV_CDR | 6111 | 13753, 21395, 29037, 36679, 44321, 51963, 59605 |
| anti-HIV_CDR | 6112 | 13754, 21396, 29038, 36680, 44322, 51964, 59606 |
| anti-HIV_CDR | 6113 | 13755, 21397, 29039, 36681, 44323, 51965, 59607 |
| anti-HIV_CDR | 6114 | 13756, 21398, 29040, 36682, 44324, 51966, 59608 |
| anti-HIV_CDR | 6115 | 13757, 21399, 29041, 36683, 44325, 51967, 59609 |
| anti-HIV_CDR | 6116 | 13758, 21400, 29042, 36684, 44326, 51968, 59610 |
| anti-HIV_CDR | 6117 | 13759, 21401, 29043, 36685, 44327, 51969, 59611 |
| anti-HIV_CDR | 6118 | 13760, 21402, 29044, 36686, 44328, 51970, 59612 |
| anti-HIV_CDR | 6119 | 13761, 21403, 29045, 36687, 44329, 51971, 59613 |
| anti-HIV_CDR | 6120 | 13762, 21404, 29046, 36688, 44330, 51972, 59614 |
| anti-HIV_CDR | 6121 | 13763, 21405, 29047, 36689, 44331, 51973, 59615 |
| anti-HIV_CDR | 6122 | 13764, 21406, 29048, 36690, 44332, 51974, 59616 |
| anti-HIV_CDR | 6123 | 13765, 21407, 29049, 36691, 44333, 51975, 59617 |
| anti-HIV_CDR | 6124 | 13766, 21408, 29050, 36692, 44334, 51976, 59618 |
| anti-HIV_CDR | 6125 | 13767, 21409, 29051, 36693, 44335, 51977, 59619 |
| anti-HIV_CDR | 6126 | 13768, 21410, 29052, 36694, 44336, 51978, 59620 |
| anti-HIV_CDR | 6127 | 13769, 21411, 29053, 36695, 44337, 51979, 59621 |
| anti-HIV_CDR | 6128 | 13770, 21412, 29054, 36696, 44338, 51980, 59622 |
| anti-HIV_CDR | 6129 | 13771, 21413, 29055, 36697, 44339, 51981, 59623 |
| anti-HIV_CDR | 6130 | 13772, 21414, 29056, 36698, 44340, 51982, 59624 |
| anti-HIV_CDR | 6131 | 13773, 21415, 29057, 36699, 44341, 51983, 59625 |
| anti-HIV_CDR | 6132 | 13774, 21416, 29058, 36700, 44342, 51984, 59626 |
| anti-HIV_CDR | 6133 | 13775, 21417, 29059, 36701, 44343, 51985, 59627 |
| anti-HIV_CDR | 6134 | 13776, 21418, 29060, 36702, 44344, 51986, 59628 |
| anti-HIV_CDR | 6135 | 13777, 21419, 29061, 36703, 44345, 51987, 59629 |
| anti-HIV_CDR | 6136 | 13778, 21420, 29062, 36704, 44346, 51988, 59630 |
| anti-HIV_CDR | 6137 | 13779, 21421, 29063, 36705, 44347, 51989, 59631 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
| --- | --- | --- |
| anti-HIV_CDR | 6138 | 13780, 21422, 29064, 36706, 44348, 51990, 59632 |
| anti-HIV_CDR | 6139 | 13781, 21423, 29065, 36707, 44349, 51991, 59633 |
| anti-HIV_CDR | 6140 | 13782, 21424, 29066, 36708, 44350, 51992, 59634 |
| anti-HIV_CDR | 6141 | 13783, 21425, 29067, 36709, 44351, 51993, 59635 |
| anti-HIV_CDR | 6142 | 13784, 21426, 29068, 36710, 44352, 51994, 59636 |
| anti-HIV_CDR | 6143 | 13785, 21427, 29069, 36711, 44353, 51995, 59637 |
| anti-HIV_CDR | 6144 | 13786, 21428, 29070, 36712, 44354, 51996, 59638 |
| anti-HIV_CDR | 6145 | 13787, 21429, 29071, 36713, 44355, 51997, 59639 |
| anti-HIV_CDR | 6146 | 13788, 21430, 29072, 36714, 44356, 51998, 59640 |
| anti-HIV_CDR | 6147 | 13789, 21431, 29073, 36715, 44357, 51999, 59641 |
| anti-HIV_CDR | 6148 | 13790, 21432, 29074, 36716, 44358, 52000, 59642 |
| anti-HIV_CDR | 6149 | 13791, 21433, 29075, 36717, 44359, 52001, 59643 |
| anti-HIV_CDR | 6150 | 13792, 21434, 29076, 36718, 44360, 52002, 59644 |
| anti-HIV_CDR | 6151 | 13793, 21435, 29077, 36719, 44361, 52003, 59645 |
| anti-HIV_CDR | 6152 | 13794, 21436, 29078, 36720, 44362, 52004, 59646 |
| anti-HIV_CDR | 6153 | 13795, 21437, 29079, 36721, 44363, 52005, 59647 |
| anti-HIV_CDR | 6154 | 13796, 21438, 29080, 36722, 44364, 52006, 59648 |
| anti-HIV_CDR | 6155 | 13797, 21439, 29081, 36723, 44365, 52007, 59649 |
| anti-HIV_CDR | 6156 | 13798, 21440, 29082, 36724, 44366, 52008, 59650 |
| anti-HIV_CDR | 6157 | 13799, 21441, 29083, 36725, 44367, 52009, 59651 |
| anti-HIV_CDR | 6158 | 13800, 21442, 29084, 36726, 44368, 52010, 59652 |
| anti-HIV_CDR | 6159 | 13801, 21443, 29085, 36727, 44369, 52011, 59653 |
| anti-HIV_CDR | 6160 | 13802, 21444, 29086, 36728, 44370, 52012, 59654 |
| anti-HIV_CDR | 6161 | 13803, 21445, 29087, 36729, 44371, 52013, 59655 |
| anti-HIV_CDR | 6162 | 13804, 21446, 29088, 36730, 44372, 52014, 59656 |
| anti-HIV_CDR | 6163 | 13805, 21447, 29089, 36731, 44373, 52015, 59657 |
| anti-HIV_CDR | 6164 | 13806, 21448, 29090, 36732, 44374, 52016, 59658 |
| anti-HIV_CDR | 6165 | 13807, 21449, 29091, 36733, 44375, 52017, 59659 |
| anti-HIV_CDR | 6166 | 13808, 21450, 29092, 36734, 44376, 52018, 59660 |
| anti-HIV_CDR | 6167 | 13809, 21451, 29093, 36735, 44377, 52019, 59661 |
| anti-HIV_CDR | 6168 | 13810, 21452, 29094, 36736, 44378, 52020, 59662 |
| anti-HIV_CDR | 6169 | 13811, 21453, 29095, 36737, 44379, 52021, 59663 |
| anti-HIV_CDR | 6170 | 13812, 21454, 29096, 36738, 44380, 52022, 59664 |
| anti-HIV_CDR | 6171 | 13813, 21455, 29097, 36739, 44381, 52023, 59665 |
| anti-HIV_CDR | 6172 | 13814, 21456, 29098, 36740, 44382, 52024, 59666 |
| anti-HIV_CDR | 6173 | 13815, 21457, 29099, 36741, 44383, 52025, 59667 |
| anti-HIV_CDR | 6174 | 13816, 21458, 29100, 36742, 44384, 52026, 59668 |
| anti-HIV_CDR | 6175 | 13817, 21459, 29101, 36743, 44385, 52027, 59669 |
| anti-HIV_CDR | 6176 | 13818, 21460, 29102, 36744, 44386, 52028, 59670 |
| anti-HIV_CDR | 6177 | 13819, 21461, 29103, 36745, 44387, 52029, 59671 |
| anti-HIV_CDR | 6178 | 13820, 21462, 29104, 36746, 44388, 52030, 59672 |
| anti-HIV_CDR | 6179 | 13821, 21463, 29105, 36747, 44389, 52031, 59673 |
| anti-HIV_CDR | 6180 | 13822, 21464, 29106, 36748, 44390, 52032, 59674 |
| anti-HIV_CDR | 6181 | 13823, 21465, 29107, 36749, 44391, 52033, 59675 |
| anti-HIV_CDR | 6182 | 13824, 21466, 29108, 36750, 44392, 52034, 59676 |
| anti-HIV_CDR | 6183 | 13825, 21467, 29109, 36751, 44393, 52035, 59677 |
| anti-HIV_CDR | 6184 | 13826, 21468, 29110, 36752, 44394, 52036, 59678 |
| anti-HIV_CDR | 6185 | 13827, 21469, 29111, 36753, 44395, 52037, 59679 |
| anti-HIV_CDR | 6186 | 13828, 21470, 29112, 36754, 44396, 52038, 59680 |
| anti-HIV_CDR | 6187 | 13829, 21471, 29113, 36755, 44397, 52039, 59681 |
| anti-HIV_CDR | 6188 | 13830, 21472, 29114, 36756, 44398, 52040, 59682 |
| anti-HIV_CDR | 6189 | 13831, 21473, 29115, 36757, 44399, 52041, 59683 |
| anti-HIV_CDR | 6190 | 13832, 21474, 29116, 36758, 44400, 52042, 59684 |
| anti-HIV_CDR | 6191 | 13833, 21475, 29117, 36759, 44401, 52043, 59685 |
| anti-HIV_CDR | 6192 | 13834, 21476, 29118, 36760, 44402, 52044, 59686 |
| anti-HIV_CDR | 6193 | 13835, 21477, 29119, 36761, 44403, 52045, 59687 |
| anti-HIV_CDR | 6194 | 13836, 21478, 29120, 36762, 44404, 52046, 59688 |
| anti-HIV_CDR | 6195 | 13837, 21479, 29121, 36763, 44405, 52047, 59689 |
| anti-HIV_CDR | 6196 | 13838, 21480, 29122, 36764, 44406, 52048, 59690 |
| anti-HIV_CDR | 6197 | 13839, 21481, 29123, 36765, 44407, 52049, 59691 |
| anti-HIV_CDR | 6198 | 13840, 21482, 29124, 36766, 44408, 52050, 59692 |
| anti-HIV_CDR | 6199 | 13841, 21483, 29125, 36767, 44409, 52051, 59693 |
| anti-HIV_CDR | 6200 | 13842, 21484, 29126, 36768, 44410, 52052, 59694 |
| anti-HIV_CDR | 6201 | 13843, 21485, 29127, 36769, 44411, 52053, 59695 |
| anti-HIV_CDR | 6202 | 13844, 21486, 29128, 36770, 44412, 52054, 59696 |
| anti-HIV_CDR | 6203 | 13845, 21487, 29129, 36771, 44413, 52055, 59697 |
| anti-HIV_CDR | 6204 | 13846, 21488, 29130, 36772, 44414, 52056, 59698 |
| anti-HIV_CDR | 6205 | 13847, 21489, 29131, 36773, 44415, 52057, 59699 |
| anti-HIV_CDR | 6206 | 13848, 21490, 29132, 36774, 44416, 52058, 59700 |
| anti-HIV_CDR | 6207 | 13849, 21491, 29133, 36775, 44417, 52059, 59701 |
| anti-HIV_CDR | 6208 | 13850, 21492, 29134, 36776, 44418, 52060, 59702 |
| anti-HIV_CDR | 6209 | 13851, 21493, 29135, 36777, 44419, 52061, 59703 |
| anti-HIV_CDR | 6210 | 13852, 21494, 29136, 36778, 44420, 52062, 59704 |
| anti-HIV_CDR | 6211 | 13853, 21495, 29137, 36779, 44421, 52063, 59705 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_CDR | 6212 | 13854, 21496, 29138, 36780, 44422, 52064, 59706 |
| anti-HIV_CDR | 6213 | 13855, 21497, 29139, 36781, 44423, 52065, 59707 |
| anti-HIV_CDR | 6214 | 13856, 21498, 29140, 36782, 44424, 52066, 59708 |
| anti-HIV_CDR | 6215 | 13857, 21499, 29141, 36783, 44425, 52067, 59709 |
| anti-HIV_CDR | 6216 | 13858, 21500, 29142, 36784, 44426, 52068, 59710 |
| anti-HIV_CDR | 6217 | 13859, 21501, 29143, 36785, 44427, 52069, 59711 |
| anti-HIV_CDR | 6218 | 13860, 21502, 29144, 36786, 44428, 52070, 59712 |
| anti-HIV_CDR | 6219 | 13861, 21503, 29145, 36787, 44429, 52071, 59713 |
| anti-HIV_CDR | 6220 | 13862, 21504, 29146, 36788, 44430, 52072, 59714 |
| anti-HIV_CDR | 6221 | 13863, 21505, 29147, 36789, 44431, 52073, 59715 |
| anti-HIV_CDR | 6222 | 13864, 21506, 29148, 36790, 44432, 52074, 59716 |
| anti-HIV_CDR | 6223 | 13865, 21507, 29149, 36791, 44433, 52075, 59717 |
| anti-HIV_CDR | 6224 | 13866, 21508, 29150, 36792, 44434, 52076, 59718 |
| anti-HIV_CDR | 6225 | 13867, 21509, 29151, 36793, 44435, 52077, 59719 |
| anti-HIV_CDR | 6226 | 13868, 21510, 29152, 36794, 44436, 52078, 59720 |
| anti-HIV_CDR | 6227 | 13869, 21511, 29153, 36795, 44437, 52079, 59721 |
| anti-HIV_CDR | 6228 | 13870, 21512, 29154, 36796, 44438, 52080, 59722 |
| anti-HIV_CDR | 6229 | 13871, 21513, 29155, 36797, 44439, 52081, 59723 |
| anti-HIV_CDR | 6230 | 13872, 21514, 29156, 36798, 44440, 52082, 59724 |
| anti-HIV_CDR | 6231 | 13873, 21515, 29157, 36799, 44441, 52083, 59725 |
| anti-HIV_CDR | 6232 | 13874, 21516, 29158, 36800, 44442, 52084, 59726 |
| anti-HIV_CDR | 6233 | 13875, 21517, 29159, 36801, 44443, 52085, 59727 |
| anti-HIV_CDR | 6234 | 13876, 21518, 29160, 36802, 44444, 52086, 59728 |
| anti-HIV_CDR | 6235 | 13877, 21519, 29161, 36803, 44445, 52087, 59729 |
| anti-HIV_CDR | 6236 | 13878, 21520, 29162, 36804, 44446, 52088, 59730 |
| anti-HIV_CDR | 6237 | 13879, 21521, 29163, 36805, 44447, 52089, 59731 |
| anti-HIV_CDR | 6238 | 13880, 21522, 29164, 36806, 44448, 52090, 59732 |
| anti-HIV_CDR | 6239 | 13881, 21523, 29165, 36807, 44449, 52091, 59733 |
| anti-HIV_CDR | 6240 | 13882, 21524, 29166, 36808, 44450, 52092, 59734 |
| anti-HIV_CDR | 6241 | 13883, 21525, 29167, 36809, 44451, 52093, 59735 |
| anti-HIV_CDR | 6242 | 13884, 21526, 29168, 36810, 44452, 52094, 59736 |
| anti-HIV_CDR | 6243 | 13885, 21527, 29169, 36811, 44453, 52095, 59737 |
| anti-HIV_CDR | 6244 | 13886, 21528, 29170, 36812, 44454, 52096, 59738 |
| anti-HIV_CDR | 6245 | 13887, 21529, 29171, 36813, 44455, 52097, 59739 |
| anti-HIV_CDR | 6246 | 13888, 21530, 29172, 36814, 44456, 52098, 59740 |
| anti-HIV_CDR | 6247 | 13889, 21531, 29173, 36815, 44457, 52099, 59741 |
| anti-HIV_CDR | 6248 | 13890, 21532, 29174, 36816, 44458, 52100, 59742 |
| anti-HIV_CDR | 6249 | 13891, 21533, 29175, 36817, 44459, 52101, 59743 |
| anti-HIV_CDR | 6250 | 13892, 21534, 29176, 36818, 44460, 52102, 59744 |
| anti-HIV_CDR | 6251 | 13893, 21535, 29177, 36819, 44461, 52103, 59745 |
| anti-HIV_CDR | 6252 | 13894, 21536, 29178, 36820, 44462, 52104, 59746 |
| anti-HIV_CDR | 6253 | 13895, 21537, 29179, 36821, 44463, 52105, 59747 |
| anti-HIV_CDR | 6254 | 13896, 21538, 29180, 36822, 44464, 52106, 59748 |
| anti-HIV_CDR | 6255 | 13897, 21539, 29181, 36823, 44465, 52107, 59749 |
| anti-HIV_CDR | 6256 | 13898, 21540, 29182, 36824, 44466, 52108, 59750 |
| anti-HIV_CDR | 6257 | 13899, 21541, 29183, 36825, 44467, 52109, 59751 |
| anti-HIV_CDR | 6258 | 13900, 21542, 29184, 36826, 44468, 52110, 59752 |
| anti-HIV_CDR | 6259 | 13901, 21543, 29185, 36827, 44469, 52111, 59753 |
| anti-HIV_CDR | 6260 | 13902, 21544, 29186, 36828, 44470, 52112, 59754 |
| anti-HIV_CDR | 6261 | 13903, 21545, 29187, 36829, 44471, 52113, 59755 |
| anti-HIV_CDR | 6262 | 13904, 21546, 29188, 36830, 44472, 52114, 59756 |
| anti-HIV_CDR | 6263 | 13905, 21547, 29189, 36831, 44473, 52115, 59757 |
| anti-HIV_CDR | 6264 | 13906, 21548, 29190, 36832, 44474, 52116, 59758 |
| anti-HIV_CDR | 6265 | 13907, 21549, 29191, 36833, 44475, 52117, 59759 |
| anti-HIV_CDR | 6266 | 13908, 21550, 29192, 36834, 44476, 52118, 59760 |
| anti-HIV_CDR | 6267 | 13909, 21551, 29193, 36835, 44477, 52119, 59761 |
| anti-HIV_CDR | 6268 | 13910, 21552, 29194, 36836, 44478, 52120, 59762 |
| anti-HIV_CDR | 6269 | 13911, 21553, 29195, 36837, 44479, 52121, 59763 |
| anti-HIV_CDR | 6270 | 13912, 21554, 29196, 36838, 44480, 52122, 59764 |
| anti-HIV_CDR | 6271 | 13913, 21555, 29197, 36839, 44481, 52123, 59765 |
| anti-HIV_CDR | 6272 | 13914, 21556, 29198, 36840, 44482, 52124, 59766 |
| anti-HIV_CDR | 6273 | 13915, 21557, 29199, 36841, 44483, 52125, 59767 |
| anti-HIV_CDR | 6274 | 13916, 21558, 29200, 36842, 44484, 52126, 59768 |
| anti-HIV_CDR | 6275 | 13917, 21559, 29201, 36843, 44485, 52127, 59769 |
| anti-HIV_CDR | 6276 | 13918, 21560, 29202, 36844, 44486, 52128, 59770 |
| anti-HIV_CDR | 6277 | 13919, 21561, 29203, 36845, 44487, 52129, 59771 |
| anti-HIV_CDR | 6278 | 13920, 21562, 29204, 36846, 44488, 52130, 59772 |
| anti-HIV_CDR | 6279 | 13921, 21563, 29205, 36847, 44489, 52131, 59773 |
| anti-HIV_CDR | 6280 | 13922, 21564, 29206, 36848, 44490, 52132, 59774 |
| anti-HIV_CDR | 6281 | 13923, 21565, 29207, 36849, 44491, 52133, 59775 |
| anti-HIV_CDR | 6282 | 13924, 21566, 29208, 36850, 44492, 52134, 59776 |
| anti-HIV_CDR | 6283 | 13925, 21567, 29209, 36851, 44493, 52135, 59777 |
| anti-HIV_CDR | 6284 | 13926, 21568, 29210, 36852, 44494, 52136, 59778 |
| anti-HIV_CDR | 6285 | 13927, 21569, 29211, 36853, 44495, 52137, 59779 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
| --- | --- | --- |
| anti-HIV_CDR | 6286 | 13928, 21570, 29212, 36854, 44496, 52138, 59780 |
| anti-HIV_CDR | 6287 | 13929, 21571, 29213, 36855, 44497, 52139, 59781 |
| anti-HIV_CDR | 6288 | 13930, 21572, 29214, 36856, 44498, 52140, 59782 |
| anti-HIV_CDR | 6289 | 13931, 21573, 29215, 36857, 44499, 52141, 59783 |
| anti-HIV_CDR | 6290 | 13932, 21574, 29216, 36858, 44500, 52142, 59784 |
| anti-HIV_CDR | 6291 | 13933, 21575, 29217, 36859, 44501, 52143, 59785 |
| anti-HIV_CDR | 6292 | 13934, 21576, 29218, 36860, 44502, 52144, 59786 |
| anti-HIV_CDR | 6293 | 13935, 21577, 29219, 36861, 44503, 52145, 59787 |
| anti-HIV_CDR | 6294 | 13936, 21578, 29220, 36862, 44504, 52146, 59788 |
| anti-HIV_CDR | 6295 | 13937, 21579, 29221, 36863, 44505, 52147, 59789 |
| anti-HIV_CDR | 6296 | 13938, 21580, 29222, 36864, 44506, 52148, 59790 |
| anti-HIV_CDR | 6297 | 13939, 21581, 29223, 36865, 44507, 52149, 59791 |
| anti-HIV_CDR | 6298 | 13940, 21582, 29224, 36866, 44508, 52150, 59792 |
| anti-HIV_CDR | 6299 | 13941, 21583, 29225, 36867, 44509, 52151, 59793 |
| anti-HIV_CDR | 6300 | 13942, 21584, 29226, 36868, 44510, 52152, 59794 |
| anti-HIV_CDR | 6301 | 13943, 21585, 29227, 36869, 44511, 52153, 59795 |
| anti-HIV_CDR | 6302 | 13944, 21586, 29228, 36870, 44512, 52154, 59796 |
| anti-HIV_CDR | 6303 | 13945, 21587, 29229, 36871, 44513, 52155, 59797 |
| anti-HIV_CDR | 6304 | 13946, 21588, 29230, 36872, 44514, 52156, 59798 |
| anti-HIV_CDR | 6305 | 13947, 21589, 29231, 36873, 44515, 52157, 59799 |
| anti-HIV_CDR | 6306 | 13948, 21590, 29232, 36874, 44516, 52158, 59800 |
| anti-HIV_CDR | 6307 | 13949, 21591, 29233, 36875, 44517, 52159, 59801 |
| anti-HIV_CDR | 6308 | 13950, 21592, 29234, 36876, 44518, 52160, 59802 |
| anti-HIV_CDR | 6309 | 13951, 21593, 29235, 36877, 44519, 52161, 59803 |
| anti-HIV_CDR | 6310 | 13952, 21594, 29236, 36878, 44520, 52162, 59804 |
| anti-HIV_CDR | 6311 | 13953, 21595, 29237, 36879, 44521, 52163, 59805 |
| anti-HIV_CDR | 6312 | 13954, 21596, 29238, 36880, 44522, 52164, 59806 |
| anti-HIV_CDR | 6313 | 13955, 21597, 29239, 36881, 44523, 52165, 59807 |
| anti-HIV_CDR | 6314 | 13956, 21598, 29240, 36882, 44524, 52166, 59808 |
| anti-HIV_CDR | 6315 | 13957, 21599, 29241, 36883, 44525, 52167, 59809 |
| anti-HIV_CDR | 6316 | 13958, 21600, 29242, 36884, 44526, 52168, 59810 |
| anti-HIV_CDR | 6317 | 13959, 21601, 29243, 36885, 44527, 52169, 59811 |
| anti-HIV_CDR | 6318 | 13960, 21602, 29244, 36886, 44528, 52170, 59812 |
| anti-HIV_CDR | 6319 | 13961, 21603, 29245, 36887, 44529, 52171, 59813 |
| anti-HIV_CDR | 6320 | 13962, 21604, 29246, 36888, 44530, 52172, 59814 |
| anti-HIV_CDR | 6321 | 13963, 21605, 29247, 36889, 44531, 52173, 59815 |
| anti-HIV_CDR | 6322 | 13964, 21606, 29248, 36890, 44532, 52174, 59816 |
| anti-HIV_CDR | 6323 | 13965, 21607, 29249, 36891, 44533, 52175, 59817 |
| anti-HIV_CDR | 6324 | 13966, 21608, 29250, 36892, 44534, 52176, 59818 |
| anti-HIV_CDR | 6325 | 13967, 21609, 29251, 36893, 44535, 52177, 59819 |
| anti-HIV_CDR | 6326 | 13968, 21610, 29252, 36894, 44536, 52178, 59820 |
| anti-HIV_CDR | 6327 | 13969, 21611, 29253, 36895, 44537, 52179, 59821 |
| anti-HIV_CDR | 6328 | 13970, 21612, 29254, 36896, 44538, 52180, 59822 |
| anti-HIV_CDR | 6329 | 13971, 21613, 29255, 36897, 44539, 52181, 59823 |
| anti-HIV_CDR | 6330 | 13972, 21614, 29256, 36898, 44540, 52182, 59824 |
| anti-HIV_CDR | 6331 | 13973, 21615, 29257, 36899, 44541, 52183, 59825 |
| anti-HIV_CDR | 6332 | 13974, 21616, 29258, 36900, 44542, 52184, 59826 |
| anti-HIV_CDR | 6333 | 13975, 21617, 29259, 36901, 44543, 52185, 59827 |
| anti-HIV_CDR | 6334 | 13976, 21618, 29260, 36902, 44544, 52186, 59828 |
| anti-HIV_CDR | 6335 | 13977, 21619, 29261, 36903, 44545, 52187, 59829 |
| anti-HIV_CDR | 6336 | 13978, 21620, 29262, 36904, 44546, 52188, 59830 |
| anti-HIV_CDR | 6337 | 13979, 21621, 29263, 36905, 44547, 52189, 59831 |
| anti-HIV_CDR | 6338 | 13980, 21622, 29264, 36906, 44548, 52190, 59832 |
| anti-HIV_CDR | 6339 | 13981, 21623, 29265, 36907, 44549, 52191, 59833 |
| anti-HIV_CDR | 6340 | 13982, 21624, 29266, 36908, 44550, 52192, 59834 |
| anti-HIV_CDR | 6341 | 13983, 21625, 29267, 36909, 44551, 52193, 59835 |
| anti-HIV_CDR | 6342 | 13984, 21626, 29268, 36910, 44552, 52194, 59836 |
| anti-HIV_CDR | 6343 | 13985, 21627, 29269, 36911, 44553, 52195, 59837 |
| anti-HIV_CDR | 6344 | 13986, 21628, 29270, 36912, 44554, 52196, 59838 |
| anti-HIV_CDR | 6345 | 13987, 21629, 29271, 36913, 44555, 52197, 59839 |
| anti-HIV_CDR | 6346 | 13988, 21630, 29272, 36914, 44556, 52198, 59840 |
| anti-HIV_CDR | 6347 | 13989, 21631, 29273, 36915, 44557, 52199, 59841 |
| anti-HIV_CDR | 6348 | 13990, 21632, 29274, 36916, 44558, 52200, 59842 |
| anti-HIV_CDR | 6349 | 13991, 21633, 29275, 36917, 44559, 52201, 59843 |
| anti-HIV_CDR | 6350 | 13992, 21634, 29276, 36918, 44560, 52202, 59844 |
| anti-HIV_CDR | 6351 | 13993, 21635, 29277, 36919, 44561, 52203, 59845 |
| anti-HIV_CDR | 6352 | 13994, 21636, 29278, 36920, 44562, 52204, 59846 |
| anti-HIV_CDR | 6353 | 13995, 21637, 29279, 36921, 44563, 52205, 59847 |
| anti-HIV_CDR | 6354 | 13996, 21638, 29280, 36922, 44564, 52206, 59848 |
| anti-HIV_CDR | 6355 | 13997, 21639, 29281, 36923, 44565, 52207, 59849 |
| anti-HIV_CDR | 6356 | 13998, 21640, 29282, 36924, 44566, 52208, 59850 |
| anti-HIV_CDR | 6357 | 13999, 21641, 29283, 36925, 44567, 52209, 59851 |
| anti-HIV_CDR | 6358 | 14000, 21642, 29284, 36926, 44568, 52210, 59852 |
| anti-HIV_CDR | 6359 | 14001, 21643, 29285, 36927, 44569, 52211, 59853 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_CDR | 6360 | 14002, 21644, 29286, 36928, 44570, 52212, 59854 |
| anti-HIV_CDR | 6361 | 14003, 21645, 29287, 36929, 44571, 52213, 59855 |
| anti-HIV_CDR | 6362 | 14004, 21646, 29288, 36930, 44572, 52214, 59856 |
| anti-HIV_CDR | 6363 | 14005, 21647, 29289, 36931, 44573, 52215, 59857 |
| anti-HIV_CDR | 6364 | 14006, 21648, 29290, 36932, 44574, 52216, 59858 |
| anti-HIV_CDR | 6365 | 14007, 21649, 29291, 36933, 44575, 52217, 59859 |
| anti-HIV_CDR | 6366 | 14008, 21650, 29292, 36934, 44576, 52218, 59860 |
| anti-HIV_CDR | 6367 | 14009, 21651, 29293, 36935, 44577, 52219, 59861 |
| anti-HIV_CDR | 6368 | 14010, 21652, 29294, 36936, 44578, 52220, 59862 |
| anti-HIV_CDR | 6369 | 14011, 21653, 29295, 36937, 44579, 52221, 59863 |
| anti-HIV_CDR | 6370 | 14012, 21654, 29296, 36938, 44580, 52222, 59864 |
| anti-HIV_CDR | 6371 | 14013, 21655, 29297, 36939, 44581, 52223, 59865 |
| anti-HIV_CDR | 6372 | 14014, 21656, 29298, 36940, 44582, 52224, 59866 |
| anti-HIV_CDR | 6373 | 14015, 21657, 29299, 36941, 44583, 52225, 59867 |
| anti-HIV_CDR | 6374 | 14016, 21658, 29300, 36942, 44584, 52226, 59868 |
| anti-HIV_CDR | 6375 | 14017, 21659, 29301, 36943, 44585, 52227, 59869 |
| anti-HIV_CDR | 6376 | 14018, 21660, 29302, 36944, 44586, 52228, 59870 |
| anti-HIV_CDR | 6377 | 14019, 21661, 29303, 36945, 44587, 52229, 59871 |
| anti-HIV_CDR | 6378 | 14020, 21662, 29304, 36946, 44588, 52230, 59872 |
| anti-HIV_CDR | 6379 | 14021, 21663, 29305, 36947, 44589, 52231, 59873 |
| anti-HIV_CDR | 6380 | 14022, 21664, 29306, 36948, 44590, 52232, 59874 |
| anti-HIV_CDR | 6381 | 14023, 21665, 29307, 36949, 44591, 52233, 59875 |
| anti-HIV_CDR | 6382 | 14024, 21666, 29308, 36950, 44592, 52234, 59876 |
| anti-HIV_CDR | 6383 | 14025, 21667, 29309, 36951, 44593, 52235, 59877 |
| anti-HIV_CDR | 6384 | 14026, 21668, 29310, 36952, 44594, 52236, 59878 |
| anti-HIV_CDR | 6385 | 14027, 21669, 29311, 36953, 44595, 52237, 59879 |
| anti-HIV_CDR | 6386 | 14028, 21670, 29312, 36954, 44596, 52238, 59880 |
| anti-HIV_CDR | 6387 | 14029, 21671, 29313, 36955, 44597, 52239, 59881 |
| anti-HIV_CDR | 6388 | 14030, 21672, 29314, 36956, 44598, 52240, 59882 |
| anti-HIV_CDR | 6389 | 14031, 21673, 29315, 36957, 44599, 52241, 59883 |
| anti-HIV_CDR | 6390 | 14032, 21674, 29316, 36958, 44600, 52242, 59884 |
| anti-HIV_CDR | 6391 | 14033, 21675, 29317, 36959, 44601, 52243, 59885 |
| anti-HIV_CDR | 6392 | 14034, 21676, 29318, 36960, 44602, 52244, 59886 |
| anti-HIV_CDR | 6393 | 14035, 21677, 29319, 36961, 44603, 52245, 59887 |
| anti-HIV_CDR | 6394 | 14036, 21678, 29320, 36962, 44604, 52246, 59888 |
| anti-HIV_CDR | 6395 | 14037, 21679, 29321, 36963, 44605, 52247, 59889 |
| anti-HIV_CDR | 6396 | 14038, 21680, 29322, 36964, 44606, 52248, 59890 |
| anti-HIV_CDR | 6397 | 14039, 21681, 29323, 36965, 44607, 52249, 59891 |
| anti-HIV_CDR | 6398 | 14040, 21682, 29324, 36966, 44608, 52250, 59892 |
| anti-HIV_CDR | 6399 | 14041, 21683, 29325, 36967, 44609, 52251, 59893 |
| anti-HIV_CDR | 6400 | 14042, 21684, 29326, 36968, 44610, 52252, 59894 |
| anti-HIV_CDR | 6401 | 14043, 21685, 29327, 36969, 44611, 52253, 59895 |
| anti-HIV_CDR | 6402 | 14044, 21686, 29328, 36970, 44612, 52254, 59896 |
| anti-HIV_CDR | 6403 | 14045, 21687, 29329, 36971, 44613, 52255, 59897 |
| anti-HIV_CDR | 6404 | 14046, 21688, 29330, 36972, 44614, 52256, 59898 |
| anti-HIV_CDR | 6405 | 14047, 21689, 29331, 36973, 44615, 52257, 59899 |
| anti-HIV_CDR | 6406 | 14048, 21690, 29332, 36974, 44616, 52258, 59900 |
| anti-HIV_CDR | 6407 | 14049, 21691, 29333, 36975, 44617, 52259, 59901 |
| anti-HIV_CDR | 6408 | 14050, 21692, 29334, 36976, 44618, 52260, 59902 |
| anti-HIV_CDR | 6409 | 14051, 21693, 29335, 36977, 44619, 52261, 59903 |
| anti-HIV_CDR | 6410 | 14052, 21694, 29336, 36978, 44620, 52262, 59904 |
| anti-HIV_CDR | 6411 | 14053, 21695, 29337, 36979, 44621, 52263, 59905 |
| anti-HIV_CDR | 6412 | 14054, 21696, 29338, 36980, 44622, 52264, 59906 |
| anti-HIV_CDR | 6413 | 14055, 21697, 29339, 36981, 44623, 52265, 59907 |
| anti-HIV_CDR | 6414 | 14056, 21698, 29340, 36982, 44624, 52266, 59908 |
| anti-HIV_CDR | 6415 | 14057, 21699, 29341, 36983, 44625, 52267, 59909 |
| anti-HIV_CDR | 6416 | 14058, 21700, 29342, 36984, 44626, 52268, 59910 |
| anti-HIV_CDR | 6417 | 14059, 21701, 29343, 36985, 44627, 52269, 59911 |
| anti-HIV_CDR | 6418 | 14060, 21702, 29344, 36986, 44628, 52270, 59912 |
| anti-HIV_CDR | 6419 | 14061, 21703, 29345, 36987, 44629, 52271, 59913 |
| anti-HIV_CDR | 6420 | 14062, 21704, 29346, 36988, 44630, 52272, 59914 |
| anti-HIV_CDR | 6421 | 14063, 21705, 29347, 36989, 44631, 52273, 59915 |
| anti-HIV_CDR | 6422 | 14064, 21706, 29348, 36990, 44632, 52274, 59916 |
| anti-HIV_CDR | 6423 | 14065, 21707, 29349, 36991, 44633, 52275, 59917 |
| anti-HIV_CDR | 6424 | 14066, 21708, 29350, 36992, 44634, 52276, 59918 |
| anti-HIV_CDR | 6425 | 14067, 21709, 29351, 36993, 44635, 52277, 59919 |
| anti-HIV_CDR | 6426 | 14068, 21710, 29352, 36994, 44636, 52278, 59920 |
| anti-HIV_CDR | 6427 | 14069, 21711, 29353, 36995, 44637, 52279, 59921 |
| anti-HIV_CDR | 6428 | 14070, 21712, 29354, 36996, 44638, 52280, 59922 |
| anti-HIV_CDR | 6429 | 14071, 21713, 29355, 36997, 44639, 52281, 59923 |
| anti-HIV_CDR | 6430 | 14072, 21714, 29356, 36998, 44640, 52282, 59924 |
| anti-HIV_CDR | 6431 | 14073, 21715, 29357, 36999, 44641, 52283, 59925 |
| anti-HIV_CDR | 6432 | 14074, 21716, 29358, 37000, 44642, 52284, 59926 |
| anti-HIV_CDR | 6433 | 14075, 21717, 29359, 37001, 44643, 52285, 59927 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-HIV_CDR | 6434 | 14076, 21718, 29360, 37002, 44644, 52286, 59928 |
| anti-HIV_CDR | 6435 | 14077, 21719, 29361, 37003, 44645, 52287, 59929 |
| anti-HIV_CDR | 6436 | 14078, 21720, 29362, 37004, 44646, 52288, 59930 |
| anti-HIV_CDR | 6437 | 14079, 21721, 29363, 37005, 44647, 52289, 59931 |
| anti-HIV_CDR | 6438 | 14080, 21722, 29364, 37006, 44648, 52290, 59932 |
| anti-HIV_CDR | 6439 | 14081, 21723, 29365, 37007, 44649, 52291, 59933 |
| anti-HIV_CDR | 6440 | 14082, 21724, 29366, 37008, 44650, 52292, 59934 |
| anti-HIV_CDR | 6441 | 14083, 21725, 29367, 37009, 44651, 52293, 59935 |
| anti-HIV_CDR | 6442 | 14084, 21726, 29368, 37010, 44652, 52294, 59936 |
| anti-HIV_CDR | 6443 | 14085, 21727, 29369, 37011, 44653, 52295, 59937 |
| anti-HIV_CDR | 6444 | 14086, 21728, 29370, 37012, 44654, 52296, 59938 |
| anti-HIV_CDR | 6445 | 14087, 21729, 29371, 37013, 44655, 52297, 59939 |
| anti-HIV_CDR | 6446 | 14088, 21730, 29372, 37014, 44656, 52298, 59940 |
| anti-HIV_CDR | 6447 | 14089, 21731, 29373, 37015, 44657, 52299, 59941 |
| anti-HIV_CDR | 6448 | 14090, 21732, 29374, 37016, 44658, 52300, 59942 |
| anti-HIV_CDR | 6449 | 14091, 21733, 29375, 37017, 44659, 52301, 59943 |
| anti-HIV_CDR | 6450 | 14092, 21734, 29376, 37018, 44660, 52302, 59944 |
| anti-HIV_CDR | 6451 | 14093, 21735, 29377, 37019, 44661, 52303, 59945 |
| anti-HIV_CDR | 6452 | 14094, 21736, 29378, 37020, 44662, 52304, 59946 |
| anti-HIV_CDR | 6453 | 14095, 21737, 29379, 37021, 44663, 52305, 59947 |
| anti-HIV_CDR | 6454 | 14096, 21738, 29380, 37022, 44664, 52306, 59948 |
| anti-HIV_CDR | 6455 | 14097, 21739, 29381, 37023, 44665, 52307, 59949 |
| anti-HIV_CDR | 6456 | 14098, 21740, 29382, 37024, 44666, 52308, 59950 |
| anti-HIV_CDR | 6457 | 14099, 21741, 29383, 37025, 44667, 52309, 59951 |
| anti-HIV_CDR | 6458 | 14100, 21742, 29384, 37026, 44668, 52310, 59952 |
| anti-HIV_CDR | 6459 | 14101, 21743, 29385, 37027, 44669, 52311, 59953 |
| anti-HIV_CDR | 6460 | 14102, 21744, 29386, 37028, 44670, 52312, 59954 |
| anti-HIV_CDR | 6461 | 14103, 21745, 29387, 37029, 44671, 52313, 59955 |
| anti-HIV_CDR | 6462 | 14104, 21746, 29388, 37030, 44672, 52314, 59956 |
| anti-HIV_CDR | 6463 | 14105, 21747, 29389, 37031, 44673, 52315, 59957 |
| anti-HIV_CDR | 6464 | 14106, 21748, 29390, 37032, 44674, 52316, 59958 |
| anti-HIV_CDR | 6465 | 14107, 21749, 29391, 37033, 44675, 52317, 59959 |
| anti-HIV_CDR | 6466 | 14108, 21750, 29392, 37034, 44676, 52318, 59960 |
| anti-HIV_CDR | 6467 | 14109, 21751, 29393, 37035, 44677, 52319, 59961 |
| anti-HIV_CDR | 6468 | 14110, 21752, 29394, 37036, 44678, 52320, 59962 |
| anti-HIV_CDR | 6469 | 14111, 21753, 29395, 37037, 44679, 52321, 59963 |
| anti-HIV_CDR | 6470 | 14112, 21754, 29396, 37038, 44680, 52322, 59964 |
| anti-HIV_CDR | 6471 | 14113, 21755, 29397, 37039, 44681, 52323, 59965 |
| anti-HIV_CDR | 6472 | 14114, 21756, 29398, 37040, 44682, 52324, 59966 |
| anti-HIV_CDR | 6473 | 14115, 21757, 29399, 37041, 44683, 52325, 59967 |
| anti-HIV_CDR | 6474 | 14116, 21758, 29400, 37042, 44684, 52326, 59968 |
| anti-HIV_CDR | 6475 | 14117, 21759, 29401, 37043, 44685, 52327, 59969 |
| anti-HIV_CDR | 6476 | 14118, 21760, 29402, 37044, 44686, 52328, 59970 |
| anti-HIV_CDR | 6477 | 14119, 21761, 29403, 37045, 44687, 52329, 59971 |
| anti-influenza_CDR | 6478 | 14120, 21762, 29404, 37046, 44688, 52330, 59972 |
| anti-influenza_CDR | 6479 | 14121, 21763, 29405, 37047, 44689, 52331, 59973 |
| anti-influenza_CDR | 6480 | 14122, 21764, 29406, 37048, 44690, 52332, 59974 |
| anti-influenza_CDR | 6481 | 14123, 21765, 29407, 37049, 44691, 52333, 59975 |
| anti-influenza_CDR | 6482 | 14124, 21766, 29408, 37050, 44692, 52334, 59976 |
| anti-influenza_CDR | 6483 | 14125, 21767, 29409, 37051, 44693, 52335, 59977 |
| anti-influenza_CDR | 6484 | 14126, 21768, 29410, 37052, 44694, 52336, 59978 |
| anti-influenza_CDR | 6485 | 14127, 21769, 29411, 37053, 44695, 52337, 59979 |
| anti-influenza_CDR | 6486 | 14128, 21770, 29412, 37054, 44696, 52338, 59980 |
| anti-influenza_CDR | 6487 | 14129, 21771, 29413, 37055, 44697, 52339, 59981 |
| anti-influenza_CDR | 6488 | 14130, 21772, 29414, 37056, 44698, 52340, 59982 |
| anti-influenza_CDR | 6489 | 14131, 21773, 29415, 37057, 44699, 52341, 59983 |
| anti-influenza_CDR | 6490 | 14132, 21774, 29416, 37058, 44700, 52342, 59984 |
| anti-influenza_CDR | 6491 | 14133, 21775, 29417, 37059, 44701, 52343, 59985 |
| anti-influenza_CDR | 6492 | 14134, 21776, 29418, 37060, 44702, 52344, 59986 |
| anti-influenza_CDR | 6493 | 14135, 21777, 29419, 37061, 44703, 52345, 59987 |
| anti-influenza_CDR | 6494 | 14136, 21778, 29420, 37062, 44704, 52346, 59988 |
| anti-influenza_CDR | 6495 | 14137, 21779, 29421, 37063, 44705, 52347, 59989 |
| anti-influenza_CDR | 6496 | 14138, 21780, 29422, 37064, 44706, 52348, 59990 |
| anti-influenza_CDR | 6497 | 14139, 21781, 29423, 37065, 44707, 52349, 59991 |
| anti-influenza_CDR | 6498 | 14140, 21782, 29424, 37066, 44708, 52350, 59992 |
| anti-influenza_CDR | 6499 | 14141, 21783, 29425, 37067, 44709, 52351, 59993 |
| anti-influenza_CDR | 6500 | 14142, 21784, 29426, 37068, 44710, 52352, 59994 |
| anti-influenza_CDR | 6501 | 14143, 21785, 29427, 37069, 44711, 52353, 59995 |
| anti-influenza_CDR | 6502 | 14144, 21786, 29428, 37070, 44712, 52354, 59996 |
| anti-influenza_CDR | 6503 | 14145, 21787, 29429, 37071, 44713, 52355, 59997 |
| anti-influenza_CDR | 6504 | 14146, 21788, 29430, 37072, 44714, 52356, 59998 |
| anti-influenza_CDR | 6505 | 14147, 21789, 29431, 37073, 44715, 52357, 59999 |
| anti-influenza_CDR | 6506 | 14148, 21790, 29432, 37074, 44716, 52358, 60000 |
| anti-influenza_CDR | 6507 | 14149, 21791, 29433, 37075, 44717, 52359, 60001 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 6508 | 14150, 21792, 29434, 37076, 44718, 52360, 60002 |
| anti-influenza_CDR | 6509 | 14151, 21793, 29435, 37077, 44719, 52361, 60003 |
| anti-influenza_CDR | 6510 | 14152, 21794, 29436, 37078, 44720, 52362, 60004 |
| anti-influenza_CDR | 6511 | 14153, 21795, 29437, 37079, 44721, 52363, 60005 |
| anti-influenza_CDR | 6512 | 14154, 21796, 29438, 37080, 44722, 52364, 60006 |
| anti-influenza_CDR | 6513 | 14155, 21797, 29439, 37081, 44723, 52365, 60007 |
| anti-influenza_CDR | 6514 | 14156, 21798, 29440, 37082, 44724, 52366, 60008 |
| anti-influenza_CDR | 6515 | 14157, 21799, 29441, 37083, 44725, 52367, 60009 |
| anti-influenza_CDR | 6516 | 14158, 21800, 29442, 37084, 44726, 52368, 60010 |
| anti-influenza_CDR | 6517 | 14159, 21801, 29443, 37085, 44727, 52369, 60011 |
| anti-influenza_CDR | 6518 | 14160, 21802, 29444, 37086, 44728, 52370, 60012 |
| anti-influenza_CDR | 6519 | 14161, 21803, 29445, 37087, 44729, 52371, 60013 |
| anti-influenza_CDR | 6520 | 14162, 21804, 29446, 37088, 44730, 52372, 60014 |
| anti-influenza_CDR | 6521 | 14163, 21805, 29447, 37089, 44731, 52373, 60015 |
| anti-influenza_CDR | 6522 | 14164, 21806, 29448, 37090, 44732, 52374, 60016 |
| anti-influenza_CDR | 6523 | 14165, 21807, 29449, 37091, 44733, 52375, 60017 |
| anti-influenza_CDR | 6524 | 14166, 21808, 29450, 37092, 44734, 52376, 60018 |
| anti-influenza_CDR | 6525 | 14167, 21809, 29451, 37093, 44735, 52377, 60019 |
| anti-influenza_CDR | 6526 | 14168, 21810, 29452, 37094, 44736, 52378, 60020 |
| anti-influenza_CDR | 6527 | 14169, 21811, 29453, 37095, 44737, 52379, 60021 |
| anti-influenza_CDR | 6528 | 14170, 21812, 29454, 37096, 44738, 52380, 60022 |
| anti-influenza_CDR | 6529 | 14171, 21813, 29455, 37097, 44739, 52381, 60023 |
| anti-influenza_CDR | 6530 | 14172, 21814, 29456, 37098, 44740, 52382, 60024 |
| anti-influenza_CDR | 6531 | 14173, 21815, 29457, 37099, 44741, 52383, 60025 |
| anti-influenza_CDR | 6532 | 14174, 21816, 29458, 37100, 44742, 52384, 60026 |
| anti-influenza_CDR | 6533 | 14175, 21817, 29459, 37101, 44743, 52385, 60027 |
| anti-influenza_CDR | 6534 | 14176, 21818, 29460, 37102, 44744, 52386, 60028 |
| anti-influenza_CDR | 6535 | 14177, 21819, 29461, 37103, 44745, 52387, 60029 |
| anti-influenza_CDR | 6536 | 14178, 21820, 29462, 37104, 44746, 52388, 60030 |
| anti-influenza_CDR | 6537 | 14179, 21821, 29463, 37105, 44747, 52389, 60031 |
| anti-influenza_CDR | 6538 | 14180, 21822, 29464, 37106, 44748, 52390, 60032 |
| anti-influenza_CDR | 6539 | 14181, 21823, 29465, 37107, 44749, 52391, 60033 |
| anti-influenza_CDR | 6540 | 14182, 21824, 29466, 37108, 44750, 52392, 60034 |
| anti-influenza_CDR | 6541 | 14183, 21825, 29467, 37109, 44751, 52393, 60035 |
| anti-influenza_CDR | 6542 | 14184, 21826, 29468, 37110, 44752, 52394, 60036 |
| anti-influenza_CDR | 6543 | 14185, 21827, 29469, 37111, 44753, 52395, 60037 |
| anti-influenza_CDR | 6544 | 14186, 21828, 29470, 37112, 44754, 52396, 60038 |
| anti-influenza_CDR | 6545 | 14187, 21829, 29471, 37113, 44755, 52397, 60039 |
| anti-influenza_CDR | 6546 | 14188, 21830, 29472, 37114, 44756, 52398, 60040 |
| anti-influenza_CDR | 6547 | 14189, 21831, 29473, 37115, 44757, 52399, 60041 |
| anti-influenza_CDR | 6548 | 14190, 21832, 29474, 37116, 44758, 52400, 60042 |
| anti-influenza_CDR | 6549 | 14191, 21833, 29475, 37117, 44759, 52401, 60043 |
| anti-influenza_CDR | 6550 | 14192, 21834, 29476, 37118, 44760, 52402, 60044 |
| anti-influenza_CDR | 6551 | 14193, 21835, 29477, 37119, 44761, 52403, 60045 |
| anti-influenza_CDR | 6552 | 14194, 21836, 29478, 37120, 44762, 52404, 60046 |
| anti-influenza_CDR | 6553 | 14195, 21837, 29479, 37121, 44763, 52405, 60047 |
| anti-influenza_CDR | 6554 | 14196, 21838, 29480, 37122, 44764, 52406, 60048 |
| anti-influenza_CDR | 6555 | 14197, 21839, 29481, 37123, 44765, 52407, 60049 |
| anti-influenza_CDR | 6556 | 14198, 21840, 29482, 37124, 44766, 52408, 60050 |
| anti-influenza_CDR | 6557 | 14199, 21841, 29483, 37125, 44767, 52409, 60051 |
| anti-influenza_CDR | 6558 | 14200, 21842, 29484, 37126, 44768, 52410, 60052 |
| anti-influenza_CDR | 6559 | 14201, 21843, 29485, 37127, 44769, 52411, 60053 |
| anti-influenza_CDR | 6560 | 14202, 21844, 29486, 37128, 44770, 52412, 60054 |
| anti-influenza_CDR | 6561 | 14203, 21845, 29487, 37129, 44771, 52413, 60055 |
| anti-influenza_CDR | 6562 | 14204, 21846, 29488, 37130, 44772, 52414, 60056 |
| anti-influenza_CDR | 6563 | 14205, 21847, 29489, 37131, 44773, 52415, 60057 |
| anti-influenza_CDR | 6564 | 14206, 21848, 29490, 37132, 44774, 52416, 60058 |
| anti-influenza_CDR | 6565 | 14207, 21849, 29491, 37133, 44775, 52417, 60059 |
| anti-influenza_CDR | 6566 | 14208, 21850, 29492, 37134, 44776, 52418, 60060 |
| anti-influenza_CDR | 6567 | 14209, 21851, 29493, 37135, 44777, 52419, 60061 |
| anti-influenza_CDR | 6568 | 14210, 21852, 29494, 37136, 44778, 52420, 60062 |
| anti-influenza_CDR | 6569 | 14211, 21853, 29495, 37137, 44779, 52421, 60063 |
| anti-influenza_CDR | 6570 | 14212, 21854, 29496, 37138, 44780, 52422, 60064 |
| anti-influenza_CDR | 6571 | 14213, 21855, 29497, 37139, 44781, 52423, 60065 |
| anti-influenza_CDR | 6572 | 14214, 21856, 29498, 37140, 44782, 52424, 60066 |
| anti-influenza_CDR | 6573 | 14215, 21857, 29499, 37141, 44783, 52425, 60067 |
| anti-influenza_CDR | 6574 | 14216, 21858, 29500, 37142, 44784, 52426, 60068 |
| anti-influenza_CDR | 6575 | 14217, 21859, 29501, 37143, 44785, 52427, 60069 |
| anti-influenza_CDR | 6576 | 14218, 21860, 29502, 37144, 44786, 52428, 60070 |
| anti-influenza_CDR | 6577 | 14219, 21861, 29503, 37145, 44787, 52429, 60071 |
| anti-influenza_CDR | 6578 | 14220, 21862, 29504, 37146, 44788, 52430, 60072 |
| anti-influenza_CDR | 6579 | 14221, 21863, 29505, 37147, 44789, 52431, 60073 |
| anti-influenza_CDR | 6580 | 14222, 21864, 29506, 37148, 44790, 52432, 60074 |
| anti-influenza_CDR | 6581 | 14223, 21865, 29507, 37149, 44791, 52433, 60075 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
| --- | --- | --- |
| anti-influenza_CDR | 6582 | 14224, 21866, 29508, 37150, 44792, 52434, 60076 |
| anti-influenza_CDR | 6583 | 14225, 21867, 29509, 37151, 44793, 52435, 60077 |
| anti-influenza_CDR | 6584 | 14226, 21868, 29510, 37152, 44794, 52436, 60078 |
| anti-influenza_CDR | 6585 | 14227, 21869, 29511, 37153, 44795, 52437, 60079 |
| anti-influenza_CDR | 6586 | 14228, 21870, 29512, 37154, 44796, 52438, 60080 |
| anti-influenza_CDR | 6587 | 14229, 21871, 29513, 37155, 44797, 52439, 60081 |
| anti-influenza_CDR | 6588 | 14230, 21872, 29514, 37156, 44798, 52440, 60082 |
| anti-influenza_CDR | 6589 | 14231, 21873, 29515, 37157, 44799, 52441, 60083 |
| anti-influenza_CDR | 6590 | 14232, 21874, 29516, 37158, 44800, 52442, 60084 |
| anti-influenza_CDR | 6591 | 14233, 21875, 29517, 37159, 44801, 52443, 60085 |
| anti-influenza_CDR | 6592 | 14234, 21876, 29518, 37160, 44802, 52444, 60086 |
| anti-influenza_CDR | 6593 | 14235, 21877, 29519, 37161, 44803, 52445, 60087 |
| anti-influenza_CDR | 6594 | 14236, 21878, 29520, 37162, 44804, 52446, 60088 |
| anti-influenza_CDR | 6595 | 14237, 21879, 29521, 37163, 44805, 52447, 60089 |
| anti-influenza_CDR | 6596 | 14238, 21880, 29522, 37164, 44806, 52448, 60090 |
| anti-influenza_CDR | 6597 | 14239, 21881, 29523, 37165, 44807, 52449, 60091 |
| anti-influenza_CDR | 6598 | 14240, 21882, 29524, 37166, 44808, 52450, 60092 |
| anti-influenza_CDR | 6599 | 14241, 21883, 29525, 37167, 44809, 52451, 60093 |
| anti-influenza_CDR | 6600 | 14242, 21884, 29526, 37168, 44810, 52452, 60094 |
| anti-influenza_CDR | 6601 | 14243, 21885, 29527, 37169, 44811, 52453, 60095 |
| anti-influenza_CDR | 6602 | 14244, 21886, 29528, 37170, 44812, 52454, 60096 |
| anti-influenza_CDR | 6603 | 14245, 21887, 29529, 37171, 44813, 52455, 60097 |
| anti-influenza_CDR | 6604 | 14246, 21888, 29530, 37172, 44814, 52456, 60098 |
| anti-influenza_CDR | 6605 | 14247, 21889, 29531, 37173, 44815, 52457, 60099 |
| anti-influenza_CDR | 6606 | 14248, 21890, 29532, 37174, 44816, 52458, 60100 |
| anti-influenza_CDR | 6607 | 14249, 21891, 29533, 37175, 44817, 52459, 60101 |
| anti-influenza_CDR | 6608 | 14250, 21892, 29534, 37176, 44818, 52460, 60102 |
| anti-influenza_CDR | 6609 | 14251, 21893, 29535, 37177, 44819, 52461, 60103 |
| anti-influenza_CDR | 6610 | 14252, 21894, 29536, 37178, 44820, 52462, 60104 |
| anti-influenza_CDR | 6611 | 14253, 21895, 29537, 37179, 44821, 52463, 60105 |
| anti-influenza_CDR | 6612 | 14254, 21896, 29538, 37180, 44822, 52464, 60106 |
| anti-influenza_CDR | 6613 | 14255, 21897, 29539, 37181, 44823, 52465, 60107 |
| anti-influenza_CDR | 6614 | 14256, 21898, 29540, 37182, 44824, 52466, 60108 |
| anti-influenza_CDR | 6615 | 14257, 21899, 29541, 37183, 44825, 52467, 60109 |
| anti-influenza_CDR | 6616 | 14258, 21900, 29542, 37184, 44826, 52468, 60110 |
| anti-influenza_CDR | 6617 | 14259, 21901, 29543, 37185, 44827, 52469, 60111 |
| anti-influenza_CDR | 6618 | 14260, 21902, 29544, 37186, 44828, 52470, 60112 |
| anti-influenza_CDR | 6619 | 14261, 21903, 29545, 37187, 44829, 52471, 60113 |
| anti-influenza_CDR | 6620 | 14262, 21904, 29546, 37188, 44830, 52472, 60114 |
| anti-influenza_CDR | 6621 | 14263, 21905, 29547, 37189, 44831, 52473, 60115 |
| anti-influenza_CDR | 6622 | 14264, 21906, 29548, 37190, 44832, 52474, 60116 |
| anti-influenza_CDR | 6623 | 14265, 21907, 29549, 37191, 44833, 52475, 60117 |
| anti-influenza_CDR | 6624 | 14266, 21908, 29550, 37192, 44834, 52476, 60118 |
| anti-influenza_CDR | 6625 | 14267, 21909, 29551, 37193, 44835, 52477, 60119 |
| anti-influenza_CDR | 6626 | 14268, 21910, 29552, 37194, 44836, 52478, 60120 |
| anti-influenza_CDR | 6627 | 14269, 21911, 29553, 37195, 44837, 52479, 60121 |
| anti-influenza_CDR | 6628 | 14270, 21912, 29554, 37196, 44838, 52480, 60122 |
| anti-influenza_CDR | 6629 | 14271, 21913, 29555, 37197, 44839, 52481, 60123 |
| anti-influenza_CDR | 6630 | 14272, 21914, 29556, 37198, 44840, 52482, 60124 |
| anti-influenza_CDR | 6631 | 14273, 21915, 29557, 37199, 44841, 52483, 60125 |
| anti-influenza_CDR | 6632 | 14274, 21916, 29558, 37200, 44842, 52484, 60126 |
| anti-influenza_CDR | 6633 | 14275, 21917, 29559, 37201, 44843, 52485, 60127 |
| anti-influenza_CDR | 6634 | 14276, 21918, 29560, 37202, 44844, 52486, 60128 |
| anti-influenza_CDR | 6635 | 14277, 21919, 29561, 37203, 44845, 52487, 60129 |
| anti-influenza_CDR | 6636 | 14278, 21920, 29562, 37204, 44846, 52488, 60130 |
| anti-influenza_CDR | 6637 | 14279, 21921, 29563, 37205, 44847, 52489, 60131 |
| anti-influenza_CDR | 6638 | 14280, 21922, 29564, 37206, 44848, 52490, 60132 |
| anti-influenza_CDR | 6639 | 14281, 21923, 29565, 37207, 44849, 52491, 60133 |
| anti-influenza_CDR | 6640 | 14282, 21924, 29566, 37208, 44850, 52492, 60134 |
| anti-influenza_CDR | 6641 | 14283, 21925, 29567, 37209, 44851, 52493, 60135 |
| anti-influenza_CDR | 6642 | 14284, 21926, 29568, 37210, 44852, 52494, 60136 |
| anti-influenza_CDR | 6643 | 14285, 21927, 29569, 37211, 44853, 52495, 60137 |
| anti-influenza_CDR | 6644 | 14286, 21928, 29570, 37212, 44854, 52496, 60138 |
| anti-influenza_CDR | 6645 | 14287, 21929, 29571, 37213, 44855, 52497, 60139 |
| anti-influenza_CDR | 6646 | 14288, 21930, 29572, 37214, 44856, 52498, 60140 |
| anti-influenza_CDR | 6647 | 14289, 21931, 29573, 37215, 44857, 52499, 60141 |
| anti-influenza_CDR | 6648 | 14290, 21932, 29574, 37216, 44858, 52500, 60142 |
| anti-influenza_CDR | 6649 | 14291, 21933, 29575, 37217, 44859, 52501, 60143 |
| anti-influenza_CDR | 6650 | 14292, 21934, 29576, 37218, 44860, 52502, 60144 |
| anti-influenza_CDR | 6651 | 14293, 21935, 29577, 37219, 44861, 52503, 60145 |
| anti-influenza_CDR | 6652 | 14294, 21936, 29578, 37220, 44862, 52504, 60146 |
| anti-influenza_CDR | 6653 | 14295, 21937, 29579, 37221, 44863, 52505, 60147 |
| anti-influenza_CDR | 6654 | 14296, 21938, 29580, 37222, 44864, 52506, 60148 |
| anti-influenza_CDR | 6655 | 14297, 21939, 29581, 37223, 44865, 52507, 60149 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 6656 | 14298, 21940, 29582, 37224, 44866, 52508, 60150 |
| anti-influenza_CDR | 6657 | 14299, 21941, 29583, 37225, 44867, 52509, 60151 |
| anti-influenza_CDR | 6658 | 14300, 21942, 29584, 37226, 44868, 52510, 60152 |
| anti-influenza_CDR | 6659 | 14301, 21943, 29585, 37227, 44869, 52511, 60153 |
| anti-influenza_CDR | 6660 | 14302, 21944, 29586, 37228, 44870, 52512, 60154 |
| anti-influenza_CDR | 6661 | 14303, 21945, 29587, 37229, 44871, 52513, 60155 |
| anti-influenza_CDR | 6662 | 14304, 21946, 29588, 37230, 44872, 52514, 60156 |
| anti-influenza_CDR | 6663 | 14305, 21947, 29589, 37231, 44873, 52515, 60157 |
| anti-influenza_CDR | 6664 | 14306, 21948, 29590, 37232, 44874, 52516, 60158 |
| anti-influenza_CDR | 6665 | 14307, 21949, 29591, 37233, 44875, 52517, 60159 |
| anti-influenza_CDR | 6666 | 14308, 21950, 29592, 37234, 44876, 52518, 60160 |
| anti-influenza_CDR | 6667 | 14309, 21951, 29593, 37235, 44877, 52519, 60161 |
| anti-influenza_CDR | 6668 | 14310, 21952, 29594, 37236, 44878, 52520, 60162 |
| anti-influenza_CDR | 6669 | 14311, 21953, 29595, 37237, 44879, 52521, 60163 |
| anti-influenza_CDR | 6670 | 14312, 21954, 29596, 37238, 44880, 52522, 60164 |
| anti-influenza_CDR | 6671 | 14313, 21955, 29597, 37239, 44881, 52523, 60165 |
| anti-influenza_CDR | 6672 | 14314, 21956, 29598, 37240, 44882, 52524, 60166 |
| anti-influenza_CDR | 6673 | 14315, 21957, 29599, 37241, 44883, 52525, 60167 |
| anti-influenza_CDR | 6674 | 14316, 21958, 29600, 37242, 44884, 52526, 60168 |
| anti-influenza_CDR | 6675 | 14317, 21959, 29601, 37243, 44885, 52527, 60169 |
| anti-influenza_CDR | 6676 | 14318, 21960, 29602, 37244, 44886, 52528, 60170 |
| anti-influenza_CDR | 6677 | 14319, 21961, 29603, 37245, 44887, 52529, 60171 |
| anti-influenza_CDR | 6678 | 14320, 21962, 29604, 37246, 44888, 52530, 60172 |
| anti-influenza_CDR | 6679 | 14321, 21963, 29605, 37247, 44889, 52531, 60173 |
| anti-influenza_CDR | 6680 | 14322, 21964, 29606, 37248, 44890, 52532, 60174 |
| anti-influenza_CDR | 6681 | 14323, 21965, 29607, 37249, 44891, 52533, 60175 |
| anti-influenza_CDR | 6682 | 14324, 21966, 29608, 37250, 44892, 52534, 60176 |
| anti-influenza_CDR | 6683 | 14325, 21967, 29609, 37251, 44893, 52535, 60177 |
| anti-influenza_CDR | 6684 | 14326, 21968, 29610, 37252, 44894, 52536, 60178 |
| anti-influenza_CDR | 6685 | 14327, 21969, 29611, 37253, 44895, 52537, 60179 |
| anti-influenza_CDR | 6686 | 14328, 21970, 29612, 37254, 44896, 52538, 60180 |
| anti-influenza_CDR | 6687 | 14329, 21971, 29613, 37255, 44897, 52539, 60181 |
| anti-influenza_CDR | 6688 | 14330, 21972, 29614, 37256, 44898, 52540, 60182 |
| anti-influenza_CDR | 6689 | 14331, 21973, 29615, 37257, 44899, 52541, 60183 |
| anti-influenza_CDR | 6690 | 14332, 21974, 29616, 37258, 44900, 52542, 60184 |
| anti-influenza_CDR | 6691 | 14333, 21975, 29617, 37259, 44901, 52543, 60185 |
| anti-influenza_CDR | 6692 | 14334, 21976, 29618, 37260, 44902, 52544, 60186 |
| anti-influenza_CDR | 6693 | 14335, 21977, 29619, 37261, 44903, 52545, 60187 |
| anti-influenza_CDR | 6694 | 14336, 21978, 29620, 37262, 44904, 52546, 60188 |
| anti-influenza_CDR | 6695 | 14337, 21979, 29621, 37263, 44905, 52547, 60189 |
| anti-influenza_CDR | 6696 | 14338, 21980, 29622, 37264, 44906, 52548, 60190 |
| anti-influenza_CDR | 6697 | 14339, 21981, 29623, 37265, 44907, 52549, 60191 |
| anti-influenza_CDR | 6698 | 14340, 21982, 29624, 37266, 44908, 52550, 60192 |
| anti-influenza_CDR | 6699 | 14341, 21983, 29625, 37267, 44909, 52551, 60193 |
| anti-influenza_CDR | 6700 | 14342, 21984, 29626, 37268, 44910, 52552, 60194 |
| anti-influenza_CDR | 6701 | 14343, 21985, 29627, 37269, 44911, 52553, 60195 |
| anti-influenza_CDR | 6702 | 14344, 21986, 29628, 37270, 44912, 52554, 60196 |
| anti-influenza_CDR | 6703 | 14345, 21987, 29629, 37271, 44913, 52555, 60197 |
| anti-influenza_CDR | 6704 | 14346, 21988, 29630, 37272, 44914, 52556, 60198 |
| anti-influenza_CDR | 6705 | 14347, 21989, 29631, 37273, 44915, 52557, 60199 |
| anti-influenza_CDR | 6706 | 14348, 21990, 29632, 37274, 44916, 52558, 60200 |
| anti-influenza_CDR | 6707 | 14349, 21991, 29633, 37275, 44917, 52559, 60201 |
| anti-influenza_CDR | 6708 | 14350, 21992, 29634, 37276, 44918, 52560, 60202 |
| anti-influenza_CDR | 6709 | 14351, 21993, 29635, 37277, 44919, 52561, 60203 |
| anti-influenza_CDR | 6710 | 14352, 21994, 29636, 37278, 44920, 52562, 60204 |
| anti-influenza_CDR | 6711 | 14353, 21995, 29637, 37279, 44921, 52563, 60205 |
| anti-influenza_CDR | 6712 | 14354, 21996, 29638, 37280, 44922, 52564, 60206 |
| anti-influenza_CDR | 6713 | 14355, 21997, 29639, 37281, 44923, 52565, 60207 |
| anti-influenza_CDR | 6714 | 14356, 21998, 29640, 37282, 44924, 52566, 60208 |
| anti-influenza_CDR | 6715 | 14357, 21999, 29641, 37283, 44925, 52567, 60209 |
| anti-influenza_CDR | 6716 | 14358, 22000, 29642, 37284, 44926, 52568, 60210 |
| anti-influenza_CDR | 6717 | 14359, 22001, 29643, 37285, 44927, 52569, 60211 |
| anti-influenza_CDR | 6718 | 14360, 22002, 29644, 37286, 44928, 52570, 60212 |
| anti-influenza_CDR | 6719 | 14361, 22003, 29645, 37287, 44929, 52571, 60213 |
| anti-influenza_CDR | 6720 | 14362, 22004, 29646, 37288, 44930, 52572, 60214 |
| anti-influenza_CDR | 6721 | 14363, 22005, 29647, 37289, 44931, 52573, 60215 |
| anti-influenza_CDR | 6722 | 14364, 22006, 29648, 37290, 44932, 52574, 60216 |
| anti-influenza_CDR | 6723 | 14365, 22007, 29649, 37291, 44933, 52575, 60217 |
| anti-influenza_CDR | 6724 | 14366, 22008, 29650, 37292, 44934, 52576, 60218 |
| anti-influenza_CDR | 6725 | 14367, 22009, 29651, 37293, 44935, 52577, 60219 |
| anti-influenza_CDR | 6726 | 14368, 22010, 29652, 37294, 44936, 52578, 60220 |
| anti-influenza_CDR | 6727 | 14369, 22011, 29653, 37295, 44937, 52579, 60221 |
| anti-influenza_CDR | 6728 | 14370, 22012, 29654, 37296, 44938, 52580, 60222 |
| anti-influenza_CDR | 6729 | 14371, 22013, 29655, 37297, 44939, 52581, 60223 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 6730 | 14372, 22014, 29656, 37298, 44940, 52582, 60224 |
| anti-influenza_CDR | 6731 | 14373, 22015, 29657, 37299, 44941, 52583, 60225 |
| anti-influenza_CDR | 6732 | 14374, 22016, 29658, 37300, 44942, 52584, 60226 |
| anti-influenza_CDR | 6733 | 14375, 22017, 29659, 37301, 44943, 52585, 60227 |
| anti-influenza_CDR | 6734 | 14376, 22018, 29660, 37302, 44944, 52586, 60228 |
| anti-influenza_CDR | 6735 | 14377, 22019, 29661, 37303, 44945, 52587, 60229 |
| anti-influenza_CDR | 6736 | 14378, 22020, 29662, 37304, 44946, 52588, 60230 |
| anti-influenza_CDR | 6737 | 14379, 22021, 29663, 37305, 44947, 52589, 60231 |
| anti-influenza_CDR | 6738 | 14380, 22022, 29664, 37306, 44948, 52590, 60232 |
| anti-influenza_CDR | 6739 | 14381, 22023, 29665, 37307, 44949, 52591, 60233 |
| anti-influenza_CDR | 6740 | 14382, 22024, 29666, 37308, 44950, 52592, 60234 |
| anti-influenza_CDR | 6741 | 14383, 22025, 29667, 37309, 44951, 52593, 60235 |
| anti-influenza_CDR | 6742 | 14384, 22026, 29668, 37310, 44952, 52594, 60236 |
| anti-influenza_CDR | 6743 | 14385, 22027, 29669, 37311, 44953, 52595, 60237 |
| anti-influenza_CDR | 6744 | 14386, 22028, 29670, 37312, 44954, 52596, 60238 |
| anti-influenza_CDR | 6745 | 14387, 22029, 29671, 37313, 44955, 52597, 60239 |
| anti-influenza_CDR | 6746 | 14388, 22030, 29672, 37314, 44956, 52598, 60240 |
| anti-influenza_CDR | 6747 | 14389, 22031, 29673, 37315, 44957, 52599, 60241 |
| anti-influenza_CDR | 6748 | 14390, 22032, 29674, 37316, 44958, 52600, 60242 |
| anti-influenza_CDR | 6749 | 14391, 22033, 29675, 37317, 44959, 52601, 60243 |
| anti-influenza_CDR | 6750 | 14392, 22034, 29676, 37318, 44960, 52602, 60244 |
| anti-influenza_CDR | 6751 | 14393, 22035, 29677, 37319, 44961, 52603, 60245 |
| anti-influenza_CDR | 6752 | 14394, 22036, 29678, 37320, 44962, 52604, 60246 |
| anti-influenza_CDR | 6753 | 14395, 22037, 29679, 37321, 44963, 52605, 60247 |
| anti-influenza_CDR | 6754 | 14396, 22038, 29680, 37322, 44964, 52606, 60248 |
| anti-influenza_CDR | 6755 | 14397, 22039, 29681, 37323, 44965, 52607, 60249 |
| anti-influenza_CDR | 6756 | 14398, 22040, 29682, 37324, 44966, 52608, 60250 |
| anti-influenza_CDR | 6757 | 14399, 22041, 29683, 37325, 44967, 52609, 60251 |
| anti-influenza_CDR | 6758 | 14400, 22042, 29684, 37326, 44968, 52610, 60252 |
| anti-influenza_CDR | 6759 | 14401, 22043, 29685, 37327, 44969, 52611, 60253 |
| anti-influenza_CDR | 6760 | 14402, 22044, 29686, 37328, 44970, 52612, 60254 |
| anti-influenza_CDR | 6761 | 14403, 22045, 29687, 37329, 44971, 52613, 60255 |
| anti-influenza_CDR | 6762 | 14404, 22046, 29688, 37330, 44972, 52614, 60256 |
| anti-influenza_CDR | 6763 | 14405, 22047, 29689, 37331, 44973, 52615, 60257 |
| anti-influenza_CDR | 6764 | 14406, 22048, 29690, 37332, 44974, 52616, 60258 |
| anti-influenza_CDR | 6765 | 14407, 22049, 29691, 37333, 44975, 52617, 60259 |
| anti-influenza_CDR | 6766 | 14408, 22050, 29692, 37334, 44976, 52618, 60260 |
| anti-influenza_CDR | 6767 | 14409, 22051, 29693, 37335, 44977, 52619, 60261 |
| anti-influenza_CDR | 6768 | 14410, 22052, 29694, 37336, 44978, 52620, 60262 |
| anti-influenza_CDR | 6769 | 14411, 22053, 29695, 37337, 44979, 52621, 60263 |
| anti-influenza_CDR | 6770 | 14412, 22054, 29696, 37338, 44980, 52622, 60264 |
| anti-influenza_CDR | 6771 | 14413, 22055, 29697, 37339, 44981, 52623, 60265 |
| anti-influenza_CDR | 6772 | 14414, 22056, 29698, 37340, 44982, 52624, 60266 |
| anti-influenza_CDR | 6773 | 14415, 22057, 29699, 37341, 44983, 52625, 60267 |
| anti-influenza_CDR | 6774 | 14416, 22058, 29700, 37342, 44984, 52626, 60268 |
| anti-influenza_CDR | 6775 | 14417, 22059, 29701, 37343, 44985, 52627, 60269 |
| anti-influenza_CDR | 6776 | 14418, 22060, 29702, 37344, 44986, 52628, 60270 |
| anti-influenza_CDR | 6777 | 14419, 22061, 29703, 37345, 44987, 52629, 60271 |
| anti-influenza_CDR | 6778 | 14420, 22062, 29704, 37346, 44988, 52630, 60272 |
| anti-influenza_CDR | 6779 | 14421, 22063, 29705, 37347, 44989, 52631, 60273 |
| anti-influenza_CDR | 6780 | 14422, 22064, 29706, 37348, 44990, 52632, 60274 |
| anti-influenza_CDR | 6781 | 14423, 22065, 29707, 37349, 44991, 52633, 60275 |
| anti-influenza_CDR | 6782 | 14424, 22066, 29708, 37350, 44992, 52634, 60276 |
| anti-influenza_CDR | 6783 | 14425, 22067, 29709, 37351, 44993, 52635, 60277 |
| anti-influenza_CDR | 6784 | 14426, 22068, 29710, 37352, 44994, 52636, 60278 |
| anti-influenza_CDR | 6785 | 14427, 22069, 29711, 37353, 44995, 52637, 60279 |
| anti-influenza_CDR | 6786 | 14428, 22070, 29712, 37354, 44996, 52638, 60280 |
| anti-influenza_CDR | 6787 | 14429, 22071, 29713, 37355, 44997, 52639, 60281 |
| anti-influenza_CDR | 6788 | 14430, 22072, 29714, 37356, 44998, 52640, 60282 |
| anti-influenza_CDR | 6789 | 14431, 22073, 29715, 37357, 44999, 52641, 60283 |
| anti-influenza_CDR | 6790 | 14432, 22074, 29716, 37358, 45000, 52642, 60284 |
| anti-influenza_CDR | 6791 | 14433, 22075, 29717, 37359, 45001, 52643, 60285 |
| anti-influenza_CDR | 6792 | 14434, 22076, 29718, 37360, 45002, 52644, 60286 |
| anti-influenza_CDR | 6793 | 14435, 22077, 29719, 37361, 45003, 52645, 60287 |
| anti-influenza_CDR | 6794 | 14436, 22078, 29720, 37362, 45004, 52646, 60288 |
| anti-influenza_CDR | 6795 | 14437, 22079, 29721, 37363, 45005, 52647, 60289 |
| anti-influenza_CDR | 6796 | 14438, 22080, 29722, 37364, 45006, 52648, 60290 |
| anti-influenza_CDR | 6797 | 14439, 22081, 29723, 37365, 45007, 52649, 60291 |
| anti-influenza_CDR | 6798 | 14440, 22082, 29724, 37366, 45008, 52650, 60292 |
| anti-influenza_CDR | 6799 | 14441, 22083, 29725, 37367, 45009, 52651, 60293 |
| anti-influenza_CDR | 6800 | 14442, 22084, 29726, 37368, 45010, 52652, 60294 |
| anti-influenza_CDR | 6801 | 14443, 22085, 29727, 37369, 45011, 52653, 60295 |
| anti-influenza_CDR | 6802 | 14444, 22086, 29728, 37370, 45012, 52654, 60296 |
| anti-influenza_CDR | 6803 | 14445, 22087, 29729, 37371, 45013, 52655, 60297 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 6804 | 14446, 22088, 29730, 37372, 45014, 52656, 60298 |
| anti-influenza_CDR | 6805 | 14447, 22089, 29731, 37373, 45015, 52657, 60299 |
| anti-influenza_CDR | 6806 | 14448, 22090, 29732, 37374, 45016, 52658, 60300 |
| anti-influenza_CDR | 6807 | 14449, 22091, 29733, 37375, 45017, 52659, 60301 |
| anti-influenza_CDR | 6808 | 14450, 22092, 29734, 37376, 45018, 52660, 60302 |
| anti-influenza_CDR | 6809 | 14451, 22093, 29735, 37377, 45019, 52661, 60303 |
| anti-influenza_CDR | 6810 | 14452, 22094, 29736, 37378, 45020, 52662, 60304 |
| anti-influenza_CDR | 6811 | 14453, 22095, 29737, 37379, 45021, 52663, 60305 |
| anti-influenza_CDR | 6812 | 14454, 22096, 29738, 37380, 45022, 52664, 60306 |
| anti-influenza_CDR | 6813 | 14455, 22097, 29739, 37381, 45023, 52665, 60307 |
| anti-influenza_CDR | 6814 | 14456, 22098, 29740, 37382, 45024, 52666, 60308 |
| anti-influenza_CDR | 6815 | 14457, 22099, 29741, 37383, 45025, 52667, 60309 |
| anti-influenza_CDR | 6816 | 14458, 22100, 29742, 37384, 45026, 52668, 60310 |
| anti-influenza_CDR | 6817 | 14459, 22101, 29743, 37385, 45027, 52669, 60311 |
| anti-influenza_CDR | 6818 | 14460, 22102, 29744, 37386, 45028, 52670, 60312 |
| anti-influenza_CDR | 6819 | 14461, 22103, 29745, 37387, 45029, 52671, 60313 |
| anti-influenza_CDR | 6820 | 14462, 22104, 29746, 37388, 45030, 52672, 60314 |
| anti-influenza_CDR | 6821 | 14463, 22105, 29747, 37389, 45031, 52673, 60315 |
| anti-influenza_CDR | 6822 | 14464, 22106, 29748, 37390, 45032, 52674, 60316 |
| anti-influenza_CDR | 6823 | 14465, 22107, 29749, 37391, 45033, 52675, 60317 |
| anti-influenza_CDR | 6824 | 14466, 22108, 29750, 37392, 45034, 52676, 60318 |
| anti-influenza_CDR | 6825 | 14467, 22109, 29751, 37393, 45035, 52677, 60319 |
| anti-influenza_CDR | 6826 | 14468, 22110, 29752, 37394, 45036, 52678, 60320 |
| anti-influenza_CDR | 6827 | 14469, 22111, 29753, 37395, 45037, 52679, 60321 |
| anti-influenza_CDR | 6828 | 14470, 22112, 29754, 37396, 45038, 52680, 60322 |
| anti-influenza_CDR | 6829 | 14471, 22113, 29755, 37397, 45039, 52681, 60323 |
| anti-influenza_CDR | 6830 | 14472, 22114, 29756, 37398, 45040, 52682, 60324 |
| anti-influenza_CDR | 6831 | 14473, 22115, 29757, 37399, 45041, 52683, 60325 |
| anti-influenza_CDR | 6832 | 14474, 22116, 29758, 37400, 45042, 52684, 60326 |
| anti-influenza_CDR | 6833 | 14475, 22117, 29759, 37401, 45043, 52685, 60327 |
| anti-influenza_CDR | 6834 | 14476, 22118, 29760, 37402, 45044, 52686, 60328 |
| anti-influenza_CDR | 6835 | 14477, 22119, 29761, 37403, 45045, 52687, 60329 |
| anti-influenza_CDR | 6836 | 14478, 22120, 29762, 37404, 45046, 52688, 60330 |
| anti-influenza_CDR | 6837 | 14479, 22121, 29763, 37405, 45047, 52689, 60331 |
| anti-influenza_CDR | 6838 | 14480, 22122, 29764, 37406, 45048, 52690, 60332 |
| anti-influenza_CDR | 6839 | 14481, 22123, 29765, 37407, 45049, 52691, 60333 |
| anti-influenza_CDR | 6840 | 14482, 22124, 29766, 37408, 45050, 52692, 60334 |
| anti-influenza_CDR | 6841 | 14483, 22125, 29767, 37409, 45051, 52693, 60335 |
| anti-influenza_CDR | 6842 | 14484, 22126, 29768, 37410, 45052, 52694, 60336 |
| anti-influenza_CDR | 6843 | 14485, 22127, 29769, 37411, 45053, 52695, 60337 |
| anti-influenza_CDR | 6844 | 14486, 22128, 29770, 37412, 45054, 52696, 60338 |
| anti-influenza_CDR | 6845 | 14487, 22129, 29771, 37413, 45055, 52697, 60339 |
| anti-influenza_CDR | 6846 | 14488, 22130, 29772, 37414, 45056, 52698, 60340 |
| anti-influenza_CDR | 6847 | 14489, 22131, 29773, 37415, 45057, 52699, 60341 |
| anti-influenza_CDR | 6848 | 14490, 22132, 29774, 37416, 45058, 52700, 60342 |
| anti-influenza_CDR | 6849 | 14491, 22133, 29775, 37417, 45059, 52701, 60343 |
| anti-influenza_CDR | 6850 | 14492, 22134, 29776, 37418, 45060, 52702, 60344 |
| anti-influenza_CDR | 6851 | 14493, 22135, 29777, 37419, 45061, 52703, 60345 |
| anti-influenza_CDR | 6852 | 14494, 22136, 29778, 37420, 45062, 52704, 60346 |
| anti-influenza_CDR | 6853 | 14495, 22137, 29779, 37421, 45063, 52705, 60347 |
| anti-influenza_CDR | 6854 | 14496, 22138, 29780, 37422, 45064, 52706, 60348 |
| anti-influenza_CDR | 6855 | 14497, 22139, 29781, 37423, 45065, 52707, 60349 |
| anti-influenza_CDR | 6856 | 14498, 22140, 29782, 37424, 45066, 52708, 60350 |
| anti-influenza_CDR | 6857 | 14499, 22141, 29783, 37425, 45067, 52709, 60351 |
| anti-influenza_CDR | 6858 | 14500, 22142, 29784, 37426, 45068, 52710, 60352 |
| anti-influenza_CDR | 6859 | 14501, 22143, 29785, 37427, 45069, 52711, 60353 |
| anti-influenza_CDR | 6860 | 14502, 22144, 29786, 37428, 45070, 52712, 60354 |
| anti-influenza_CDR | 6861 | 14503, 22145, 29787, 37429, 45071, 52713, 60355 |
| anti-influenza_CDR | 6862 | 14504, 22146, 29788, 37430, 45072, 52714, 60356 |
| anti-influenza_CDR | 6863 | 14505, 22147, 29789, 37431, 45073, 52715, 60357 |
| anti-influenza_CDR | 6864 | 14506, 22148, 29790, 37432, 45074, 52716, 60358 |
| anti-influenza_CDR | 6865 | 14507, 22149, 29791, 37433, 45075, 52717, 60359 |
| anti-influenza_CDR | 6866 | 14508, 22150, 29792, 37434, 45076, 52718, 60360 |
| anti-influenza_CDR | 6867 | 14509, 22151, 29793, 37435, 45077, 52719, 60361 |
| anti-influenza_CDR | 6868 | 14510, 22152, 29794, 37436, 45078, 52720, 60362 |
| anti-influenza_CDR | 6869 | 14511, 22153, 29795, 37437, 45079, 52721, 60363 |
| anti-influenza_CDR | 6870 | 14512, 22154, 29796, 37438, 45080, 52722, 60364 |
| anti-influenza_CDR | 6871 | 14513, 22155, 29797, 37439, 45081, 52723, 60365 |
| anti-influenza_CDR | 6872 | 14514, 22156, 29798, 37440, 45082, 52724, 60366 |
| anti-influenza_CDR | 6873 | 14515, 22157, 29799, 37441, 45083, 52725, 60367 |
| anti-influenza_CDR | 6874 | 14516, 22158, 29800, 37442, 45084, 52726, 60368 |
| anti-influenza_CDR | 6875 | 14517, 22159, 29801, 37443, 45085, 52727, 60369 |
| anti-influenza_CDR | 6876 | 14518, 22160, 29802, 37444, 45086, 52728, 60370 |
| anti-influenza_CDR | 6877 | 14519, 22161, 29803, 37445, 45087, 52729, 60371 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 6878 | 14520, 22162, 29804, 37446, 45088, 52730, 60372 |
| anti-influenza_CDR | 6879 | 14521, 22163, 29805, 37447, 45089, 52731, 60373 |
| anti-influenza_CDR | 6880 | 14522, 22164, 29806, 37448, 45090, 52732, 60374 |
| anti-influenza_CDR | 6881 | 14523, 22165, 29807, 37449, 45091, 52733, 60375 |
| anti-influenza_CDR | 6882 | 14524, 22166, 29808, 37450, 45092, 52734, 60376 |
| anti-influenza_CDR | 6883 | 14525, 22167, 29809, 37451, 45093, 52735, 60377 |
| anti-influenza_CDR | 6884 | 14526, 22168, 29810, 37452, 45094, 52736, 60378 |
| anti-influenza_CDR | 6885 | 14527, 22169, 29811, 37453, 45095, 52737, 60379 |
| anti-influenza_CDR | 6886 | 14528, 22170, 29812, 37454, 45096, 52738, 60380 |
| anti-influenza_CDR | 6887 | 14529, 22171, 29813, 37455, 45097, 52739, 60381 |
| anti-influenza_CDR | 6888 | 14530, 22172, 29814, 37456, 45098, 52740, 60382 |
| anti-influenza_CDR | 6889 | 14531, 22173, 29815, 37457, 45099, 52741, 60383 |
| anti-influenza_CDR | 6890 | 14532, 22174, 29816, 37458, 45100, 52742, 60384 |
| anti-influenza_CDR | 6891 | 14533, 22175, 29817, 37459, 45101, 52743, 60385 |
| anti-influenza_CDR | 6892 | 14534, 22176, 29818, 37460, 45102, 52744, 60386 |
| anti-influenza_CDR | 6893 | 14535, 22177, 29819, 37461, 45103, 52745, 60387 |
| anti-influenza_CDR | 6894 | 14536, 22178, 29820, 37462, 45104, 52746, 60388 |
| anti-influenza_CDR | 6895 | 14537, 22179, 29821, 37463, 45105, 52747, 60389 |
| anti-influenza_CDR | 6896 | 14538, 22180, 29822, 37464, 45106, 52748, 60390 |
| anti-influenza_CDR | 6897 | 14539, 22181, 29823, 37465, 45107, 52749, 60391 |
| anti-influenza_CDR | 6898 | 14540, 22182, 29824, 37466, 45108, 52750, 60392 |
| anti-influenza_CDR | 6899 | 14541, 22183, 29825, 37467, 45109, 52751, 60393 |
| anti-influenza_CDR | 6900 | 14542, 22184, 29826, 37468, 45110, 52752, 60394 |
| anti-influenza_CDR | 6901 | 14543, 22185, 29827, 37469, 45111, 52753, 60395 |
| anti-influenza_CDR | 6902 | 14544, 22186, 29828, 37470, 45112, 52754, 60396 |
| anti-influenza_CDR | 6903 | 14545, 22187, 29829, 37471, 45113, 52755, 60397 |
| anti-influenza_CDR | 6904 | 14546, 22188, 29830, 37472, 45114, 52756, 60398 |
| anti-influenza_CDR | 6905 | 14547, 22189, 29831, 37473, 45115, 52757, 60399 |
| anti-influenza_CDR | 6906 | 14548, 22190, 29832, 37474, 45116, 52758, 60400 |
| anti-influenza_CDR | 6907 | 14549, 22191, 29833, 37475, 45117, 52759, 60401 |
| anti-influenza_CDR | 6908 | 14550, 22192, 29834, 37476, 45118, 52760, 60402 |
| anti-influenza_CDR | 6909 | 14551, 22193, 29835, 37477, 45119, 52761, 60403 |
| anti-influenza_CDR | 6910 | 14552, 22194, 29836, 37478, 45120, 52762, 60404 |
| anti-influenza_CDR | 6911 | 14553, 22195, 29837, 37479, 45121, 52763, 60405 |
| anti-influenza_CDR | 6912 | 14554, 22196, 29838, 37480, 45122, 52764, 60406 |
| anti-influenza_CDR | 6913 | 14555, 22197, 29839, 37481, 45123, 52765, 60407 |
| anti-influenza_CDR | 6914 | 14556, 22198, 29840, 37482, 45124, 52766, 60408 |
| anti-influenza_CDR | 6915 | 14557, 22199, 29841, 37483, 45125, 52767, 60409 |
| anti-influenza_CDR | 6916 | 14558, 22200, 29842, 37484, 45126, 52768, 60410 |
| anti-influenza_CDR | 6917 | 14559, 22201, 29843, 37485, 45127, 52769, 60411 |
| anti-influenza_CDR | 6918 | 14560, 22202, 29844, 37486, 45128, 52770, 60412 |
| anti-influenza_CDR | 6919 | 14561, 22203, 29845, 37487, 45129, 52771, 60413 |
| anti-influenza_CDR | 6920 | 14562, 22204, 29846, 37488, 45130, 52772, 60414 |
| anti-influenza_CDR | 6921 | 14563, 22205, 29847, 37489, 45131, 52773, 60415 |
| anti-influenza_CDR | 6922 | 14564, 22206, 29848, 37490, 45132, 52774, 60416 |
| anti-influenza_CDR | 6923 | 14565, 22207, 29849, 37491, 45133, 52775, 60417 |
| anti-influenza_CDR | 6924 | 14566, 22208, 29850, 37492, 45134, 52776, 60418 |
| anti-influenza_CDR | 6925 | 14567, 22209, 29851, 37493, 45135, 52777, 60419 |
| anti-influenza_CDR | 6926 | 14568, 22210, 29852, 37494, 45136, 52778, 60420 |
| anti-influenza_CDR | 6927 | 14569, 22211, 29853, 37495, 45137, 52779, 60421 |
| anti-influenza_CDR | 6928 | 14570, 22212, 29854, 37496, 45138, 52780, 60422 |
| anti-influenza_CDR | 6929 | 14571, 22213, 29855, 37497, 45139, 52781, 60423 |
| anti-influenza_CDR | 6930 | 14572, 22214, 29856, 37498, 45140, 52782, 60424 |
| anti-influenza_CDR | 6931 | 14573, 22215, 29857, 37499, 45141, 52783, 60425 |
| anti-influenza_CDR | 6932 | 14574, 22216, 29858, 37500, 45142, 52784, 60426 |
| anti-influenza_CDR | 6933 | 14575, 22217, 29859, 37501, 45143, 52785, 60427 |
| anti-influenza_CDR | 6934 | 14576, 22218, 29860, 37502, 45144, 52786, 60428 |
| anti-influenza_CDR | 6935 | 14577, 22219, 29861, 37503, 45145, 52787, 60429 |
| anti-influenza_CDR | 6936 | 14578, 22220, 29862, 37504, 45146, 52788, 60430 |
| anti-influenza_CDR | 6937 | 14579, 22221, 29863, 37505, 45147, 52789, 60431 |
| anti-influenza_CDR | 6938 | 14580, 22222, 29864, 37506, 45148, 52790, 60432 |
| anti-influenza_CDR | 6939 | 14581, 22223, 29865, 37507, 45149, 52791, 60433 |
| anti-influenza_CDR | 6940 | 14582, 22224, 29866, 37508, 45150, 52792, 60434 |
| anti-influenza_CDR | 6941 | 14583, 22225, 29867, 37509, 45151, 52793, 60435 |
| anti-influenza_CDR | 6942 | 14584, 22226, 29868, 37510, 45152, 52794, 60436 |
| anti-influenza_CDR | 6943 | 14585, 22227, 29869, 37511, 45153, 52795, 60437 |
| anti-influenza_CDR | 6944 | 14586, 22228, 29870, 37512, 45154, 52796, 60438 |
| anti-influenza_CDR | 6945 | 14587, 22229, 29871, 37513, 45155, 52797, 60439 |
| anti-influenza_CDR | 6946 | 14588, 22230, 29872, 37514, 45156, 52798, 60440 |
| anti-influenza_CDR | 6947 | 14589, 22231, 29873, 37515, 45157, 52799, 60441 |
| anti-influenza_CDR | 6948 | 14590, 22232, 29874, 37516, 45158, 52800, 60442 |
| anti-influenza_CDR | 6949 | 14591, 22233, 29875, 37517, 45159, 52801, 60443 |
| anti-influenza_CDR | 6950 | 14592, 22234, 29876, 37518, 45160, 52802, 60444 |
| anti-influenza_CDR | 6951 | 14593, 22235, 29877, 37519, 45161, 52803, 60445 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 6952 | 14594, 22236, 29878, 37520, 45162, 52804, 60446 |
| anti-influenza_CDR | 6953 | 14595, 22237, 29879, 37521, 45163, 52805, 60447 |
| anti-influenza_CDR | 6954 | 14596, 22238, 29880, 37522, 45164, 52806, 60448 |
| anti-influenza_CDR | 6955 | 14597, 22239, 29881, 37523, 45165, 52807, 60449 |
| anti-influenza_CDR | 6956 | 14598, 22240, 29882, 37524, 45166, 52808, 60450 |
| anti-influenza_CDR | 6957 | 14599, 22241, 29883, 37525, 45167, 52809, 60451 |
| anti-influenza_CDR | 6958 | 14600, 22242, 29884, 37526, 45168, 52810, 60452 |
| anti-influenza_CDR | 6959 | 14601, 22243, 29885, 37527, 45169, 52811, 60453 |
| anti-influenza_CDR | 6960 | 14602, 22244, 29886, 37528, 45170, 52812, 60454 |
| anti-influenza_CDR | 6961 | 14603, 22245, 29887, 37529, 45171, 52813, 60455 |
| anti-influenza_CDR | 6962 | 14604, 22246, 29888, 37530, 45172, 52814, 60456 |
| anti-influenza_CDR | 6963 | 14605, 22247, 29889, 37531, 45173, 52815, 60457 |
| anti-influenza_CDR | 6964 | 14606, 22248, 29890, 37532, 45174, 52816, 60458 |
| anti-influenza_CDR | 6965 | 14607, 22249, 29891, 37533, 45175, 52817, 60459 |
| anti-influenza_CDR | 6966 | 14608, 22250, 29892, 37534, 45176, 52818, 60460 |
| anti-influenza_CDR | 6967 | 14609, 22251, 29893, 37535, 45177, 52819, 60461 |
| anti-influenza_CDR | 6968 | 14610, 22252, 29894, 37536, 45178, 52820, 60462 |
| anti-influenza_CDR | 6969 | 14611, 22253, 29895, 37537, 45179, 52821, 60463 |
| anti-influenza_CDR | 6970 | 14612, 22254, 29896, 37538, 45180, 52822, 60464 |
| anti-influenza_CDR | 6971 | 14613, 22255, 29897, 37539, 45181, 52823, 60465 |
| anti-influenza_CDR | 6972 | 14614, 22256, 29898, 37540, 45182, 52824, 60466 |
| anti-influenza_CDR | 6973 | 14615, 22257, 29899, 37541, 45183, 52825, 60467 |
| anti-influenza_CDR | 6974 | 14616, 22258, 29900, 37542, 45184, 52826, 60468 |
| anti-influenza_CDR | 6975 | 14617, 22259, 29901, 37543, 45185, 52827, 60469 |
| anti-influenza_CDR | 6976 | 14618, 22260, 29902, 37544, 45186, 52828, 60470 |
| anti-influenza_CDR | 6977 | 14619, 22261, 29903, 37545, 45187, 52829, 60471 |
| anti-influenza_CDR | 6978 | 14620, 22262, 29904, 37546, 45188, 52830, 60472 |
| anti-influenza_CDR | 6979 | 14621, 22263, 29905, 37547, 45189, 52831, 60473 |
| anti-influenza_CDR | 6980 | 14622, 22264, 29906, 37548, 45190, 52832, 60474 |
| anti-influenza_CDR | 6981 | 14623, 22265, 29907, 37549, 45191, 52833, 60475 |
| anti-influenza_CDR | 6982 | 14624, 22266, 29908, 37550, 45192, 52834, 60476 |
| anti-influenza_CDR | 6983 | 14625, 22267, 29909, 37551, 45193, 52835, 60477 |
| anti-influenza_CDR | 6984 | 14626, 22268, 29910, 37552, 45194, 52836, 60478 |
| anti-influenza_CDR | 6985 | 14627, 22269, 29911, 37553, 45195, 52837, 60479 |
| anti-influenza_CDR | 6986 | 14628, 22270, 29912, 37554, 45196, 52838, 60480 |
| anti-influenza_CDR | 6987 | 14629, 22271, 29913, 37555, 45197, 52839, 60481 |
| anti-influenza_CDR | 6988 | 14630, 22272, 29914, 37556, 45198, 52840, 60482 |
| anti-influenza_CDR | 6989 | 14631, 22273, 29915, 37557, 45199, 52841, 60483 |
| anti-influenza_CDR | 6990 | 14632, 22274, 29916, 37558, 45200, 52842, 60484 |
| anti-influenza_CDR | 6991 | 14633, 22275, 29917, 37559, 45201, 52843, 60485 |
| anti-influenza_CDR | 6992 | 14634, 22276, 29918, 37560, 45202, 52844, 60486 |
| anti-influenza_CDR | 6993 | 14635, 22277, 29919, 37561, 45203, 52845, 60487 |
| anti-influenza_CDR | 6994 | 14636, 22278, 29920, 37562, 45204, 52846, 60488 |
| anti-influenza_CDR | 6995 | 14637, 22279, 29921, 37563, 45205, 52847, 60489 |
| anti-influenza_CDR | 6996 | 14638, 22280, 29922, 37564, 45206, 52848, 60490 |
| anti-influenza_CDR | 6997 | 14639, 22281, 29923, 37565, 45207, 52849, 60491 |
| anti-influenza_CDR | 6998 | 14640, 22282, 29924, 37566, 45208, 52850, 60492 |
| anti-influenza_CDR | 6999 | 14641, 22283, 29925, 37567, 45209, 52851, 60493 |
| anti-influenza_CDR | 7000 | 14642, 22284, 29926, 37568, 45210, 52852, 60494 |
| anti-influenza_CDR | 7001 | 14643, 22285, 29927, 37569, 45211, 52853, 60495 |
| anti-influenza_CDR | 7002 | 14644, 22286, 29928, 37570, 45212, 52854, 60496 |
| anti-influenza_CDR | 7003 | 14645, 22287, 29929, 37571, 45213, 52855, 60497 |
| anti-influenza_CDR | 7004 | 14646, 22288, 29930, 37572, 45214, 52856, 60498 |
| anti-influenza_CDR | 7005 | 14647, 22289, 29931, 37573, 45215, 52857, 60499 |
| anti-influenza_CDR | 7006 | 14648, 22290, 29932, 37574, 45216, 52858, 60500 |
| anti-influenza_CDR | 7007 | 14649, 22291, 29933, 37575, 45217, 52859, 60501 |
| anti-influenza_CDR | 7008 | 14650, 22292, 29934, 37576, 45218, 52860, 60502 |
| anti-influenza_CDR | 7009 | 14651, 22293, 29935, 37577, 45219, 52861, 60503 |
| anti-influenza_CDR | 7010 | 14652, 22294, 29936, 37578, 45220, 52862, 60504 |
| anti-influenza_CDR | 7011 | 14653, 22295, 29937, 37579, 45221, 52863, 60505 |
| anti-influenza_CDR | 7012 | 14654, 22296, 29938, 37580, 45222, 52864, 60506 |
| anti-influenza_CDR | 7013 | 14655, 22297, 29939, 37581, 45223, 52865, 60507 |
| anti-influenza_CDR | 7014 | 14656, 22298, 29940, 37582, 45224, 52866, 60508 |
| anti-influenza_CDR | 7015 | 14657, 22299, 29941, 37583, 45225, 52867, 60509 |
| anti-influenza_CDR | 7016 | 14658, 22300, 29942, 37584, 45226, 52868, 60510 |
| anti-influenza_CDR | 7017 | 14659, 22301, 29943, 37585, 45227, 52869, 60511 |
| anti-influenza_CDR | 7018 | 14660, 22302, 29944, 37586, 45228, 52870, 60512 |
| anti-influenza_CDR | 7019 | 14661, 22303, 29945, 37587, 45229, 52871, 60513 |
| anti-influenza_CDR | 7020 | 14662, 22304, 29946, 37588, 45230, 52872, 60514 |
| anti-influenza_CDR | 7021 | 14663, 22305, 29947, 37589, 45231, 52873, 60515 |
| anti-influenza_CDR | 7022 | 14664, 22306, 29948, 37590, 45232, 52874, 60516 |
| anti-influenza_CDR | 7023 | 14665, 22307, 29949, 37591, 45233, 52875, 60517 |
| anti-influenza_CDR | 7024 | 14666, 22308, 29950, 37592, 45234, 52876, 60518 |
| anti-influenza_CDR | 7025 | 14667, 22309, 29951, 37593, 45235, 52877, 60519 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
| --- | --- | --- |
| anti-influenza_CDR | 7026 | 14668, 22310, 29952, 37594, 45236, 52878, 60520 |
| anti-influenza_CDR | 7027 | 14669, 22311, 29953, 37595, 45237, 52879, 60521 |
| anti-influenza_CDR | 7028 | 14670, 22312, 29954, 37596, 45238, 52880, 60522 |
| anti-influenza_CDR | 7029 | 14671, 22313, 29955, 37597, 45239, 52881, 60523 |
| anti-influenza_CDR | 7030 | 14672, 22314, 29956, 37598, 45240, 52882, 60524 |
| anti-influenza_CDR | 7031 | 14673, 22315, 29957, 37599, 45241, 52883, 60525 |
| anti-influenza_CDR | 7032 | 14674, 22316, 29958, 37600, 45242, 52884, 60526 |
| anti-influenza_CDR | 7033 | 14675, 22317, 29959, 37601, 45243, 52885, 60527 |
| anti-influenza_CDR | 7034 | 14676, 22318, 29960, 37602, 45244, 52886, 60528 |
| anti-influenza_CDR | 7035 | 14677, 22319, 29961, 37603, 45245, 52887, 60529 |
| anti-influenza_CDR | 7036 | 14678, 22320, 29962, 37604, 45246, 52888, 60530 |
| anti-influenza_CDR | 7037 | 14679, 22321, 29963, 37605, 45247, 52889, 60531 |
| anti-influenza_CDR | 7038 | 14680, 22322, 29964, 37606, 45248, 52890, 60532 |
| anti-influenza_CDR | 7039 | 14681, 22323, 29965, 37607, 45249, 52891, 60533 |
| anti-influenza_CDR | 7040 | 14682, 22324, 29966, 37608, 45250, 52892, 60534 |
| anti-influenza_CDR | 7041 | 14683, 22325, 29967, 37609, 45251, 52893, 60535 |
| anti-influenza_CDR | 7042 | 14684, 22326, 29968, 37610, 45252, 52894, 60536 |
| anti-influenza_CDR | 7043 | 14685, 22327, 29969, 37611, 45253, 52895, 60537 |
| anti-influenza_CDR | 7044 | 14686, 22328, 29970, 37612, 45254, 52896, 60538 |
| anti-influenza_CDR | 7045 | 14687, 22329, 29971, 37613, 45255, 52897, 60539 |
| anti-influenza_CDR | 7046 | 14688, 22330, 29972, 37614, 45256, 52898, 60540 |
| anti-influenza_CDR | 7047 | 14689, 22331, 29973, 37615, 45257, 52899, 60541 |
| anti-influenza_CDR | 7048 | 14690, 22332, 29974, 37616, 45258, 52900, 60542 |
| anti-influenza_CDR | 7049 | 14691, 22333, 29975, 37617, 45259, 52901, 60543 |
| anti-influenza_CDR | 7050 | 14692, 22334, 29976, 37618, 45260, 52902, 60544 |
| anti-influenza_CDR | 7051 | 14693, 22335, 29977, 37619, 45261, 52903, 60545 |
| anti-influenza_CDR | 7052 | 14694, 22336, 29978, 37620, 45262, 52904, 60546 |
| anti-influenza_CDR | 7053 | 14695, 22337, 29979, 37621, 45263, 52905, 60547 |
| anti-influenza_CDR | 7054 | 14696, 22338, 29980, 37622, 45264, 52906, 60548 |
| anti-influenza_CDR | 7055 | 14697, 22339, 29981, 37623, 45265, 52907, 60549 |
| anti-influenza_CDR | 7056 | 14698, 22340, 29982, 37624, 45266, 52908, 60550 |
| anti-influenza_CDR | 7057 | 14699, 22341, 29983, 37625, 45267, 52909, 60551 |
| anti-influenza_CDR | 7058 | 14700, 22342, 29984, 37626, 45268, 52910, 60552 |
| anti-influenza_CDR | 7059 | 14701, 22343, 29985, 37627, 45269, 52911, 60553 |
| anti-influenza_CDR | 7060 | 14702, 22344, 29986, 37628, 45270, 52912, 60554 |
| anti-influenza_CDR | 7061 | 14703, 22345, 29987, 37629, 45271, 52913, 60555 |
| anti-influenza_CDR | 7062 | 14704, 22346, 29988, 37630, 45272, 52914, 60556 |
| anti-influenza_CDR | 7063 | 14705, 22347, 29989, 37631, 45273, 52915, 60557 |
| anti-influenza_CDR | 7064 | 14706, 22348, 29990, 37632, 45274, 52916, 60558 |
| anti-influenza_CDR | 7065 | 14707, 22349, 29991, 37633, 45275, 52917, 60559 |
| anti-influenza_CDR | 7066 | 14708, 22350, 29992, 37634, 45276, 52918, 60560 |
| anti-influenza_CDR | 7067 | 14709, 22351, 29993, 37635, 45277, 52919, 60561 |
| anti-influenza_CDR | 7068 | 14710, 22352, 29994, 37636, 45278, 52920, 60562 |
| anti-influenza_CDR | 7069 | 14711, 22353, 29995, 37637, 45279, 52921, 60563 |
| anti-influenza_CDR | 7070 | 14712, 22354, 29996, 37638, 45280, 52922, 60564 |
| anti-influenza_CDR | 7071 | 14713, 22355, 29997, 37639, 45281, 52923, 60565 |
| anti-influenza_CDR | 7072 | 14714, 22356, 29998, 37640, 45282, 52924, 60566 |
| anti-influenza_CDR | 7073 | 14715, 22357, 29999, 37641, 45283, 52925, 60567 |
| anti-influenza_CDR | 7074 | 14716, 22358, 30000, 37642, 45284, 52926, 60568 |
| anti-influenza_CDR | 7075 | 14717, 22359, 30001, 37643, 45285, 52927, 60569 |
| anti-influenza_CDR | 7076 | 14718, 22360, 30002, 37644, 45286, 52928, 60570 |
| anti-influenza_CDR | 7077 | 14719, 22361, 30003, 37645, 45287, 52929, 60571 |
| anti-influenza_CDR | 7078 | 14720, 22362, 30004, 37646, 45288, 52930, 60572 |
| anti-influenza_CDR | 7079 | 14721, 22363, 30005, 37647, 45289, 52931, 60573 |
| anti-influenza_CDR | 7080 | 14722, 22364, 30006, 37648, 45290, 52932, 60574 |
| anti-influenza_CDR | 7081 | 14723, 22365, 30007, 37649, 45291, 52933, 60575 |
| anti-influenza_CDR | 7082 | 14724, 22366, 30008, 37650, 45292, 52934, 60576 |
| anti-influenza_CDR | 7083 | 14725, 22367, 30009, 37651, 45293, 52935, 60577 |
| anti-influenza_CDR | 7084 | 14726, 22368, 30010, 37652, 45294, 52936, 60578 |
| anti-influenza_CDR | 7085 | 14727, 22369, 30011, 37653, 45295, 52937, 60579 |
| anti-influenza_CDR | 7086 | 14728, 22370, 30012, 37654, 45296, 52938, 60580 |
| anti-influenza_CDR | 7087 | 14729, 22371, 30013, 37655, 45297, 52939, 60581 |
| anti-influenza_CDR | 7088 | 14730, 22372, 30014, 37656, 45298, 52940, 60582 |
| anti-influenza_CDR | 7089 | 14731, 22373, 30015, 37657, 45299, 52941, 60583 |
| anti-influenza_CDR | 7090 | 14732, 22374, 30016, 37658, 45300, 52942, 60584 |
| anti-influenza_CDR | 7091 | 14733, 22375, 30017, 37659, 45301, 52943, 60585 |
| anti-influenza_CDR | 7092 | 14734, 22376, 30018, 37660, 45302, 52944, 60586 |
| anti-influenza_CDR | 7093 | 14735, 22377, 30019, 37661, 45303, 52945, 60587 |
| anti-influenza_CDR | 7094 | 14736, 22378, 30020, 37662, 45304, 52946, 60588 |
| anti-influenza_CDR | 7095 | 14737, 22379, 30021, 37663, 45305, 52947, 60589 |
| anti-influenza_CDR | 7096 | 14738, 22380, 30022, 37664, 45306, 52948, 60590 |
| anti-influenza_CDR | 7097 | 14739, 22381, 30023, 37665, 45307, 52949, 60591 |
| anti-influenza_CDR | 7098 | 14740, 22382, 30024, 37666, 45308, 52950, 60592 |
| anti-influenza_CDR | 7099 | 14741, 22383, 30025, 37667, 45309, 52951, 60593 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 7100 | 14742, 22384, 30026, 37668, 45310, 52952, 60594 |
| anti-influenza_CDR | 7101 | 14743, 22385, 30027, 37669, 45311, 52953, 60595 |
| anti-influenza_CDR | 7102 | 14744, 22386, 30028, 37670, 45312, 52954, 60596 |
| anti-influenza_CDR | 7103 | 14745, 22387, 30029, 37671, 45313, 52955, 60597 |
| anti-influenza_CDR | 7104 | 14746, 22388, 30030, 37672, 45314, 52956, 60598 |
| anti-influenza_CDR | 7105 | 14747, 22389, 30031, 37673, 45315, 52957, 60599 |
| anti-influenza_CDR | 7106 | 14748, 22390, 30032, 37674, 45316, 52958, 60600 |
| anti-influenza_CDR | 7107 | 14749, 22391, 30033, 37675, 45317, 52959, 60601 |
| anti-influenza_CDR | 7108 | 14750, 22392, 30034, 37676, 45318, 52960, 60602 |
| anti-influenza_CDR | 7109 | 14751, 22393, 30035, 37677, 45319, 52961, 60603 |
| anti-influenza_CDR | 7110 | 14752, 22394, 30036, 37678, 45320, 52962, 60604 |
| anti-influenza_CDR | 7111 | 14753, 22395, 30037, 37679, 45321, 52963, 60605 |
| anti-influenza_CDR | 7112 | 14754, 22396, 30038, 37680, 45322, 52964, 60606 |
| anti-influenza_CDR | 7113 | 14755, 22397, 30039, 37681, 45323, 52965, 60607 |
| anti-influenza_CDR | 7114 | 14756, 22398, 30040, 37682, 45324, 52966, 60608 |
| anti-influenza_CDR | 7115 | 14757, 22399, 30041, 37683, 45325, 52967, 60609 |
| anti-influenza_CDR | 7116 | 14758, 22400, 30042, 37684, 45326, 52968, 60610 |
| anti-influenza_CDR | 7117 | 14759, 22401, 30043, 37685, 45327, 52969, 60611 |
| anti-influenza_CDR | 7118 | 14760, 22402, 30044, 37686, 45328, 52970, 60612 |
| anti-influenza_CDR | 7119 | 14761, 22403, 30045, 37687, 45329, 52971, 60613 |
| anti-influenza_CDR | 7120 | 14762, 22404, 30046, 37688, 45330, 52972, 60614 |
| anti-influenza_CDR | 7121 | 14763, 22405, 30047, 37689, 45331, 52973, 60615 |
| anti-influenza_CDR | 7122 | 14764, 22406, 30048, 37690, 45332, 52974, 60616 |
| anti-influenza_CDR | 7123 | 14765, 22407, 30049, 37691, 45333, 52975, 60617 |
| anti-influenza_CDR | 7124 | 14766, 22408, 30050, 37692, 45334, 52976, 60618 |
| anti-influenza_CDR | 7125 | 14767, 22409, 30051, 37693, 45335, 52977, 60619 |
| anti-influenza_CDR | 7126 | 14768, 22410, 30052, 37694, 45336, 52978, 60620 |
| anti-influenza_CDR | 7127 | 14769, 22411, 30053, 37695, 45337, 52979, 60621 |
| anti-influenza_CDR | 7128 | 14770, 22412, 30054, 37696, 45338, 52980, 60622 |
| anti-influenza_CDR | 7129 | 14771, 22413, 30055, 37697, 45339, 52981, 60623 |
| anti-influenza_CDR | 7130 | 14772, 22414, 30056, 37698, 45340, 52982, 60624 |
| anti-influenza_CDR | 7131 | 14773, 22415, 30057, 37699, 45341, 52983, 60625 |
| anti-influenza_CDR | 7132 | 14774, 22416, 30058, 37700, 45342, 52984, 60626 |
| anti-influenza_CDR | 7133 | 14775, 22417, 30059, 37701, 45343, 52985, 60627 |
| anti-influenza_CDR | 7134 | 14776, 22418, 30060, 37702, 45344, 52986, 60628 |
| anti-influenza_CDR | 7135 | 14777, 22419, 30061, 37703, 45345, 52987, 60629 |
| anti-influenza_CDR | 7136 | 14778, 22420, 30062, 37704, 45346, 52988, 60630 |
| anti-influenza_CDR | 7137 | 14779, 22421, 30063, 37705, 45347, 52989, 60631 |
| anti-influenza_CDR | 7138 | 14780, 22422, 30064, 37706, 45348, 52990, 60632 |
| anti-influenza_CDR | 7139 | 14781, 22423, 30065, 37707, 45349, 52991, 60633 |
| anti-influenza_CDR | 7140 | 14782, 22424, 30066, 37708, 45350, 52992, 60634 |
| anti-influenza_CDR | 7141 | 14783, 22425, 30067, 37709, 45351, 52993, 60635 |
| anti-influenza_CDR | 7142 | 14784, 22426, 30068, 37710, 45352, 52994, 60636 |
| anti-influenza_CDR | 7143 | 14785, 22427, 30069, 37711, 45353, 52995, 60637 |
| anti-influenza_CDR | 7144 | 14786, 22428, 30070, 37712, 45354, 52996, 60638 |
| anti-influenza_CDR | 7145 | 14787, 22429, 30071, 37713, 45355, 52997, 60639 |
| anti-influenza_CDR | 7146 | 14788, 22430, 30072, 37714, 45356, 52998, 60640 |
| anti-influenza_CDR | 7147 | 14789, 22431, 30073, 37715, 45357, 52999, 60641 |
| anti-influenza_CDR | 7148 | 14790, 22432, 30074, 37716, 45358, 53000, 60642 |
| anti-influenza_CDR | 7149 | 14791, 22433, 30075, 37717, 45359, 53001, 60643 |
| anti-influenza_CDR | 7150 | 14792, 22434, 30076, 37718, 45360, 53002, 60644 |
| anti-influenza_CDR | 7151 | 14793, 22435, 30077, 37719, 45361, 53003, 60645 |
| anti-influenza_CDR | 7152 | 14794, 22436, 30078, 37720, 45362, 53004, 60646 |
| anti-influenza_CDR | 7153 | 14795, 22437, 30079, 37721, 45363, 53005, 60647 |
| anti-influenza_CDR | 7154 | 14796, 22438, 30080, 37722, 45364, 53006, 60648 |
| anti-influenza_CDR | 7155 | 14797, 22439, 30081, 37723, 45365, 53007, 60649 |
| anti-influenza_CDR | 7156 | 14798, 22440, 30082, 37724, 45366, 53008, 60650 |
| anti-influenza_CDR | 7157 | 14799, 22441, 30083, 37725, 45367, 53009, 60651 |
| anti-influenza_CDR | 7158 | 14800, 22442, 30084, 37726, 45368, 53010, 60652 |
| anti-influenza_CDR | 7159 | 14801, 22443, 30085, 37727, 45369, 53011, 60653 |
| anti-influenza_CDR | 7160 | 14802, 22444, 30086, 37728, 45370, 53012, 60654 |
| anti-influenza_CDR | 7161 | 14803, 22445, 30087, 37729, 45371, 53013, 60655 |
| anti-influenza_CDR | 7162 | 14804, 22446, 30088, 37730, 45372, 53014, 60656 |
| anti-influenza_CDR | 7163 | 14805, 22447, 30089, 37731, 45373, 53015, 60657 |
| anti-influenza_CDR | 7164 | 14806, 22448, 30090, 37732, 45374, 53016, 60658 |
| anti-influenza_CDR | 7165 | 14807, 22449, 30091, 37733, 45375, 53017, 60659 |
| anti-influenza_CDR | 7166 | 14808, 22450, 30092, 37734, 45376, 53018, 60660 |
| anti-influenza_CDR | 7167 | 14809, 22451, 30093, 37735, 45377, 53019, 60661 |
| anti-influenza_CDR | 7168 | 14810, 22452, 30094, 37736, 45378, 53020, 60662 |
| anti-influenza_CDR | 7169 | 14811, 22453, 30095, 37737, 45379, 53021, 60663 |
| anti-influenza_CDR | 7170 | 14812, 22454, 30096, 37738, 45380, 53022, 60664 |
| anti-influenza_CDR | 7171 | 14813, 22455, 30097, 37739, 45381, 53023, 60665 |
| anti-influenza_CDR | 7172 | 14814, 22456, 30098, 37740, 45382, 53024, 60666 |
| anti-influenza_CDR | 7173 | 14815, 22457, 30099, 37741, 45383, 53025, 60667 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 7174 | 14816, 22458, 30100, 37742, 45384, 53026, 60668 |
| anti-influenza_CDR | 7175 | 14817, 22459, 30101, 37743, 45385, 53027, 60669 |
| anti-influenza_CDR | 7176 | 14818, 22460, 30102, 37744, 45386, 53028, 60670 |
| anti-influenza_CDR | 7177 | 14819, 22461, 30103, 37745, 45387, 53029, 60671 |
| anti-influenza_CDR | 7178 | 14820, 22462, 30104, 37746, 45388, 53030, 60672 |
| anti-influenza_CDR | 7179 | 14821, 22463, 30105, 37747, 45389, 53031, 60673 |
| anti-influenza_CDR | 7180 | 14822, 22464, 30106, 37748, 45390, 53032, 60674 |
| anti-influenza_CDR | 7181 | 14823, 22465, 30107, 37749, 45391, 53033, 60675 |
| anti-influenza_CDR | 7182 | 14824, 22466, 30108, 37750, 45392, 53034, 60676 |
| anti-influenza_CDR | 7183 | 14825, 22467, 30109, 37751, 45393, 53035, 60677 |
| anti-influenza_CDR | 7184 | 14826, 22468, 30110, 37752, 45394, 53036, 60678 |
| anti-influenza_CDR | 7185 | 14827, 22469, 30111, 37753, 45395, 53037, 60679 |
| anti-influenza_CDR | 7186 | 14828, 22470, 30112, 37754, 45396, 53038, 60680 |
| anti-influenza_CDR | 7187 | 14829, 22471, 30113, 37755, 45397, 53039, 60681 |
| anti-influenza_CDR | 7188 | 14830, 22472, 30114, 37756, 45398, 53040, 60682 |
| anti-influenza_CDR | 7189 | 14831, 22473, 30115, 37757, 45399, 53041, 60683 |
| anti-influenza_CDR | 7190 | 14832, 22474, 30116, 37758, 45400, 53042, 60684 |
| anti-influenza_CDR | 7191 | 14833, 22475, 30117, 37759, 45401, 53043, 60685 |
| anti-influenza_CDR | 7192 | 14834, 22476, 30118, 37760, 45402, 53044, 60686 |
| anti-influenza_CDR | 7193 | 14835, 22477, 30119, 37761, 45403, 53045, 60687 |
| anti-influenza_CDR | 7194 | 14836, 22478, 30120, 37762, 45404, 53046, 60688 |
| anti-influenza_CDR | 7195 | 14837, 22479, 30121, 37763, 45405, 53047, 60689 |
| anti-influenza_CDR | 7196 | 14838, 22480, 30122, 37764, 45406, 53048, 60690 |
| anti-influenza_CDR | 7197 | 14839, 22481, 30123, 37765, 45407, 53049, 60691 |
| anti-influenza_CDR | 7198 | 14840, 22482, 30124, 37766, 45408, 53050, 60692 |
| anti-influenza_CDR | 7199 | 14841, 22483, 30125, 37767, 45409, 53051, 60693 |
| anti-influenza_CDR | 7200 | 14842, 22484, 30126, 37768, 45410, 53052, 60694 |
| anti-influenza_CDR | 7201 | 14843, 22485, 30127, 37769, 45411, 53053, 60695 |
| anti-influenza_CDR | 7202 | 14844, 22486, 30128, 37770, 45412, 53054, 60696 |
| anti-influenza_CDR | 7203 | 14845, 22487, 30129, 37771, 45413, 53055, 60697 |
| anti-influenza_CDR | 7204 | 14846, 22488, 30130, 37772, 45414, 53056, 60698 |
| anti-influenza_CDR | 7205 | 14847, 22489, 30131, 37773, 45415, 53057, 60699 |
| anti-influenza_CDR | 7206 | 14848, 22490, 30132, 37774, 45416, 53058, 60700 |
| anti-influenza_CDR | 7207 | 14849, 22491, 30133, 37775, 45417, 53059, 60701 |
| anti-influenza_CDR | 7208 | 14850, 22492, 30134, 37776, 45418, 53060, 60702 |
| anti-influenza_CDR | 7209 | 14851, 22493, 30135, 37777, 45419, 53061, 60703 |
| anti-influenza_CDR | 7210 | 14852, 22494, 30136, 37778, 45420, 53062, 60704 |
| anti-influenza_CDR | 7211 | 14853, 22495, 30137, 37779, 45421, 53063, 60705 |
| anti-influenza_CDR | 7212 | 14854, 22496, 30138, 37780, 45422, 53064, 60706 |
| anti-influenza_CDR | 7213 | 14855, 22497, 30139, 37781, 45423, 53065, 60707 |
| anti-influenza_CDR | 7214 | 14856, 22498, 30140, 37782, 45424, 53066, 60708 |
| anti-influenza_CDR | 7215 | 14857, 22499, 30141, 37783, 45425, 53067, 60709 |
| anti-influenza_CDR | 7216 | 14858, 22500, 30142, 37784, 45426, 53068, 60710 |
| anti-influenza_CDR | 7217 | 14859, 22501, 30143, 37785, 45427, 53069, 60711 |
| anti-influenza_CDR | 7218 | 14860, 22502, 30144, 37786, 45428, 53070, 60712 |
| anti-influenza_CDR | 7219 | 14861, 22503, 30145, 37787, 45429, 53071, 60713 |
| anti-influenza_CDR | 7220 | 14862, 22504, 30146, 37788, 45430, 53072, 60714 |
| anti-influenza_CDR | 7221 | 14863, 22505, 30147, 37789, 45431, 53073, 60715 |
| anti-influenza_CDR | 7222 | 14864, 22506, 30148, 37790, 45432, 53074, 60716 |
| anti-influenza_CDR | 7223 | 14865, 22507, 30149, 37791, 45433, 53075, 60717 |
| anti-influenza_CDR | 7224 | 14866, 22508, 30150, 37792, 45434, 53076, 60718 |
| anti-influenza_CDR | 7225 | 14867, 22509, 30151, 37793, 45435, 53077, 60719 |
| anti-influenza_CDR | 7226 | 14868, 22510, 30152, 37794, 45436, 53078, 60720 |
| anti-influenza_CDR | 7227 | 14869, 22511, 30153, 37795, 45437, 53079, 60721 |
| anti-influenza_CDR | 7228 | 14870, 22512, 30154, 37796, 45438, 53080, 60722 |
| anti-influenza_CDR | 7229 | 14871, 22513, 30155, 37797, 45439, 53081, 60723 |
| anti-influenza_CDR | 7230 | 14872, 22514, 30156, 37798, 45440, 53082, 60724 |
| anti-influenza_CDR | 7231 | 14873, 22515, 30157, 37799, 45441, 53083, 60725 |
| anti-influenza_CDR | 7232 | 14874, 22516, 30158, 37800, 45442, 53084, 60726 |
| anti-influenza_CDR | 7233 | 14875, 22517, 30159, 37801, 45443, 53085, 60727 |
| anti-influenza_CDR | 7234 | 14876, 22518, 30160, 37802, 45444, 53086, 60728 |
| anti-influenza_CDR | 7235 | 14877, 22519, 30161, 37803, 45445, 53087, 60729 |
| anti-influenza_CDR | 7236 | 14878, 22520, 30162, 37804, 45446, 53088, 60730 |
| anti-influenza_CDR | 7237 | 14879, 22521, 30163, 37805, 45447, 53089, 60731 |
| anti-influenza_CDR | 7238 | 14880, 22522, 30164, 37806, 45448, 53090, 60732 |
| anti-influenza_CDR | 7239 | 14881, 22523, 30165, 37807, 45449, 53091, 60733 |
| anti-influenza_CDR | 7240 | 14882, 22524, 30166, 37808, 45450, 53092, 60734 |
| anti-influenza_CDR | 7241 | 14883, 22525, 30167, 37809, 45451, 53093, 60735 |
| anti-influenza_CDR | 7242 | 14884, 22526, 30168, 37810, 45452, 53094, 60736 |
| anti-influenza_CDR | 7243 | 14885, 22527, 30169, 37811, 45453, 53095, 60737 |
| anti-influenza_CDR | 7244 | 14886, 22528, 30170, 37812, 45454, 53096, 60738 |
| anti-influenza_CDR | 7245 | 14887, 22529, 30171, 37813, 45455, 53097, 60739 |
| anti-influenza_CDR | 7246 | 14888, 22530, 30172, 37814, 45456, 53098, 60740 |
| anti-influenza_CDR | 7247 | 14889, 22531, 30173, 37815, 45457, 53099, 60741 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 7248 | 14890, 22532, 30174, 37816, 45458, 53100, 60742 |
| anti-influenza_CDR | 7249 | 14891, 22533, 30175, 37817, 45459, 53101, 60743 |
| anti-influenza_CDR | 7250 | 14892, 22534, 30176, 37818, 45460, 53102, 60744 |
| anti-influenza_CDR | 7251 | 14893, 22535, 30177, 37819, 45461, 53103, 60745 |
| anti-influenza_CDR | 7252 | 14894, 22536, 30178, 37820, 45462, 53104, 60746 |
| anti-influenza_CDR | 7253 | 14895, 22537, 30179, 37821, 45463, 53105, 60747 |
| anti-influenza_CDR | 7254 | 14896, 22538, 30180, 37822, 45464, 53106, 60748 |
| anti-influenza_CDR | 7255 | 14897, 22539, 30181, 37823, 45465, 53107, 60749 |
| anti-influenza_CDR | 7256 | 14898, 22540, 30182, 37824, 45466, 53108, 60750 |
| anti-influenza_CDR | 7257 | 14899, 22541, 30183, 37825, 45467, 53109, 60751 |
| anti-influenza_CDR | 7258 | 14900, 22542, 30184, 37826, 45468, 53110, 60752 |
| anti-influenza_CDR | 7259 | 14901, 22543, 30185, 37827, 45469, 53111, 60753 |
| anti-influenza_CDR | 7260 | 14902, 22544, 30186, 37828, 45470, 53112, 60754 |
| anti-influenza_CDR | 7261 | 14903, 22545, 30187, 37829, 45471, 53113, 60755 |
| anti-influenza_CDR | 7262 | 14904, 22546, 30188, 37830, 45472, 53114, 60756 |
| anti-influenza_CDR | 7263 | 14905, 22547, 30189, 37831, 45473, 53115, 60757 |
| anti-influenza_CDR | 7264 | 14906, 22548, 30190, 37832, 45474, 53116, 60758 |
| anti-influenza_CDR | 7265 | 14907, 22549, 30191, 37833, 45475, 53117, 60759 |
| anti-influenza_CDR | 7266 | 14908, 22550, 30192, 37834, 45476, 53118, 60760 |
| anti-influenza_CDR | 7267 | 14909, 22551, 30193, 37835, 45477, 53119, 60761 |
| anti-influenza_CDR | 7268 | 14910, 22552, 30194, 37836, 45478, 53120, 60762 |
| anti-influenza_CDR | 7269 | 14911, 22553, 30195, 37837, 45479, 53121, 60763 |
| anti-influenza_CDR | 7270 | 14912, 22554, 30196, 37838, 45480, 53122, 60764 |
| anti-influenza_CDR | 7271 | 14913, 22555, 30197, 37839, 45481, 53123, 60765 |
| anti-influenza_CDR | 7272 | 14914, 22556, 30198, 37840, 45482, 53124, 60766 |
| anti-influenza_CDR | 7273 | 14915, 22557, 30199, 37841, 45483, 53125, 60767 |
| anti-influenza_CDR | 7274 | 14916, 22558, 30200, 37842, 45484, 53126, 60768 |
| anti-influenza_CDR | 7275 | 14917, 22559, 30201, 37843, 45485, 53127, 60769 |
| anti-influenza_CDR | 7276 | 14918, 22560, 30202, 37844, 45486, 53128, 60770 |
| anti-influenza_CDR | 7277 | 14919, 22561, 30203, 37845, 45487, 53129, 60771 |
| anti-influenza_CDR | 7278 | 14920, 22562, 30204, 37846, 45488, 53130, 60772 |
| anti-influenza_CDR | 7279 | 14921, 22563, 30205, 37847, 45489, 53131, 60773 |
| anti-influenza_CDR | 7280 | 14922, 22564, 30206, 37848, 45490, 53132, 60774 |
| anti-influenza_CDR | 7281 | 14923, 22565, 30207, 37849, 45491, 53133, 60775 |
| anti-influenza_CDR | 7282 | 14924, 22566, 30208, 37850, 45492, 53134, 60776 |
| anti-influenza_CDR | 7283 | 14925, 22567, 30209, 37851, 45493, 53135, 60777 |
| anti-influenza_CDR | 7284 | 14926, 22568, 30210, 37852, 45494, 53136, 60778 |
| anti-influenza_CDR | 7285 | 14927, 22569, 30211, 37853, 45495, 53137, 60779 |
| anti-influenza_CDR | 7286 | 14928, 22570, 30212, 37854, 45496, 53138, 60780 |
| anti-influenza_CDR | 7287 | 14929, 22571, 30213, 37855, 45497, 53139, 60781 |
| anti-influenza_CDR | 7288 | 14930, 22572, 30214, 37856, 45498, 53140, 60782 |
| anti-influenza_CDR | 7289 | 14931, 22573, 30215, 37857, 45499, 53141, 60783 |
| anti-influenza_CDR | 7290 | 14932, 22574, 30216, 37858, 45500, 53142, 60784 |
| anti-influenza_CDR | 7291 | 14933, 22575, 30217, 37859, 45501, 53143, 60785 |
| anti-influenza_CDR | 7292 | 14934, 22576, 30218, 37860, 45502, 53144, 60786 |
| anti-influenza_CDR | 7293 | 14935, 22577, 30219, 37861, 45503, 53145, 60787 |
| anti-influenza_CDR | 7294 | 14936, 22578, 30220, 37862, 45504, 53146, 60788 |
| anti-influenza_CDR | 7295 | 14937, 22579, 30221, 37863, 45505, 53147, 60789 |
| anti-influenza_CDR | 7296 | 14938, 22580, 30222, 37864, 45506, 53148, 60790 |
| anti-influenza_CDR | 7297 | 14939, 22581, 30223, 37865, 45507, 53149, 60791 |
| anti-influenza_CDR | 7298 | 14940, 22582, 30224, 37866, 45508, 53150, 60792 |
| anti-influenza_CDR | 7299 | 14941, 22583, 30225, 37867, 45509, 53151, 60793 |
| anti-influenza_CDR | 7300 | 14942, 22584, 30226, 37868, 45510, 53152, 60794 |
| anti-influenza_CDR | 7301 | 14943, 22585, 30227, 37869, 45511, 53153, 60795 |
| anti-influenza_CDR | 7302 | 14944, 22586, 30228, 37870, 45512, 53154, 60796 |
| anti-influenza_CDR | 7303 | 14945, 22587, 30229, 37871, 45513, 53155, 60797 |
| anti-influenza_CDR | 7304 | 14946, 22588, 30230, 37872, 45514, 53156, 60798 |
| anti-influenza_CDR | 7305 | 14947, 22589, 30231, 37873, 45515, 53157, 60799 |
| anti-influenza_CDR | 7306 | 14948, 22590, 30232, 37874, 45516, 53158, 60800 |
| anti-influenza_CDR | 7307 | 14949, 22591, 30233, 37875, 45517, 53159, 60801 |
| anti-influenza_CDR | 7308 | 14950, 22592, 30234, 37876, 45518, 53160, 60802 |
| anti-influenza_CDR | 7309 | 14951, 22593, 30235, 37877, 45519, 53161, 60803 |
| anti-influenza_CDR | 7310 | 14952, 22594, 30236, 37878, 45520, 53162, 60804 |
| anti-influenza_CDR | 7311 | 14953, 22595, 30237, 37879, 45521, 53163, 60805 |
| anti-influenza_CDR | 7312 | 14954, 22596, 30238, 37880, 45522, 53164, 60806 |
| anti-influenza_CDR | 7313 | 14955, 22597, 30239, 37881, 45523, 53165, 60807 |
| anti-influenza_CDR | 7314 | 14956, 22598, 30240, 37882, 45524, 53166, 60808 |
| anti-influenza_CDR | 7315 | 14957, 22599, 30241, 37883, 45525, 53167, 60809 |
| anti-influenza_CDR | 7316 | 14958, 22600, 30242, 37884, 45526, 53168, 60810 |
| anti-influenza_CDR | 7317 | 14959, 22601, 30243, 37885, 45527, 53169, 60811 |
| anti-influenza_CDR | 7318 | 14960, 22602, 30244, 37886, 45528, 53170, 60812 |
| anti-influenza_CDR | 7319 | 14961, 22603, 30245, 37887, 45529, 53171, 60813 |
| anti-influenza_CDR | 7320 | 14962, 22604, 30246, 37888, 45530, 53172, 60814 |
| anti-influenza_CDR | 7321 | 14963, 22605, 30247, 37889, 45531, 53173, 60815 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 7322 | 14964, 22606, 30248, 37890, 45532, 53174, 60816 |
| anti-influenza_CDR | 7323 | 14965, 22607, 30249, 37891, 45533, 53175, 60817 |
| anti-influenza_CDR | 7324 | 14966, 22608, 30250, 37892, 45534, 53176, 60818 |
| anti-influenza_CDR | 7325 | 14967, 22609, 30251, 37893, 45535, 53177, 60819 |
| anti-influenza_CDR | 7326 | 14968, 22610, 30252, 37894, 45536, 53178, 60820 |
| anti-influenza_CDR | 7327 | 14969, 22611, 30253, 37895, 45537, 53179, 60821 |
| anti-influenza_CDR | 7328 | 14970, 22612, 30254, 37896, 45538, 53180, 60822 |
| anti-influenza_CDR | 7329 | 14971, 22613, 30255, 37897, 45539, 53181, 60823 |
| anti-influenza_CDR | 7330 | 14972, 22614, 30256, 37898, 45540, 53182, 60824 |
| anti-influenza_CDR | 7331 | 14973, 22615, 30257, 37899, 45541, 53183, 60825 |
| anti-influenza_CDR | 7332 | 14974, 22616, 30258, 37900, 45542, 53184, 60826 |
| anti-influenza_CDR | 7333 | 14975, 22617, 30259, 37901, 45543, 53185, 60827 |
| anti-influenza_CDR | 7334 | 14976, 22618, 30260, 37902, 45544, 53186, 60828 |
| anti-influenza_CDR | 7335 | 14977, 22619, 30261, 37903, 45545, 53187, 60829 |
| anti-influenza_CDR | 7336 | 14978, 22620, 30262, 37904, 45546, 53188, 60830 |
| anti-influenza_CDR | 7337 | 14979, 22621, 30263, 37905, 45547, 53189, 60831 |
| anti-influenza_CDR | 7338 | 14980, 22622, 30264, 37906, 45548, 53190, 60832 |
| anti-influenza_CDR | 7339 | 14981, 22623, 30265, 37907, 45549, 53191, 60833 |
| anti-influenza_CDR | 7340 | 14982, 22624, 30266, 37908, 45550, 53192, 60834 |
| anti-influenza_CDR | 7341 | 14983, 22625, 30267, 37909, 45551, 53193, 60835 |
| anti-influenza_CDR | 7342 | 14984, 22626, 30268, 37910, 45552, 53194, 60836 |
| anti-influenza_CDR | 7343 | 14985, 22627, 30269, 37911, 45553, 53195, 60837 |
| anti-influenza_CDR | 7344 | 14986, 22628, 30270, 37912, 45554, 53196, 60838 |
| anti-influenza_CDR | 7345 | 14987, 22629, 30271, 37913, 45555, 53197, 60839 |
| anti-influenza_CDR | 7346 | 14988, 22630, 30272, 37914, 45556, 53198, 60840 |
| anti-influenza_CDR | 7347 | 14989, 22631, 30273, 37915, 45557, 53199, 60841 |
| anti-influenza_CDR | 7348 | 14990, 22632, 30274, 37916, 45558, 53200, 60842 |
| anti-influenza_CDR | 7349 | 14991, 22633, 30275, 37917, 45559, 53201, 60843 |
| anti-influenza_CDR | 7350 | 14992, 22634, 30276, 37918, 45560, 53202, 60844 |
| anti-influenza_CDR | 7351 | 14993, 22635, 30277, 37919, 45561, 53203, 60845 |
| anti-influenza_CDR | 7352 | 14994, 22636, 30278, 37920, 45562, 53204, 60846 |
| anti-influenza_CDR | 7353 | 14995, 22637, 30279, 37921, 45563, 53205, 60847 |
| anti-influenza_CDR | 7354 | 14996, 22638, 30280, 37922, 45564, 53206, 60848 |
| anti-influenza_CDR | 7355 | 14997, 22639, 30281, 37923, 45565, 53207, 60849 |
| anti-influenza_CDR | 7356 | 14998, 22640, 30282, 37924, 45566, 53208, 60850 |
| anti-influenza_CDR | 7357 | 14999, 22641, 30283, 37925, 45567, 53209, 60851 |
| anti-influenza_CDR | 7358 | 15000, 22642, 30284, 37926, 45568, 53210, 60852 |
| anti-influenza_CDR | 7359 | 15001, 22643, 30285, 37927, 45569, 53211, 60853 |
| anti-influenza_CDR | 7360 | 15002, 22644, 30286, 37928, 45570, 53212, 60854 |
| anti-influenza_CDR | 7361 | 15003, 22645, 30287, 37929, 45571, 53213, 60855 |
| anti-influenza_CDR | 7362 | 15004, 22646, 30288, 37930, 45572, 53214, 60856 |
| anti-influenza_CDR | 7363 | 15005, 22647, 30289, 37931, 45573, 53215, 60857 |
| anti-influenza_CDR | 7364 | 15006, 22648, 30290, 37932, 45574, 53216, 60858 |
| anti-influenza_CDR | 7365 | 15007, 22649, 30291, 37933, 45575, 53217, 60859 |
| anti-influenza_CDR | 7366 | 15008, 22650, 30292, 37934, 45576, 53218, 60860 |
| anti-influenza_CDR | 7367 | 15009, 22651, 30293, 37935, 45577, 53219, 60861 |
| anti-influenza_CDR | 7368 | 15010, 22652, 30294, 37936, 45578, 53220, 60862 |
| anti-influenza_CDR | 7369 | 15011, 22653, 30295, 37937, 45579, 53221, 60863 |
| anti-influenza_CDR | 7370 | 15012, 22654, 30296, 37938, 45580, 53222, 60864 |
| anti-influenza_CDR | 7371 | 15013, 22655, 30297, 37939, 45581, 53223, 60865 |
| anti-influenza_CDR | 7372 | 15014, 22656, 30298, 37940, 45582, 53224, 60866 |
| anti-influenza_CDR | 7373 | 15015, 22657, 30299, 37941, 45583, 53225, 60867 |
| anti-influenza_CDR | 7374 | 15016, 22658, 30300, 37942, 45584, 53226, 60868 |
| anti-influenza_CDR | 7375 | 15017, 22659, 30301, 37943, 45585, 53227, 60869 |
| anti-influenza_CDR | 7376 | 15018, 22660, 30302, 37944, 45586, 53228, 60870 |
| anti-influenza_CDR | 7377 | 15019, 22661, 30303, 37945, 45587, 53229, 60871 |
| anti-influenza_CDR | 7378 | 15020, 22662, 30304, 37946, 45588, 53230, 60872 |
| anti-influenza_CDR | 7379 | 15021, 22663, 30305, 37947, 45589, 53231, 60873 |
| anti-influenza_CDR | 7380 | 15022, 22664, 30306, 37948, 45590, 53232, 60874 |
| anti-influenza_CDR | 7381 | 15023, 22665, 30307, 37949, 45591, 53233, 60875 |
| anti-influenza_CDR | 7382 | 15024, 22666, 30308, 37950, 45592, 53234, 60876 |
| anti-influenza_CDR | 7383 | 15025, 22667, 30309, 37951, 45593, 53235, 60877 |
| anti-influenza_CDR | 7384 | 15026, 22668, 30310, 37952, 45594, 53236, 60878 |
| anti-influenza_CDR | 7385 | 15027, 22669, 30311, 37953, 45595, 53237, 60879 |
| anti-influenza_CDR | 7386 | 15028, 22670, 30312, 37954, 45596, 53238, 60880 |
| anti-influenza_CDR | 7387 | 15029, 22671, 30313, 37955, 45597, 53239, 60881 |
| anti-influenza_CDR | 7388 | 15030, 22672, 30314, 37956, 45598, 53240, 60882 |
| anti-influenza_CDR | 7389 | 15031, 22673, 30315, 37957, 45599, 53241, 60883 |
| anti-influenza_CDR | 7390 | 15032, 22674, 30316, 37958, 45600, 53242, 60884 |
| anti-influenza_CDR | 7391 | 15033, 22675, 30317, 37959, 45601, 53243, 60885 |
| anti-influenza_CDR | 7392 | 15034, 22676, 30318, 37960, 45602, 53244, 60886 |
| anti-influenza_CDR | 7393 | 15035, 22677, 30319, 37961, 45603, 53245, 60887 |
| anti-influenza_CDR | 7394 | 15036, 22678, 30320, 37962, 45604, 53246, 60888 |
| anti-influenza_CDR | 7395 | 15037, 22679, 30321, 37963, 45605, 53247, 60889 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 7396 | 15038, 22680, 30322, 37964, 45606, 53248, 60890 |
| anti-influenza_CDR | 7397 | 15039, 22681, 30323, 37965, 45607, 53249, 60891 |
| anti-influenza_CDR | 7398 | 15040, 22682, 30324, 37966, 45608, 53250, 60892 |
| anti-influenza_CDR | 7399 | 15041, 22683, 30325, 37967, 45609, 53251, 60893 |
| anti-influenza_CDR | 7400 | 15042, 22684, 30326, 37968, 45610, 53252, 60894 |
| anti-influenza_CDR | 7401 | 15043, 22685, 30327, 37969, 45611, 53253, 60895 |
| anti-influenza_CDR | 7402 | 15044, 22686, 30328, 37970, 45612, 53254, 60896 |
| anti-influenza_CDR | 7403 | 15045, 22687, 30329, 37971, 45613, 53255, 60897 |
| anti-influenza_CDR | 7404 | 15046, 22688, 30330, 37972, 45614, 53256, 60898 |
| anti-influenza_CDR | 7405 | 15047, 22689, 30331, 37973, 45615, 53257, 60899 |
| anti-influenza_CDR | 7406 | 15048, 22690, 30332, 37974, 45616, 53258, 60900 |
| anti-influenza_CDR | 7407 | 15049, 22691, 30333, 37975, 45617, 53259, 60901 |
| anti-influenza_CDR | 7408 | 15050, 22692, 30334, 37976, 45618, 53260, 60902 |
| anti-influenza_CDR | 7409 | 15051, 22693, 30335, 37977, 45619, 53261, 60903 |
| anti-influenza_CDR | 7410 | 15052, 22694, 30336, 37978, 45620, 53262, 60904 |
| anti-influenza_CDR | 7411 | 15053, 22695, 30337, 37979, 45621, 53263, 60905 |
| anti-influenza_CDR | 7412 | 15054, 22696, 30338, 37980, 45622, 53264, 60906 |
| anti-influenza_CDR | 7413 | 15055, 22697, 30339, 37981, 45623, 53265, 60907 |
| anti-influenza_CDR | 7414 | 15056, 22698, 30340, 37982, 45624, 53266, 60908 |
| anti-influenza_CDR | 7415 | 15057, 22699, 30341, 37983, 45625, 53267, 60909 |
| anti-influenza_CDR | 7416 | 15058, 22700, 30342, 37984, 45626, 53268, 60910 |
| anti-influenza_CDR | 7417 | 15059, 22701, 30343, 37985, 45627, 53269, 60911 |
| anti-influenza_CDR | 7418 | 15060, 22702, 30344, 37986, 45628, 53270, 60912 |
| anti-influenza_CDR | 7419 | 15061, 22703, 30345, 37987, 45629, 53271, 60913 |
| anti-influenza_CDR | 7420 | 15062, 22704, 30346, 37988, 45630, 53272, 60914 |
| anti-influenza_CDR | 7421 | 15063, 22705, 30347, 37989, 45631, 53273, 60915 |
| anti-influenza_CDR | 7422 | 15064, 22706, 30348, 37990, 45632, 53274, 60916 |
| anti-influenza_CDR | 7423 | 15065, 22707, 30349, 37991, 45633, 53275, 60917 |
| anti-influenza_CDR | 7424 | 15066, 22708, 30350, 37992, 45634, 53276, 60918 |
| anti-influenza_CDR | 7425 | 15067, 22709, 30351, 37993, 45635, 53277, 60919 |
| anti-influenza_CDR | 7426 | 15068, 22710, 30352, 37994, 45636, 53278, 60920 |
| anti-influenza_CDR | 7427 | 15069, 22711, 30353, 37995, 45637, 53279, 60921 |
| anti-influenza_CDR | 7428 | 15070, 22712, 30354, 37996, 45638, 53280, 60922 |
| anti-influenza_CDR | 7429 | 15071, 22713, 30355, 37997, 45639, 53281, 60923 |
| anti-influenza_CDR | 7430 | 15072, 22714, 30356, 37998, 45640, 53282, 60924 |
| anti-influenza_CDR | 7431 | 15073, 22715, 30357, 37999, 45641, 53283, 60925 |
| anti-influenza_CDR | 7432 | 15074, 22716, 30358, 38000, 45642, 53284, 60926 |
| anti-influenza_CDR | 7433 | 15075, 22717, 30359, 38001, 45643, 53285, 60927 |
| anti-influenza_CDR | 7434 | 15076, 22718, 30360, 38002, 45644, 53286, 60928 |
| anti-influenza_CDR | 7435 | 15077, 22719, 30361, 38003, 45645, 53287, 60929 |
| anti-influenza_CDR | 7436 | 15078, 22720, 30362, 38004, 45646, 53288, 60930 |
| anti-influenza_CDR | 7437 | 15079, 22721, 30363, 38005, 45647, 53289, 60931 |
| anti-influenza_CDR | 7438 | 15080, 22722, 30364, 38006, 45648, 53290, 60932 |
| anti-influenza_CDR | 7439 | 15081, 22723, 30365, 38007, 45649, 53291, 60933 |
| anti-influenza_CDR | 7440 | 15082, 22724, 30366, 38008, 45650, 53292, 60934 |
| anti-influenza_CDR | 7441 | 15083, 22725, 30367, 38009, 45651, 53293, 60935 |
| anti-influenza_CDR | 7442 | 15084, 22726, 30368, 38010, 45652, 53294, 60936 |
| anti-influenza_CDR | 7443 | 15085, 22727, 30369, 38011, 45653, 53295, 60937 |
| anti-influenza_CDR | 7444 | 15086, 22728, 30370, 38012, 45654, 53296, 60938 |
| anti-influenza_CDR | 7445 | 15087, 22729, 30371, 38013, 45655, 53297, 60939 |
| anti-influenza_CDR | 7446 | 15088, 22730, 30372, 38014, 45656, 53298, 60940 |
| anti-influenza_CDR | 7447 | 15089, 22731, 30373, 38015, 45657, 53299, 60941 |
| anti-influenza_CDR | 7448 | 15090, 22732, 30374, 38016, 45658, 53300, 60942 |
| anti-influenza_CDR | 7449 | 15091, 22733, 30375, 38017, 45659, 53301, 60943 |
| anti-influenza_CDR | 7450 | 15092, 22734, 30376, 38018, 45660, 53302, 60944 |
| anti-influenza_CDR | 7451 | 15093, 22735, 30377, 38019, 45661, 53303, 60945 |
| anti-influenza_CDR | 7452 | 15094, 22736, 30378, 38020, 45662, 53304, 60946 |
| anti-influenza_CDR | 7453 | 15095, 22737, 30379, 38021, 45663, 53305, 60947 |
| anti-influenza_CDR | 7454 | 15096, 22738, 30380, 38022, 45664, 53306, 60948 |
| anti-influenza_CDR | 7455 | 15097, 22739, 30381, 38023, 45665, 53307, 60949 |
| anti-influenza_CDR | 7456 | 15098, 22740, 30382, 38024, 45666, 53308, 60950 |
| anti-influenza_CDR | 7457 | 15099, 22741, 30383, 38025, 45667, 53309, 60951 |
| anti-influenza_CDR | 7458 | 15100, 22742, 30384, 38026, 45668, 53310, 60952 |
| anti-influenza_CDR | 7459 | 15101, 22743, 30385, 38027, 45669, 53311, 60953 |
| anti-influenza_CDR | 7460 | 15102, 22744, 30386, 38028, 45670, 53312, 60954 |
| anti-influenza_CDR | 7461 | 15103, 22745, 30387, 38029, 45671, 53313, 60955 |
| anti-influenza_CDR | 7462 | 15104, 22746, 30388, 38030, 45672, 53314, 60956 |
| anti-influenza_CDR | 7463 | 15105, 22747, 30389, 38031, 45673, 53315, 60957 |
| anti-influenza_CDR | 7464 | 15106, 22748, 30390, 38032, 45674, 53316, 60958 |
| anti-influenza_CDR | 7465 | 15107, 22749, 30391, 38033, 45675, 53317, 60959 |
| anti-influenza_CDR | 7466 | 15108, 22750, 30392, 38034, 45676, 53318, 60960 |
| anti-influenza_CDR | 7467 | 15109, 22751, 30393, 38035, 45677, 53319, 60961 |
| anti-influenza_CDR | 7468 | 15110, 22752, 30394, 38036, 45678, 53320, 60962 |
| anti-influenza_CDR | 7469 | 15111, 22753, 30395, 38037, 45679, 53321, 60963 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-influenza_CDR | 7470 | 15112, 22754, 30396, 38038, 45680, 53322, 60964 |
| anti-influenza_CDR | 7471 | 15113, 22755, 30397, 38039, 45681, 53323, 60965 |
| anti-influenza_CDR | 7472 | 15114, 22756, 30398, 38040, 45682, 53324, 60966 |
| anti-influenza_CDR | 7473 | 15115, 22757, 30399, 38041, 45683, 53325, 60967 |
| anti-influenza_CDR | 7474 | 15116, 22758, 30400, 38042, 45684, 53326, 60968 |
| anti-influenza_CDR | 7475 | 15117, 22759, 30401, 38043, 45685, 53327, 60969 |
| anti-influenza_CDR | 7476 | 15118, 22760, 30402, 38044, 45686, 53328, 60970 |
| anti-influenza_CDR | 7477 | 15119, 22761, 30403, 38045, 45687, 53329, 60971 |
| anti-influenza_CDR | 7478 | 15120, 22762, 30404, 38046, 45688, 53330, 60972 |
| anti-influenza_CDR | 7479 | 15121, 22763, 30405, 38047, 45689, 53331, 60973 |
| anti-influenza_CDR | 7480 | 15122, 22764, 30406, 38048, 45690, 53332, 60974 |
| anti-influenza_CDR | 7481 | 15123, 22765, 30407, 38049, 45691, 53333, 60975 |
| anti-influenza_CDR | 7482 | 15124, 22766, 30408, 38050, 45692, 53334, 60976 |
| anti-influenza_CDR | 7483 | 15125, 22767, 30409, 38051, 45693, 53335, 60977 |
| anti-influenza_CDR | 7484 | 15126, 22768, 30410, 38052, 45694, 53336, 60978 |
| anti-influenza_CDR | 7485 | 15127, 22769, 30411, 38053, 45695, 53337, 60979 |
| anti-influenza_CDR | 7486 | 15128, 22770, 30412, 38054, 45696, 53338, 60980 |
| anti-influenza_CDR | 7487 | 15129, 22771, 30413, 38055, 45697, 53339, 60981 |
| anti-influenza_CDR | 7488 | 15130, 22772, 30414, 38056, 45698, 53340, 60982 |
| anti-influenza_CDR | 7489 | 15131, 22773, 30415, 38057, 45699, 53341, 60983 |
| anti-influenza_CDR | 7490 | 15132, 22774, 30416, 38058, 45700, 53342, 60984 |
| anti-influenza_CDR | 7491 | 15133, 22775, 30417, 38059, 45701, 53343, 60985 |
| anti-influenza_CDR | 7492 | 15134, 22776, 30418, 38060, 45702, 53344, 60986 |
| anti-influenza_CDR | 7493 | 15135, 22777, 30419, 38061, 45703, 53345, 60987 |
| anti-influenza_CDR | 7494 | 15136, 22778, 30420, 38062, 45704, 53346, 60988 |
| anti-influenza_CDR | 7495 | 15137, 22779, 30421, 38063, 45705, 53347, 60989 |
| anti-influenza_CDR | 7496 | 15138, 22780, 30422, 38064, 45706, 53348, 60990 |
| anti-influenza_CDR | 7497 | 15139, 22781, 30423, 38065, 45707, 53349, 60991 |
| anti-influenza_CDR | 7498 | 15140, 22782, 30424, 38066, 45708, 53350, 60992 |
| anti-influenza_CDR | 7499 | 15141, 22783, 30425, 38067, 45709, 53351, 60993 |
| anti-influenza_CDR | 7500 | 15142, 22784, 30426, 38068, 45710, 53352, 60994 |
| anti-influenza_CDR | 7501 | 15143, 22785, 30427, 38069, 45711, 53353, 60995 |
| anti-influenza_CDR | 7502 | 15144, 22786, 30428, 38070, 45712, 53354, 60996 |
| anti-influenza_CDR | 7503 | 15145, 22787, 30429, 38071, 45713, 53355, 60997 |
| anti-influenza_CDR | 7504 | 15146, 22788, 30430, 38072, 45714, 53356, 60998 |
| anti-influenza_CDR | 7505 | 15147, 22789, 30431, 38073, 45715, 53357, 60999 |
| anti-influenza_CDR | 7506 | 15148, 22790, 30432, 38074, 45716, 53358, 61000 |
| anti-influenza_CDR | 7507 | 15149, 22791, 30433, 38075, 45717, 53359, 61001 |
| anti-influenza_CDR | 7508 | 15150, 22792, 30434, 38076, 45718, 53360, 61002 |
| anti-influenza_CDR | 7509 | 15151, 22793, 30435, 38077, 45719, 53361, 61003 |
| anti-influenza_CDR | 7510 | 15152, 22794, 30436, 38078, 45720, 53362, 61004 |
| anti-influenza_CDR | 7511 | 15153, 22795, 30437, 38079, 45721, 53363, 61005 |
| anti-influenza_CDR | 7512 | 15154, 22796, 30438, 38080, 45722, 53364, 61006 |
| anti-influenza_CDR | 7513 | 15155, 22797, 30439, 38081, 45723, 53365, 61007 |
| anti-influenza_CDR | 7514 | 15156, 22798, 30440, 38082, 45724, 53366, 61008 |
| anti-influenza_CDR | 7515 | 15157, 22799, 30441, 38083, 45725, 53367, 61009 |
| anti-influenza_CDR | 7516 | 15158, 22800, 30442, 38084, 45726, 53368, 61010 |
| anti-influenza_CDR | 7517 | 15159, 22801, 30443, 38085, 45727, 53369, 61011 |
| anti-influenza_CDR | 7518 | 15160, 22802, 30444, 38086, 45728, 53370, 61012 |
| anti-influenza_CDR | 7519 | 15161, 22803, 30445, 38087, 45729, 53371, 61013 |
| anti-influenza_CDR | 7520 | 15162, 22804, 30446, 38088, 45730, 53372, 61014 |
| anti-influenza_CDR | 7521 | 15163, 22805, 30447, 38089, 45731, 53373, 61015 |
| anti-influenza_CDR | 7522 | 15164, 22806, 30448, 38090, 45732, 53374, 61016 |
| anti-influenza_CDR | 7523 | 15165, 22807, 30449, 38091, 45733, 53375, 61017 |
| anti-influenza_CDR | 7524 | 15166, 22808, 30450, 38092, 45734, 53376, 61018 |
| anti-0X40_HeavyChain_CDR1 | 7525 | 15167, 22809, 30451, 38093, 45735, 53377, 61019 |
| anti-0X40_HeavyChain_CDR1 | 7526 | 15168, 22810, 30452, 38094, 45736, 53378, 61020 |
| anti-0X40_HeavyChain_CDR1 | 7527 | 15169, 22811, 30453, 38095, 45737, 53379, 61021 |
| anti-0X40_HeavyChain_CDR1 | 7528 | 15170, 22812, 30454, 38096, 45738, 53380, 61022 |
| anti-0X40_HeavyChain_CDR1 | 7529 | 15171, 22813, 30455, 38097, 45739, 53381, 61023 |
| anti-0X40_HeavyChain_CDR1 | 7530 | 15172, 22814, 30456, 38098, 45740, 53382, 61024 |
| anti-0X40_LightChain_CDR2 | 7531 | 15173, 22815, 30457, 38099, 45741, 53383, 61025 |
| anti-0X40_LightChain_CDR2 | 7532 | 15174, 22816, 30458, 38100, 45742, 53384, 61026 |
| anti-0X40_LightChain_CDR2 | 7533 | 15175, 22817, 30459, 38101, 45743, 53385, 61027 |
| anti-0X40_LightChain_CDR2 | 7534 | 15176, 22818, 30460, 38102, 45744, 53386, 61028 |
| anti-0X40_LightChain_CDR3 | 7535 | 15177, 22819, 30461, 38103, 45745, 53387, 61029 |
| anti-0X40_HeavyChain_CDR3 | 7536 | 15178, 22820, 30462, 38104, 45746, 53388, 61030 |
| anti-0X40_HeavyChain_CDR3 | 7537 | 15179, 22821, 30463, 38105, 45747, 53389, 61031 |
| anti-0X40_HeavyChain_CDR3 | 7538 | 15180, 22822, 30464, 38106, 45748, 53390, 61032 |
| anti-0X40_LightChain_CDR3 | 7539 | 15181, 22823, 30465, 38107, 45749, 53391, 61033 |
| anti-0X40_HeavyChain_CDR3 | 7540 | 15182, 22824, 30466, 38108, 45750, 53392, 61034 |
| anti-0X40_LightChain_CDR3 | 7541 | 15183, 22825, 30467, 38109, 45751, 53393, 61035 |
| anti-0X40_LightChain_CDR3 | 7542 | 15184, 22826, 30468, 38110, 45752, 53394, 61036 |
| anti-0X40_LightChain_CDR3 | 7543 | 15185, 22827, 30469, 38111, 45753, 53395, 61037 |

TABLE 6-continued

Overview over the SEQ ID NOs of the amino acid sequences of preferred exemplary CDRs and of the respective encoding RNA sequences.

| Name | Protein SEQ ID NO: | RNA SEQ ID NO: |
|---|---|---|
| anti-OX40_LightChain_CDR3 | 7544 | 15186, 22828, 30470, 38112, 45754, 53396, 61038 |
| anti-OX40_LightChain_CDR3 | 7545 | 15187, 22829, 30471, 38113, 45755, 53397, 61039 |
| anti-OX40_LightChain_CDR3 | 7546 | 15188, 22830, 30472, 38114, 45756, 53398, 61040 |
| anti-OX40_LightChain_CDR3 | 7547 | 15189, 22831, 30473, 38115, 45757, 53399, 61041 |
| anti-OX40_LightChain_CDR3 | 7548 | 15190, 22832, 30474, 38116, 45758, 53400, 61042 |
| anti-OX40_LightChain_CDR3 | 7549 | 15191, 22833, 30475, 38117, 45759, 53401, 61043 |
| anti-OX40_HeavyChain_CDR1 | 7550 | 15192, 22834, 30476, 38118, 45760, 53402, 61044 |
| anti-OX40_HeavyChain_CDR3 | 7551 | 15193, 22835, 30477, 38119, 45761, 53403, 61045 |
| anti-OX40_LightChain_CDR1 | 7552 | 15194, 22836, 30478, 38120, 45762, 53404, 61046 |
| anti-OX40_LightChain_CDR1 | 7553 | 15195, 22837, 30479, 38121, 45763, 53405, 61047 |
| anti-OX40_LightChain_CDR1 | 7554 | 15196, 22838, 30480, 38122, 45764, 53406, 61048 |
| anti-OX40_HeavyChain_CDR3 | 7555 | 15197, 22839, 30481, 38123, 45765, 53407, 61049 |
| anti-OX40_HeavyChain_CDR3 | 7556 | 15198, 22840, 30482, 38124, 45766, 53408, 61050 |
| anti-OX40_HeavyChain_CDR3 | 7557 | 15199, 22841, 30483, 38125, 45767, 53409, 61051 |
| anti-OX40_HeavyChain_CDR3 | 7558 | 15200, 22842, 30484, 38126, 45768, 53410, 61052 |
| anti-OX40_HeavyChain_CDR2 | 7559 | 15201, 22843, 30485, 38127, 45769, 53411, 61053 |
| anti-OX40_HeavyChain_CDR2 | 7560 | 15202, 22844, 30486, 38128, 45770, 53412, 61054 |
| anti-OX40_HeavyChain_CDR2 | 7561 | 15203, 22845, 30487, 38129, 45771, 53413, 61055 |
| anti-OX40_HeavyChain_CDR2 | 7562 | 15204, 22846, 30488, 38130, 45772, 53414, 61056 |
| anti-OX40_HeavyChain_CDR2 | 7563 | 15205, 22847, 30489, 38131, 45773, 53415, 61057 |
| anti-OX40_HeavyChain_CDR2 | 7564 | 15206, 22848, 30490, 38132, 45774, 53416, 61058 |
| anti-OX40_HeavyChain_CDR2 | 7565 | 15207, 22849, 30491, 38133, 45775, 53417, 61059 |
| anti-OX40_HeavyChain_CDR2 | 7566 | 15208, 22850, 30492, 38134, 45776, 53418, 61060 |
| anti-OX40_HeavyChain_CDR2 | 7567 | 15209, 22851, 30493, 38135, 45777, 53419, 61061 |
| anti-OX40_HeavyChain_CDR2 | 7568 | 15210, 22852, 30494, 38136, 45778, 53420, 61062 |
| anti-OX40_HeavyChain_CDR2 | 7569 | 15211, 22853, 30495, 38137, 45779, 53421, 61063 |
| anti-OX40_HeavyChain_CDR2 | 7570 | 15212, 22854, 30496, 38138, 45780, 53422, 61064 |

Accordingly, it is preferred that the CDR encoded by the at least one coding sequence comprises or consists of an amino acid sequence as set forth in any of SEQ ID NOs: 5601-7570. It is also preferred that the at least one coding sequence comprises or consists of a nucleic acid sequence as set forth in any of SEQ ID NOs: 13243-15212, 20885-22854, 28527-30496, 36169-38138, 43811-45780, 51453-53422, and 59095-61064.

The amino acid sequences of exemplary CDRs comprising less than 4 amino acids are shown below in Table 7.

TABLE 7

Amino acid sequences and corresponding SEQ ID NOs of exemplary CDRs comprising less than 4 amino acids

| Amino Acid Sequence | SEQ ID NO |
|---|---|
| AR | 6478 |
| AK | 6479 |
| SNN | 6480 |
| VAS | 6481 |
| ATY | 6482 |
| TAY | 6483 |
| DND | 6484 |
| HGT | 6485 |
| DVS | 6486 |
| DTD | 6487 |
| GAS | 6488 |
| KAS | 6489 |
| DDS | 6490 |
| AAS | 6491 |
| SAS | 6492 |
| LGS | 6493 |
| WAS | 6494 |
| EDS | 6495 |
| DDD | 6496 |
| TDN | 6497 |
| LAS | 6498 |
| DAS | 6499 |
| EVR | 6500 |

TABLE 7-continued

Amino acid sequences and corresponding SEQ ID NOs of exemplary CDRs comprising less than 4 amino acids

| Amino Acid Sequence | SEQ ID NO |
|---|---|
| DDR | 6501 |
| AAI | 6502 |
| RAS | 6503 |

The nucleic acid (RNA) sequences of exemplary CDRs comprising less than 10 nucleotides are shown below in Table 8.

TABLE 8

RNA sequences and corresponding SEQ ID NOs of exemplary CDRs comprising less than 10 nucleotides

| RNA Sequence | SEQ ID NO |
|---|---|
| GCCCGC | 14120 |
| GCCAAG | 14121 |
| AGCAACAAC | 14122 |
| GUGGCCAGC | 14123 |
| GCCACCUAC | 14124 |
| ACCGCCUAC | 14125 |
| GACAACGAC | 14126 |
| CACGGCACC | 14127 |
| GACGUGAGC | 14128 |
| GACACCGAC | 14129 |

TABLE 8-continued

RNA sequences and corresponding SEQ ID NOs of exemplary CDRs comprising less than 10 nucleotides

| RNA Sequence | SEQ ID NO |
|---|---|
| GGCGCCAGC | 14130 |
| AAGGCCAGC | 14131 |
| GACGACAGC | 14132 |
| GCCGCCAGC | 14133 |
| AGCGCCUCC | 14134 |
| CUGGGCAGC | 14135 |
| UGGGCCAGC | 14136 |
| GAGGACAGC | 14137 |
| CAGGACGAC | 14138 |
| ACCGACAAC | 14139 |
| CUGGCCAGC | 14140 |
| GACGCCAGC | 14141 |
| GAGGUGCGC | 14142 |
| GACGACCGC | 14143 |
| GCCGCCAUC | 14144 |
| CGCGCCAGC | 14145 |
| GCCCGC | 21762 |
| GCCAAG | 21763 |
| UCCAACAAC | 21764 |
| GUCGCCUCC | 21765 |
| GCCACCUAC | 21766 |
| ACCGCCUAC | 21767 |
| GACAACGAC | 21768 |
| CACGGCACC | 21769 |
| GACGUCUCC | 21770 |
| GACACCGAC | 21771 |
| GGCGCCUCC | 21772 |
| AAGGCCUCC | 21773 |
| GACGACUCC | 21774 |
| GCCGCCUCC | 21775 |
| UCCGCCUCC | 21776 |
| CUCGGCUCC | 21777 |
| UGGGCCUCC | 21778 |
| GAGGACUCC | 21779 |
| CAGGACGAC | 21780 |
| ACCGACAAC | 21781 |
| CUCGCCUCC | 21782 |
| GACGCCUCC | 21783 |

TABLE 8-continued

RNA sequences and corresponding SEQ ID NOs of exemplary CDRs comprising less than 10 nucleotides

| RNA Sequence | SEQ ID NO |
|---|---|
| GAGGUCCGC | 21784 |
| GACGACCGC | 21785 |
| GCCGCCAUC | 21786 |
| CGCGCCUCC | 21787 |
| GCCAGA | 29404 |
| GCCAAG | 29405 |
| AGCAACAAU | 29406 |
| GUGGCCAGC | 29407 |
| GCCACCUAC | 29408 |
| ACCGCCUAC | 29409 |
| GACAACGAU | 29410 |
| CACGGCACC | 29411 |
| GACGUGAGC | 29412 |
| GACACCGAU | 29413 |
| GGCGCCAGC | 29414 |
| AAGGCCAGC | 29415 |
| GACGAUAGC | 29416 |
| GCCGCUAGC | 29417 |
| AGCGCCUCC | 29418 |
| CUGGGCAGC | 29419 |
| UGGGCCAGC | 29420 |
| GAGGACAGC | 29421 |
| CAGGACGAU | 29422 |
| ACCGACAAC | 29423 |
| CUGGCCAGC | 29424 |
| GACGCCAGC | 29425 |
| GAGGUGAGA | 29426 |
| GACGAUAGA | 29427 |
| GCCGCUAUC | 29428 |
| AGAGCCAGC | 29429 |
| GCCAGA | 37046 |
| GCCAAG | 37047 |
| AGCAACAAC | 37048 |
| GUGGCCAGC | 37049 |
| GCCACCUAC | 37050 |
| ACCGCCUAC | 37051 |
| GACAACGAC | 37052 |
| CACGGCACC | 37053 |

TABLE 8-continued

RNA sequences and corresponding SEQ ID NOs of exemplary CDRs comprising less than 10 nucleotides

| RNA Sequence | SEQ ID NO |
|---|---|
| GACGUGAGC | 37054 |
| GACACCGAC | 37055 |
| GGCGCCAGC | 37056 |
| AAGGCCAGC | 37057 |
| GACGACAGC | 37058 |
| GCCGCCAGC | 37059 |
| AGCGCCAGC | 37060 |
| CUGGGCAGC | 37061 |
| UGGGCCAGC | 37062 |
| GAGGACAGC | 37063 |
| CAGGACGAC | 37064 |
| ACCGACAAC | 37065 |
| CUGGCCAGC | 37066 |
| GACGCCAGC | 37067 |
| GAGGUGAGA | 37068 |
| GACGACAGA | 37069 |
| GCCGCCAUC | 37070 |
| AGAGCCAGC | 37071 |
| GCCAGA | 44688 |
| GCCAAG | 44689 |
| AGCAACAAU | 44690 |
| GUGGCCAGC | 44691 |
| GCCACCUAC | 44692 |
| ACCGCCUAC | 44693 |
| GACAACGAU | 44694 |
| CACGGCACC | 44695 |
| GACGUGAGC | 44696 |
| GACACCGAU | 44697 |
| GGCGCCAGC | 44698 |
| AAGGCCAGC | 44699 |
| GACGAUAGC | 44700 |
| GCCGCUAGC | 44701 |
| AGCGCCUCC | 44702 |
| CUGGGCAGC | 44703 |
| UGGGCCAGC | 44704 |
| GAGGACAGC | 44705 |
| CAGGACGAU | 44706 |
| ACCGACAAC | 44707 |
| CUGGCCAGC | 44708 |
| GACGCCAGC | 44709 |
| GAGGUGAGA | 44710 |
| GACGAUAGA | 44711 |
| GCCGCUAUC | 44712 |
| AGAGCCAGC | 44713 |
| GCGCGA | 52330 |
| GCCAAG | 52331 |
| AGCAAUAAC | 52332 |
| GUCGCUAGU | 52333 |
| GCCACAUAU | 52334 |
| ACCGCCUAC | 52335 |
| GAUAACGAU | 52336 |
| CACGGCACC | 52337 |
| GACGUAAGU | 52338 |
| GAUACAGAU | 52339 |
| GGCGCGAGU | 52340 |
| AAAGCCAGC | 52341 |
| GACGACAGU | 52342 |
| GCCGCUUCA | 52343 |
| AGCGCGAGC | 52344 |
| CUAGGCAGC | 52345 |
| UGGGCAAGU | 52346 |
| GAGGACAGU | 52347 |
| CAAGACGAC | 52348 |
| ACCGACAAC | 52349 |
| CUCGCUAGC | 52350 |
| GACGCCAGU | 52351 |
| GAGGUGAGA | 52352 |
| GACGAUAGA | 52353 |
| GCGGCUAUA | 52354 |
| CGCGCGAGC | 52355 |
| GCGCGG | 59972 |
| GCGAAG | 59973 |
| UCCAACAAC | 59974 |
| GUCGCCAGU | 59975 |
| GCCACCUAU | 59976 |
| ACCGCCUAC | 59977 |

TABLE 8-continued

RNA sequences and corresponding SEQ ID NOs of exemplary CDRs comprising less than 10 nucleotides

| RNA Sequence | SEQ ID NO |
|---|---|
| GAUAACGAU | 59978 |
| CACGGCACC | 59979 |
| GACGUGAGU | 59980 |
| GAUACCGAU | 59981 |
| GGCGCGAGU | 59982 |
| AAAGCGAGC | 59983 |
| GACGACAGU | 59984 |
| GCCGCCUCA | 59985 |
| AGCGCAAGU | 59986 |
| CUCGGCAGC | 59987 |
| UGGGCGAGU | 59988 |
| GAGGACAGU | 59989 |
| CAAGACGAC | 59990 |
| ACCGACAAC | 59991 |
| CUCGCCAGC | 59992 |
| GACGCGAGU | 59993 |
| GAGGUCAGG | 59994 |
| GACGACAGA | 59995 |
| GCGGCCAUA | 59996 |
| CGCGCGAGC | 59997 |

Preferably, the RNA according to the present invention comprises coding sequences encoding at least two CDRs of an antibody, more preferably at least three CDRs of an antibody, even more preferably at least four CDRs of an antibody, still more preferably at least five CDRs of an antibody, and most preferably six CDRs of an antibody.

It is also preferred that the at least one coding sequence of the RNA according to the present invention encodes a constant region of an antibody or a fragment or variant of constant region of an antibody. Typically, the constant region is identical in all antibodies of the same isotype, but differs in antibodies of different isotypes. Heavy chains γ, α and δ have a constant region composed of three tandem (in a line) immunoglobulin domains, and a hinge region for added flexibility; heavy chains μ and ε have a constant region composed of four immunoglobulin domains.

Preferably, the at least one coding sequence of the RNA according to the present invention encodes a heavy chain constant region of an antibody or a fragment or variant of heavy chain constant region of an antibody. It is also preferred that the at least one coding sequence encodes a light chain constant region of an antibody or a fragment or variant of light chain constant region of an antibody.

It is also preferred that the constant region encoded by the at least one coding sequence comprises or consists of an amino acid sequence as described in Table 9 below (referred to as "protein SEQ ID NO"). Particularly preferably, the at least one coding sequence comprises or consists of a nucleic acid sequence (RNA sequence) as described in Table 9 below (referred to as "RNA SEQ ID NO").

TABLE 9

Overview over the SEQ ID NOs of the amino acid sequences of preferred exemplary constant regions and of the respective encoding RNA sequences.

| Name | Protein SEQ ID NO: | RNA SEQ ID NO: |
|---|---|---|
| Ig_LightChain_kappa_constant_domain | 7571 | 15213, 22855, 30497, 38139, 45781, 53423, 61065 |
| Ig_LightChain_kappa_constant_domain | 7572 | 15214, 22856, 30498, 38140, 45782, 53424, 61066 |
| Ig_LightChain_lambda_constant_domain | 7573 | 15215, 22857, 30499, 38141, 45783, 53425, 61067 |
| Ig_LightChain_lambda_constant_domain | 7574 | 15216, 22858, 30500, 38142, 45784, 53426, 61068 |
| Ig_LightChain_lambda_constant_domain | 7575 | 15217, 22859, 30501, 38143, 45785, 53427, 61069 |
| Ig_LightChain_lambda_constant_domain | 7576 | 15218, 22860, 30502, 38144, 45786, 53428, 61070 |
| IgG1_HeavyChain_CH1_constant_domain | 7577 | 15219, 22861, 30503, 38145, 45787, 53429, 61071 |
| IgG1_HeavyChain_CH1_constant_domain | 7578 | 15220, 22862, 30504, 38146, 45788, 53430, 61072 |
| IgG1_HeavyChain_CH1_constant_domain | 7579 | 15221, 22863, 30505, 38147, 45789, 53431, 61073 |
| IgG1_HeavyChain_CH1_constant_domain | 7580 | 15222, 22864, 30506, 38148, 45790, 53432, 61074 |
| IgG1_HeavyChain_CH1_constant_domain | 7581 | 15223, 22865, 30507, 38149, 45791, 53433, 61075 |
| IgG1_HeavyChain_CH1_constant_domain | 7582 | 15224, 22866, 30508, 38150, 45792, 53434, 61076 |
| IgG1_HeavyChain_CH1_constant_domain | 7583 | 15225, 22867, 30509, 38151, 45793, 53435, 61077 |
| IgG1_HeavyChain_CH1_constant_domain | 7584 | 15226, 22868, 30510, 38152, 45794, 53436, 61078 |
| IgG1_HeavyChain_CH1_constant_domain | 7585 | 15227, 22869, 30511, 38153, 45795, 53437, 61079 |
| IgG1_HeavyChain_CH1_constant_domain | 7586 | 15228, 22870, 30512, 38154, 45796, 53438, 61080 |
| IgG1_HeavyChain_CH1_constant_domain | 7587 | 15229, 22871, 30513, 38155, 45797, 53439, 61081 |
| IgG1_HeavyChain_CH1_constant_domain | 7588 | 15230, 22872, 30514, 38156, 45798, 53440, 61082 |
| IgG1_HeavyChain_CH1_constant_domain | 7589 | 15231, 22873, 30515, 38157, 45799, 53441, 61083 |
| IgG1_HeavyChain_CH1_constant_domain | 7590 | 15232, 22874, 30516, 38158, 45800, 53442, 61084 |
| IgG1_HeavyChain_CH1_constant_domain | 7591 | 15233, 22875, 30517, 38159, 45801, 53443, 61085 |
| IgG1_HeavyChain_CH1_constant_domain | 7592 | 15234, 22876, 30518, 38160, 45802, 53444, 61086 |
| IgG1_HeavyChain_CH2_constant_domain | 7593 | 15235, 22877, 30519, 38161, 45803, 53445, 61087 |
| IgG1_HeavyChain_CH2_constant_domain | 7594 | 15236, 22878, 30520, 38162, 45804, 53446, 61088 |
| IgG1_HeavyChain_CH2_constant_domain | 7595 | 15237, 22879, 30521, 38163, 45805, 53447, 61089 |

TABLE 9-continued

Overview over the SEQ ID NOs of the amino acid sequences of preferred exemplary constant regions and of the respective encoding RNA sequences.

| Name | Protein SEQ ID NO: | RNA SEQ ID NO: |
|---|---|---|
| IgG1_HeavyChain_CH2_constant_domain | 7596 | 15238, 22880, 30522, 38164, 45806, 53448, 61090 |
| IgG1_HeavyChain_CH2_constant_domain | 7597 | 15239, 22881, 30523, 38165, 45807, 53449, 61091 |
| IgG1_HeavyChain_CH2_constant_domain | 7598 | 15240, 22882, 30524, 38166, 45808, 53450, 61092 |
| IgG1_HeavyChain_CH2_constant_domain | 7599 | 15241, 22883, 30525, 38167, 45809, 53451, 61093 |
| IgG1_HeavyChain_CH2_constant_domain | 7600 | 15242, 22884, 30526, 38168, 45810, 53452, 61094 |
| IgG1_HeavyChain_CH2_constant_domain | 7601 | 15243, 22885, 30527, 38169, 45811, 53453, 61095 |
| IgG1_HeavyChain_CH2_constant_domain | 7602 | 15244, 22886, 30528, 38170, 45812, 53454, 61096 |
| IgG1_HeavyChain_CH2_constant_domain | 7603 | 15245, 22887, 30529, 38171, 45813, 53455, 61097 |
| IgG1_HeavyChain_CH2_constant_domain | 7604 | 15246, 22888, 30530, 38172, 45814, 53456, 61098 |
| IgG1_HeavyChain_CH2_constant_domain | 7605 | 15247, 22889, 30531, 38173, 45815, 53457, 61099 |
| IgG1_HeavyChain_CH2_constant_domain | 7606 | 15248, 22890, 30532, 38174, 45816, 53458, 61100 |
| IgG1_HeavyChain_CH2_constant_domain | 7607 | 15249, 22891, 30533, 38175, 45817, 53459, 61101 |
| IgG1_HeavyChain_CH2_constant_domain | 7608 | 15250, 22892, 30534, 38176, 45818, 53460, 61102 |
| IgG1_HeavyChain_CH2_constant_domain | 7609 | 15251, 22893, 30535, 38177, 45819, 53461, 61103 |
| IgG1_HeavyChain_CH2_constant_domain | 7610 | 15252, 22894, 30536, 38178, 45820, 53462, 61104 |
| IgG1_HeavyChain_CH2_constant_domain | 7611 | 15253, 22895, 30537, 38179, 45821, 53463, 61105 |
| IgG1_HeavyChain_CH2_constant_domain | 7612 | 15254, 22896, 30538, 38180, 45822, 53464, 61106 |
| IgG1_HeavyChain_CH2_constant_domain | 7613 | 15255, 22897, 30539, 38181, 45823, 53465, 61107 |
| IgG1_HeavyChain_CH2_constant_domain | 7614 | 15256, 22898, 30540, 38182, 45824, 53466, 61108 |
| IgG1_HeavyChain_CH2_constant_domain | 7615 | 15257, 22899, 30541, 38183, 45825, 53467, 61109 |
| IgG1_HeavyChain_CH2_constant_domain | 7616 | 15258, 22900, 30542, 38184, 45826, 53468, 61110 |
| IgG1_HeavyChain_CH2_constant_domain | 7617 | 15259, 22901, 30543, 38185, 45827, 53469, 61111 |
| IgG1_HeavyChain_CH2_constant_domain | 7618 | 15260, 22902, 30544, 38186, 45828, 53470, 61112 |
| IgG1_HeavyChain_CH2_constant_domain | 7619 | 15261, 22903, 30545, 38187, 45829, 53471, 61113 |
| IgG1_HeavyChain_CH2_constant_domain | 7620 | 15262, 22904, 30546, 38188, 45830, 53472, 61114 |
| IgG1_HeavyChain_CH2_constant_domain | 7621 | 15263, 22905, 30547, 38189, 45831, 53473, 61115 |
| IgG1_HeavyChain_CH2_constant_domain | 7622 | 15264, 22909, 30548, 38190, 45832, 53474, 61116 |
| IgG1_HeavyChain_CH2_constant_domain | 7623 | 15265, 22907, 30549, 38191, 45833, 53475, 61117 |
| IgG1_HeavyChain_CH2_constant_domain | 7624 | 15266, 22908, 30550, 38192, 45834, 53476, 61118 |
| IgG1_HeavyChain_CH3_constant_domain | 7625 | 15267, 22909, 30551, 38193, 45835, 53477, 61119 |
| IgG1_HeavyChain_CH3_constant_domain | 7626 | 15268, 22910, 30552, 38194, 45836, 53478, 61120 |
| IgG1_HeavyChain_CH3_constant_domain | 7627 | 15269, 22911, 30553, 38195, 45837, 53479, 61121 |
| IgG1_HeavyChain_CH3_constant_domain | 7628 | 15270, 22912, 30554, 38196, 45838, 53480, 61122 |
| IgG2_HeavyChain_CH1_constant_domain | 7629 | 15271, 22913, 30555, 38197, 45839, 53481, 61123 |
| IgG2_HeavyChain_CH1_constant_domain | 7630 | 15272, 22914, 30556, 38198, 45840, 53482, 61124 |
| IgG2_HeavyChain_CH2_constant_domain | 7631 | 15273, 22915, 30557, 38199, 45841, 53483, 61125 |
| IgG2_HeavyChain_CH2_constant_domain | 7632 | 15274, 22916, 30558, 38200, 45842, 53484, 61126 |
| IgG2_HeavyChain_CH2_constant_domain | 7633 | 15275, 22917, 30559, 38201, 45843, 53485, 61127 |
| IgG2_HeavyChain_CH2_constant_domain | 7634 | 15276, 22918, 30560, 38202, 45844, 53486, 61128 |
| IgG2_HeavyChain_CH2_constant_domain | 7635 | 15277, 22919, 30561, 38203, 45845, 53487, 61129 |
| IgG2_HeavyChain_CH2_constant_domain | 7636 | 15278, 22920, 30562, 38204, 45846, 53488, 61130 |
| IgG2_HeavyChain_CH2_constant_domain | 7637 | 15279, 22921, 30563, 38205, 45847, 53489, 61131 |
| IgG2_HeavyChain_CH2_constant_domain | 7638 | 15280, 22922, 30564, 38206, 45848, 53490, 61132 |
| IgG2_HeavyChain_CH3_constant_domain | 7639 | 15281, 22923, 30565, 38207, 45849, 53491, 61133 |
| IgG4_HeavyChain_CH1_constant_domain | 7640 | 15282, 22924, 30565, 38208, 45850, 53492, 61134 |
| IgG4_HeavyChain_CH2_constant_domain | 7641 | 15283, 22925, 30567, 38209, 45851, 53493, 61135 |
| IgG4_HeavyChain_CH3_constant_domain | 7642 | 15284, 22926, 30568, 38210, 45852, 53494, 61136 |

Accordingly, it is preferred that the constant region or the fragment or variant thereof encoded by the at least one coding sequence comprises or consists of an amino acid sequence as set forth in any of SEQ ID NOs: 7571-7642. It is also preferred that the at least one coding sequence comprises or consists of a nucleic acid sequence as set forth in any of SEQ ID NOs: 15213-15284, 22855-22926, 30497-30568, 38139-38210, 45781-45852, 53423-53494, and 61065-61136.

Preferably, the RNA according to the present invention comprises (i) a coding sequence encoding a heavy chain variable region, or a fragment or variant thereof, and a heavy chain constant region, or a fragment or variant thereof; and/or (ii) a coding sequence encoding a light chain variable region, or a fragment or variant thereof, and a light chain constant region, or a fragment or variant thereof.

Preferably, the antibody or the fragment thereof, which is encoded by the RNA according to the present invention, is chosen from monoclonal and polyclonal antibodies or fragments thereof, chimeric antibodies or fragments thereof, human antibodies or fragments thereof, humanized antibodies or fragments thereof, and intrabodies or fragments thereof.

It is also preferred that the antibody or the fragment thereof, which is encoded by the RNA according to the present invention, is a monospecific or a multispecific antibody or antibody fragment. Preferably, the antibody or the fragment thereof, which is encoded by the RNA according to the present invention, is a bispecific or a trispecific antibody or antibody fragment.

As used herein, the term "multispecific" refers to the ability to bind to at least two different epitopes, e.g. on different antigens, whereas a monospecific antibody can only bind to one type of antigens (a monospecific antibody comprising one or more binding site for one and the same epitope). Thus, terms like "monospecific", "bispecific", "trispecific", "tetraspecific" etc. refer to the number of different epitopes to which the antibody can bind to. For example, conventional monospecific IgG-type antibodies have two identical epitope binding sites (paratopes) and can, thus, only bind to identical epitopes (but not to different epitopes). A multispecific antibody, in contrast, has at least two different types of paratopes and can, thus, bind to at least two different epitopes. Moreover, a single "specificity" may refer to one, two, three or more identical paratopes in a single antibody (the actual number of paratopes in one single antibody molecule is referred to as "valency"). For example, a single native IgG antibody is monospecific and bivalent, since it has two identical paratopes. Accordingly, a multispecific antibody comprises at least two (different) paratopes. Thus, the term "multispecific antibodies" refers to antibodies having more than one paratope and the ability to bind to two or more different epitopes. The term "multispecific antibodies" comprises in particular bispecific antibodies, but typically also antibodies, which bind in particular to three or more different epitopes, i.e. antibodies with three or more paratopes.

Accordingly, the present invention does not only provide RNA molecules encoding monospecific antibodies or fragments or variants thereof, but RNA molecules which code for multispecific, such as bispecific or trispecific, antibodies or fragments or variants thereof can also be provided in the context of the present invention. Bispecific antibodies in the context of the present invention are preferably antibodies which can act as adaptors between an effector and a corresponding target, e.g. for recruiting effector molecules (e.g. toxins, active compounds (drugs), cytokines etc.), targeting of effector cells (e.g. CTL, NK cells, macrophages, granulocytes etc. (see, for example, review by Kontermann R. E., Acta Pharmacol. Sin, 2005, 26(1): 1-9). In this context, bispecific antibodies are in principle built up such as is described here in general for antibodies, these bispecific antibodies e.g. recognizing two different antigens, immunogens or epitopes, or active compounds, cells, or other molecules (or structures) as mentioned above, i.e. the antigen-binding regions of the antibody are specific for two different molecules (or structures). The various antigens, immunogens or epitopes etc., for example, can thus be brought spatially close. Furthermore, by the binding e.g. of a binding domain or other specificities, the function of the antibody can be extended specifically, e.g. of a binding protein, an immunotoxin etc. Such bispecific antibodies can also be single-chain antibodies (e.g. scFv fragments etc.). Bispecific antibodies can be used, for example, to bring two reaction partners, e.g. two cells, two proteins, a protein and the substrate thereof etc., spatially close in order to promote an interaction between these (e.g. protein-protein interactions, substrate conversions, modifications etc.). Bispecific antibodies are preferably used above all to bring effector cells (such as, for example, T cells, NK cells, macrophages etc.) and target cells (e.g. tumour cells, infected cells etc.) spatially close. Examples of bispecific antibodies can include, without being limited thereto, e.g. those antibodies or antibody fragments which bind on the one hand a surface factor as described here, and on the other hand an antigen as described here, preferably a tumour antigen as described here. This includes e.g. CD28 and a tumour antigen (Grosse-Hovest L. et al., 2003, Eur. Immunol. 33(5); 1334-40, (A recombinant bispecific single-chain antibody induces targeted, supra-agonistic CD28-stimulation and tumor cell killing)), CD19 and CD3 (CD19 tumour antigen of B cell lymphoma) etc.

Preferably, the antibody fragment encoded by the RNA according to the present invention is selected from the group consisting of Nanobody; Nanobody-HAS; BiTE; Diabody; DART; TandAb; scDiabody; sc-Diabody-CH3; Diabody-CH3; Triple Body; Miniantibody; Minibody; TriBi minibody; scFv-CH3 KIH; Fab-scFv; scFv-CH-CL-scFv; F(ab')2; F(ab')2-scFv2; scFv-KIH; Fab-scFv-Fc; Tetravalent HCAb; scDiabody-Fc; Diabody-Fc; Tandem scFv-Fc; Fab; Fab'; Fc; Facb; pFc'; Fd; Fv or scFv antibody fragment. These bispecific antibody formats are shown and described for example in Spiess C., Zhai Q. and Carter P. J. (2015) Molecular Immunology 67: 95-106, in particular FIG. 1 and corresponding description, e.g. p. 95-101.

Preferably, the antibody or the fragment thereof, which is encoded by the RNA according to the present invention, comprises a binding site for an Fc receptor, in particular an Fc moiety. As used herein, the term "Fc moiety" refers to a sequence derived from the portion of an immunoglobulin heavy chain beginning in the hinge region just upstream of the papain cleavage site and ending at the C-terminus of the immunoglobulin heavy chain. Preferably, the "Fc moiety" comprises a binding site for an Fc receptor. However, it is also preferred that an Fc moiety may mediate a functionality different from binding to an Fc receptor, for example binding to a protein of the complement system. Accordingly, an "Fc moiety" may be a complete Fc region or a part (e.g., a domain) thereof. Preferably, the "Fc moiety" mediates the full functionality of a complete Fc region, e.g. including Fc receptor binding and, optionally, binding to a protein from the complement system. Thus, the antibody as used according to the present invention preferably comprises a complete Fc region, whereby a complete Fc region comprises at least a hinge domain, a CH2 domain, and a CH3 domain. The Fc moiety may also comprise one or more amino acid insertions, deletions, or substitutions relative to a naturally-occurring Fc region. For example, at least one of a hinge domain, CH2 domain or CH3 domain (or portion thereof) may be deleted. For example, an Fc moiety may comprise or consist of: (i) hinge domain (or portion thereof) fused to a CH2 domain (or portion thereof), (ii) a hinge domain (or portion thereof) fused to a CH3 domain (or portion thereof), (iii) a CH2 domain (or portion thereof) fused to a CH3 domain (or portion thereof), (iv) a hinge domain (or portion thereof), (v) a CH2 domain (or portion thereof), or (vi) a CH3 domain or portion thereof.

The antibody, or the antigen binding fragment thereof, which is encoded by the RNA according to the present invention, may be of any antibody format. In particular, antibodies preferably encompass "whole" antibodies, such as whole IgG- or IgG-like molecules, while antigen binding fragments in the context of the present invention preferably refer to small recombinant formats, such as bispecific T-cell engagers (BiTes), tandem single chain variable fragment molecules (taFvs), diabodies (Dbs), single chain diabodies (scDbs) and various other derivatives of these (cf. bispecific antibody formats as described by Byrne H. et al. (2013) Trends Biotech, 31 (11): 621-632 with FIG. 2 showing various bispecific antibody formats; Weidle U. H. et al. (2013) Cancer Genomics and Proteomics 10: 1-18, in particular FIG. 1 showing various bispecific antibody formats; and Chan, A. C. and Carter, P. J. (2010) Nat Rev Immu 10: 301-316 with FIG. 3 showing various bispecific antibody formats). Examples of bispecific antibody formats include, but are not limited to, quadroma, chemically coupled Fab (fragment antigen binding), and BiTE® (bispecific T cell engager). In one embodiment of the present invention the antibody used is preferably a BiTE® (bispecific T cell engager).

Thus, the antibody, or the antigen binding fragment thereof, which is encoded by the RNA according to the present invention, may be selected from the group comprising hybrid hybridoma (quadroma); Multispecific anticalin platform (Pieris); Diabodies; Single chain diabodies; Tandem single chain Fv fragments; TandAbs, Trispecific Abs (Affimed) (105-110 kDa); Darts (dual affinity retargeting; Macrogenics); Bispecific Xmabs (Xencor); Bispecific T cell engagers (Bites; Amgen; 55kDa); Triplebodies; Tribody=Fab-scFv Fusion Protein (CreativeBiolabs) multifunctional recombinant antibody derivates (110 kDa); Duobody platform (Genmab); Dock and lock platform; Knob into hole (KIH) platform; Humanized bispecific IgG antibody (REGN1979) (Regeneron); Mabe bispecific antibodies (F-Star); DVD-Ig=dual variable domain immunoglobulin (Abbvie); kappa-lambda bodies; TBTI=tetravalent bispecific tandem Ig; and CrossMab.

The antibody, or the antigen binding fragment thereof, which is encoded by the RNA according to the present invention, may be selected from bispecific IgG-like antibodies (BsIgG) comprising CrossMab; DAF (two-in-one); DAF (four-in-one); DutaMab; DT-IgG; Knobs-in-holes common LC; Knobs-in-holes assembly; Charge pair; Fab-arm exchange; SEEDbody; Triomab; LUZ-Y; Fcab; κλ-body; and Orthogonal Fab. These bispecific antibody formats are shown and described for example in Spiess C., Zhai Q. and Carter P. J. (2015) Molecular Immunology 67: 95-106, in particular FIG. 1 and corresponding description, e.g. p. 95-101.

Preferably, the antibody, or the antigen binding fragment thereof, which is encoded by the RNA according to the present invention, may be selected from IgG-appended antibodies with an additional antigen-binding moiety comprising DVD-IgG; IgG(H)-scFv; scFv-(H)IgG; IgG(L)-scFv; scFV-(L)IgG; IgG(L,H)-Fv; IgG(H)-V; V(H)-IgG; IgG(L)-V; V(L)-IgG; KIH IgG-scFab; 2scFv-IgG; IgG-2scFv; scFv4-Ig; scFv4-Ig; Zybody; and DVI-IgG (four-in-one). These bispecific antibody formats are shown and described for example in Spiess C., Zhai Q. and Carter P. J. (2015) Molecular Immunology 67: 95-106, in particular FIG. 1 and corresponding description, e.g. p. 95-101.

Preferably, the antibody, or the antigen binding fragment thereof, which is encoded by the RNA according to the present invention, may be selected from bispecific antibody fragments comprising Nanobody; Nanobody-HAS; BiTE; Diabody; DART; TandAb; scDiabody; sc-Diabody-CH3; Diabody-CH3; Triple Body; Miniantibody; Minibody; TriBi minibody; scFv-CH3 KIH; Fab-scFv; scFv-CH-CL-scFv; F(ab')2; F(ab')2-scFv2; scFv-KIH; Fab-scFv-Fc; Tetravalent HCAb; scDiabody-Fc; Diabody-Fc; Tandem scFv-Fc; and Intrabody. These bispecific antibody formats are shown and described for example in Spiess C., Zhai Q. and Carter P. J. (2015) Molecular Immunology 67: 95-106, in particular FIG. 1 and corresponding description, e.g. p. 95-101.

Preferably, the antibody, or the antigen binding fragment thereof, which is encoded by the RNA according to the present invention, may be selected from bispecific fusion proteins comprising Dock and Lock; ImmTAC; HSAbody; scDiabody-HAS; and Tandem scFv-Toxin. These bispecific antibody formats are shown and described for example in Spiess C., Zhai Q. and Carter P. J. (2015) Molecular Immunology 67: 95-106, in particular FIG. 1 and corresponding description, e.g. p. 95-101.

In particular, the antibody, or the antigen binding fragment thereof, which is encoded by the RNA according to the present invention, may be selected from bispecific antibody conjugates comprising IgG-IgG; Cov-X-Body; and scFv1-PEG-scFv2. These bispecific antibody formats are shown and described for example in Spiess C., Zhai Q. and Carter P. J. (2015) Molecular Immunology 67: 95-106, in particular FIG. 1 and corresponding description, e.g. p. 95-101.

Depending on the amino acid sequence of the constant region of their heavy chains, antibodies or immunoglobulins are divided in the classes: IgA, IgD, IgE, IgG and IgM, and several of these may be further divided into subclasses, e.g. IgG1, IgG2, IgG3, and IgG4, IgA1 and IgA2. The heavy chain constant regions that correspond to the different classes of immunoglobulins are called α, ε, γ, and μ, respectively. The antibodies according to the invention are preferably of IgG type. It is also preferred that the antibody, which is encoded by the RNA according to the present invention, has an IgG-like format, which includes, in addition to IgG type antibodies, recombinant antibodies based on IgG, such as the IgG-appended antibodies and the bispecific IgG-like antibodies described above.

Preferably, the antibody, or the antigen binding fragment thereof, which is encoded by the RNA according to the present invention, is a single-chain antibody or a single-chain antibody fragment. It is also preferred that the antibody, or the antigen binding fragment thereof, which is encoded by the RNA according to the present invention, is a multiple-chain antibody or a multiple-chain antibody fragment. The term "chain", as used herein, in particular in the context of a single-chain and a multiple-chain antibody, typically refers to a chain of amino acids connected by a peptide bond, such that a "chain" typically refers to a single peptide or protein. Accordingly, in particular two peptides/proteins connected via disulfide bridges (also referred to as "SS-bonds") do not form a single chain. For example, an sc-Fv antibody, wherein the variable regions are connected via a peptide linker is referred to—in the context of the present invention—as a single-chain antibody, whereas it were referred to as a multiple-chain antibody, if the variable regions are connected via a disulfide bridge.

It is also preferred that the antibody, or the antigen binding fragment thereof, which is encoded by the RNA according to the present invention, specifically recognizes and binds to tumour-specific surface antigens chosen from (TSSA), 5T4, α5β1-integrin, 707-AP, AFP, ART-4, B7H4, BAGE, β-catenin/m, Bcr-abl, MN/C IX-antigen, CA125, CAMEL, CAP-1, CASP-8, β-catenin/m, CD4, CD19, CD20, CD22, CD25, CDC27/m, CD 30, CD33, CD52, CD56, CD80, CDK4/m, CEA, CT, Cyp-B, DAM, EGFR, ErbB3, ELF2M, EMMPRIN, EpCam, ETV6-AML1, G250, GAGE, GnT-V, Gp100, HAGE, HER-2/neu, HLA-A*0201-R170I, HPV-E7, HSP70-2M, HAST-2, hTERT (or hTRT), iCE, IGF-1R, IL-2R, IL-5, KIAA0205, LAGE, LDLR/FUT, MAGE, MART-1/Melan-A, MART-2/Ski, MC1R, myosin/m, MUC1, MUM-1, -2, -3, NA88-A, PAP, proteinase-3, p190 minor bcr-abl, Pml/RARα, PRAME, PSA, PSM, PSMA, RAGE, RU1 or RU2, SAGE, SART-1 or SART-3, survivin, TEL/AML1, TGFβ, TPI/m, TRP-1, TRP-2, TRP-2/INT2, VEGF and WT1, NY-Eso-1 and NY-Eso-B, as described above.

Preferably, the at least one coding sequence of the RNA according to the present invention encodes an antibody selected from the group consisting of AAB-003; Abagovomab; Abciximab; Abituzumab; Abrilumab; Actoxumab; Adalimumab; Aducanumab; Afasevikumab; Aflibercept; Afutuzuab; Afutuzumab; Alacizumab_pegol; Alemtuzumab; Alirocumab; ALX-0061; Amatuximab; Anetumab_ravtansine; Anifrolumab; Anrukinzumab; Apolizumab; Apomab; Aquaporumab; Arcitumomab_99tc; Ascrinvacumab; Aselizuab; Atezolizumab; Atinumab; Atlizumab; Aurograb; Avelumab; Bapineuzumab; Basiliximab; Bavituximab; Begelomab; Benralizumab; Betalutin; Bevacituzuab; Bevacizumab_154-aspartic_acid; Bevacizumab_154-substitution; Bevacizumab_180-serine;

Bevacizumab_180-substitution; Bevacizumab_beta; Bevacizumab; Bevacizumab-rhuMAb-VEGF; Bezlotoxumab; Bimagrumab; Bimekizumab; Bleselumab; Blinatumomab; Blinatumumab; Blontuvetmab; Blosozumab; Bococizumab; Brentuximab_vedotin; Briakinumab; Brodalumab; Brolucizumab; Bronticuzumab; BTT-1023; Burosumab; Canakinumab; Cantuzumab; Cantuzumab_mertansine; Cantuzumab_ravtansine; Caplacizumab; Carlumab; Cergutuzumab_amunaleukin; Certolizumab_pegol; Cetuximab; Citatuzumab_bogatox; Cixutumumab; Clazakizumab; Clivatuzumab_tetraxetan; Codrituzumab; Coltuximab_ravtansine; Conatumumab_CV; Conatumumab; Concizumab; Crenezumab; Crotedumab; Dacetuzumab; Dacliximab; Daclizumab; Dalotuzumab; Dapirolizumab_pegol; Daratumumab; Dectrekumab; Demcizumab; Denintuzumab_mafodotin; Denosumab; Depatuxizumab; Depatuxizumab_mafodotin; Dinutuximab_beta; Dinutuximab; Diridavumab; Domagrozumab; Drozituab; Drozitumab; Duligotumab; Duligotuzumab; Dupilumab; Durvalumab; Dusigitumab; Ecromeximab; Eculizumab; Efalizumab; Efungumab; Eldelumab; Elgemtumab; Elotuzumab; Emactuzumab; Emibetuzumab; Emicizumab; Enavatuzumab; Enfortumab; Enfortumab_vedotin; Enoblituzumab; Enokizumab; Enoticumab; Ensituximab; Entolimod; Epratuzumab; Eptacog_beta; Erlizumab; Etaracizumab; Etrolizuab; Etrolizumab; Evinacumab; Evolocumab; Exbivirumab; Farletuzumab; Fasinumab; Fezakinumab; FG-3019; Fibatuzumab; Ficlatuzumab; Figitumumab; Firivumab; Flanvotumab; Fletikumab; Fontolizumab; Foralumab; Foravirumab; Fresolimumab; Fulranumab; Futuximab; Galcanezumab; Galiximab; Ganitumab; Gantenerumab; Gemtuzumab; Gemtuzumab_ozogamicin; Gevokizumab; Girentuximab; Glembatumumab; Goilixiab; Guselkumab; HuMab-001; HuMab-005; HuMab-006; HuMab-019; HuMab-021; HuMab-025; HuMab-027; HuMab-032; HuMab-033; HuMab-035; HuMab-036; HuMab-041; HuMab-044; HuMab-049; HuMab-050; HuMab-054; HuMab-055; HuMab-059; HuMab-060; HuMab-067; HuMab-072; HuMab-084; HuMab-091; HuMab-093; HuMab-098; HuMab-100; HuMab-106; HuMab_10F8; HuMab-111; HuMab-123; HuMab-124; HuMab-125; HuMab-127; HuMab-129; HuMab-132; HuMab-143; HuMab-150; HuMab-152; HuMab-153; HuMab-159; HuMab-160; HuMab-162; HuMab-163; HuMab-166; HuMab-167; HuMab-169; HuMab-7D8; huMAb-anti-MSP10.1; huMAb-anti-MSP10.2; HUMAB-Clone_18; HUMAB-Clone_22; HuMab-L612; HuMab_LC5002-002; HuMab_LC5002-003; HuMab_LC5002-005; HuMab_LC5002-007; HuMab_LC5002-018; Ibalizumab; Ibritumomab_tiuxetan; Icrucumab; Idarucizumab; Igatuzuab; IGF-IR_HUMAB-1A; IGF-IR_HUMAB-23; IGF-IR_HUMAB-8; ImAb1; Imalumab; Imgatuzumab; Inclacumab; Indatuximab_ravtansine; Indusatumab_vedotin; Inebilizumab; Insulin_peglispro; Interferon_beta-1b; Intetumumab; Iodine_(124I)_Girentuximab; Iodine_(131I)_Derlotuxiab_biotin; Iodine_(131I)_Derlotuximab_biotin; Ipilimumab; Iratumumab; Isatuximab; Itolizumab; Ixekizumab; Labetuzumab_govitecan; Lambrolizumab; Lampalizumab; Lanadelumab; Landogrozumab; Laprituximab_emtansine; Lealesoab; Lebrikizumab; Lenercept_chain1; Lenzilumab; Lerdelimumab; Lexatumumab; Libivirumab; Lifastuzumab; Lifastuzumab_vedotin; Ligelizumab; Lilotomab; Lintuzumab; Lirilumab; Lodelcizumab; Lokivetmab; Lorvotuzumab_mertansine; Lpathomab; Lucatumumab; Lulizumab_pegol; Lumiliximab; Lumretuzumab; Lutetium_(177Lu)_lilotomab_satetraxetan; Margetuximab; Marzeptacog_alfa; Matuzumab; Mavrilimumab; MDX-1303; Mepolizumab; Metelimumab; Milatuzumab; Mirvetuximab; Modotuximab; Mogamulizumab; Monalizumab; Motavizumab; Moxetumomab_pasudotox; Muromonab-CD3; Namilumab; Naptumomab_estafenatox; Narnatumab; Natalizumab; Navicixizumab; Navivumab; Ndimab-varB; Necitumumab; Neliximab; Nemolizumab; Nesvacumab; Neuradiab; Nimotuzumab; Nivolumab; Obiltoxaximab; Obinutuzumab; Ocaratuzumab; Ocrelizumab; Ofatumumab; Olaratumab; Olizuab; Olokizumab; Omalizumab; Onartuzumab; Ontuxizumab; Opicinumab; Oportuzumab_monatox; Oreptacog_alfa; Orticumab; Otelixizumab; Otlertuzumab; Oxelumab; Ozanezumab; Ozoralizumab; Palivizumab; Pamrevlumab; Panitumumab; Pankoab; PankoMab; Panobacumab; Parsatuzumab; Pascolizumab; Pasotuxizumab; Pateclizumab; Patritumab; Pembrolizumab; Perakizumab; Pertuzuab; Pertuzumab; Pexelizumab_h5g1.1-scFv; Pexelizumab; PF-05082566; PF-05082568; Pidilizumab; Pinatuzumab_vedotin; Placulumab; Plozalizumab; Pogalizumab; Polatuzumab_vedotin; Ponezumab; Pritoxaximab; Pritumumab; Quilizumab; Racotumomab; Radretumab; Rafivirumab; Ralpancizumab; Ramucirumab; Ranibizivab; Ranibizumab; Refanezumab; REGN2810; rhuMab_HER2 (9CI); rhuMab_HER2; rhuMAb-VEGF; Rilotumumab; Rinucumab; Risankizumab; Rituximab; Rivabazumab_pegol; Robatumumab; Roledumab; Romosozumab; Rontalizuab; Rontalizumab; Rovalpituzumab_tesirine; Rovelizumab; Ruplizumab; Sacituzumab_govitecan; Samalizumab; Sarilumab; Satumomab_pendetide; Secukinumab; Seribantumab; Setoxaximab; Sifalimumab; Siltuximab; Simtuzumab; Sirukumab; Sofituzumab_vedotin; Solanezumab; Solitomab; Sonepcizumab; Stamulumab; Suptavumab; Suvizumab; Tabalumab; Tacatuzuab; Tadocizumab; Talizumab; Tamtuvetmab; Tanezumab; Tarextumab; Tefibazumab; Tenatumomab; Teneliximab; Teplizumab; Teprotumumab; Tesidolumab; Tezepelumab; ThioMAb-chMA79b-HC(A118C); ThioMab-hu10A8.v1-HC(A118C); ThioMab-hu10A8.v1-HC(V205C); ThioMab-hu10A8.v1-LC(A118C); ThioMab-hu10A8.v1-LC(V205C); ThioMAb-huMA79b.v17-HC(A118C); ThioMAb-huMA79b.v18-HC(A118C); ThioMAb-huMA79b.v28-HC(A118C); ThioMAb-huMA79b.v28-LC(V205C); Ticilivab; Tigatuzumab; Tildrakizumab; Tisotumab_vedotin; Tocilizumab; Tosatoxumab; Tositumomab; Tovetumab; Tralokinumab; Trastuzuab; Trastuzumab_emtansine; Trastuzumab; TRC-105; Tregalizumab; Tremelimumab; Trevogrumab; Tucotuzumab_celmoleukin; Ublituximab; Ulocuplumab; Urelumab; Urtoxazumab; Ustekinumab; Vadastuximab_talirine; Vandortuzumab_vedotin; Vanticumab; Vanucizumab; Varlilumab; Vatelizumab; Vedolizumab; Veltuzumab; Vesencumab; Visilizumab; Volociximab; Vorsetuzumab; Vorsetuzumab_mafodotin; Yttrium_(90Y)_clivatuzumab_tetraxetan; Yttrium_Y_90_epratuzumab_tetraxetan; Yttrium_Y_90_epratuzumab; Zalutumumab; Zanolimumab; Zatuximab; Andecaliximab; Aprutumab; Azintuxizumab; Brazikumab; Cabiralizumab; Camrelizumab; Cosfroviximab; Crizanlizumab; Dezamizumab; Duvortuxizumab; Elezanumab; Emapalumab; Eptinezumab; Erenumab; Fremanezumab; Frunevetmab; Gatipotuzumab; Gedivumab; Gemetuzumab; Gilvetmab; Ifabotuzumab; Lacnotuzumab; Larcaviximab; Lendalizumab; Lesofavumab; Letolizumab; Losatuxizumab; Lupartumab; Lutikizumab; Oleclumab; Porgaviximab; Prezalumab; Ranevetmab; Remtolumab; Rosmantuzumab; Rozanolixizumab; Sapelizumab; Selicrelumab; Suvratoxumab; Tavolixizumab; Telisotuzumab; Telisotuzumab_vedotin; Timigutuzumab;

Timolumab; Tomuzotuximab; Trastuzumab_duocarmazine; Varisacumab; Vunakizumab; Xentuzumab; anti-rabies_SO57; anti-rabies_SOJB; anti-rabies_SOJA; anti-rabies; anti-RSV_SITB; anti-alpha-toxin_4U6V; anti-IsdB_5D1Q; anti-IsdB_5D1X; anti-IsdB_5D1Z; anti-HIV b12; anti-HIV_2G12; anti-HIV_4E10; anti-HIV_VRC01; anti-HIV_PG9; anti-HIV_VRC07; anti-HIV_3BNC117; anti-HIV_10-1074; anti-HIV_PGT121; anti-HIV_PGDM1400; anti-HIV_N6; anti-HIV_10E8; anti-HIV_12A12; anti-HIV_12A21; anti-HIV_35022; anti-HIV_3BC176; anti-HIV_3BNC55; anti-HIV_3BNC60; anti-HIV_447-52D; anti-HIV_5H/I1-BMV-D5; anti-HIV_8ANC195; anti-HIV_CAP256-VRC26.01; anti-HIV_CAP256-VRC26.02; anti-HIV_CAP256-VRC26.03; anti-HIV_CAP256-VRC26.04; anti-HIV_CAP256-VRC26.05; anti-HIV_CAP256-VRC26.06; anti-HIV_CAP256-VRC26.07; anti-HIV_CAP256-VRC26.08; anti-HIV_CAP256-VRC26.09; anti-HIV_CAP256-VRC26.10; anti-HIV_CAP256-VRC26.11; anti-HIV_CAP256-VRC26.12; anti-HIV_CAP256-VRC26.I1; anti-HIV_CAP256-VRC26.I2; anti-HIV_CAP256-VRC26.UCA; anti-HIV_CH01; anti-HIV_CH02; anti-HIV_CH03; anti-HIV_CH04; anti-HIV_CH103; anti-HIV_M66.6; anti-HIV_NIH45-46; anti-HIV_PG16; anti-HIV_PGT122; anti-HIV_PGT123; anti-HIV_PGT125; anti-HIV_PGT126; anti-HIV_PGT127; anti-HIV_PGT128; anti-HIV_PGT130; anti-HIV_PGT131; anti-HIV_PGT135; anti-HIV_PGT136; anti-HIV_PGT137; anti-HIV_PGT141; anti-HIV_PGT142; anti-HIV_PGT143; anti-HIV_PGT144; anti-HIV_PGT145; anti-HIV_PGT151; anti-HIV_PGT152; anti-HIV_VRC-CH30; anti-HIV_VRC-CH31; anti-HIV_VRC-CH32; anti-HIV_VRC-CH33; anti-HIV_VRC-CH34; anti-HIV_VRC-PG04; anti-HIV_VRC-PG04b; anti-HIV_VRC-PG20; anti-HIV_VRC02; anti-HIV_VRC03; anti-HIV_VRC23; anti-HIV_5CCK; anti-HIV_5AWN; anti-HIV_3QEG; anti-HIV_1N0X; anti-HIV_3QEH; anti-HIV_2B1H; anti-HIV_3TNM; anti-HIV_3UJJ; anti-HIV_3UJI; anti-HIV_2QSC; anti-HIV_3MLZ; anti-HIV_3MLX; anti-HIV_3MLW; anti-HIV_3MLV; anti-HIV_3MLU; anti-HIV_3MLT; anti-HIV_3GO1; anti-HIV_4XCY; anti-HIV_4YBL; anti-HIV_4R4N; anti-HIV_4R4B; anti-HIV_3JUY; anti-HIV_4KG5; anti-HIV-1; anti-HIV_V3; anti-HIV_CD4bs; anti-HIV_V2; anti-HIV_C38-VRC18.02; anti-HIV_44-VRC13.02; anti-HIV_45; anti-HIV_cap256-206-252885; anti-HIV_cap256-206-249183; anti-HIV_cap256-206-220956; anti-HIV_cap256-206-220629; anti-HIV_cap256-206-200599; anti-HIV_cap256-206-186347; anti-HIV_cap256-206-186226; anti-HIV_cap256-206-179686; anti-HIV_cap256-206-173707; anti-HIV_cap256-206-173339; anti-HIV_cap256-206-172689; anti-HIV_cap256-206-162744; anti-HIV_cap256-206-146057; anti-HIV_cap256-206-139519; anti-HIV_cap256-206-136316; anti-HIV_cap256-206-116098; anti-HIV_cap256-206-115862; anti-HIV_cap256-206-107018; anti-HIV_cap256-206-098644; anti-HIV_cap256-206-098135; anti-HIV_cap256-206-096276; anti-HIV_cap256-206-092794; anti-HIV_cap256-206-086817; anti-HIV_cap256-206-086446; anti-HIV_cap256-206-086180; anti-HIV_cap256-206-083708; anti-HIV_cap256-206-079556; anti-HIV_cap256-206-078657; anti-HIV_cap256-206-075802; anti-HIV_cap256-206-069097; anti-HIV_cap256-206-067758; anti-HIV_cap256-206-057019; anti-HIV_cap256-206-055385; anti-HIV_cap256-206-053187; anti-HIV_cap256-206-053139; anti-HIV_cap256-206-050350; anti-HIV_cap256-206-046207; anti-HIV_cap256-206-043389; anti-HIV_cap256-206-042555; anti-HIV_cap256-206-029720; anti-HIV_cap256-206-028848; anti-HIV_cap256-206-027652; anti-HIV_cap256-206-024075; anti-HIV_cap256-206-008748; anti-HIV_cap256-206-008530; anti-HIV_cap256-176-723043; anti-HIV_cap256-176-600049; anti-HIV_cap256-176-531926; anti-HIV_cap256-176-504134; anti-HIV_cap256-119-186229; anti-HIV_cap256-119-183891; anti-HIV_cap256-119-183631; anti-HIV_cap256-119-182676; anti-HIV_cap256-119-180772; anti-HIV_cap256-119-180508; anti-HIV_cap256-119-180260; anti-HIV_cap256-119-180173; anti-HIV_cap256-119-179839; anti-HIV_cap256-119-179262; anti-HIV_cap256-119-178995; anti-HIV_cap256-119-178455; anti-HIV_cap256-119-177993; anti-HIV_cap256-119-177727; anti-HIV_cap256-119-176746; anti-HIV_cap256-119-176241; anti-HIV_cap256-119-175215; anti-HIV_cap256-119-173928; anti-HIV_cap256-119-173495; anti-HIV_cap256-119-172882; anti-HIV_cap256-119-172429; anti-HIV_cap256-119-172223; anti-HIV_cap256-119-171838; anti-HIV_cap256-119-171587; anti-HIV_cap256-119-169596; anti-HIV_cap256-119-169523; anti-HIV_cap256-119-169462; anti-HIV_cap256-119-169092; anti-HIV_cap256-119-168680; anti-HIV_cap256-119-166385; anti-HIV_cap256-119-165943; anti-HIV_cap256-119-165738; anti-HIV_cap256-119-164913; anti-HIV_cap256-119-164167; anti-HIV_cap256-119-163558; anti-HIV_cap256-119-162043; anti-HIV_cap256-119-161718; anti-HIV_cap256-119-161675; anti-HIV_cap256-119-161053; anti-HIV_cap256-119-159499; anti-HIV_cap256-119-159114; anti-HIV_cap256-119-156751; anti-HIV_cap256-119-155656; anti-HIV_cap256-119-154420; anti-HIV_cap256-119-153954; anti-HIV_cap256-119-153864; anti-HIV_cap256-119-153793; anti-HIV_cap256-119-153462; anti-HIV_cap256-119-153124; anti-HIV_cap256-119-153025; anti-HIV_cap256-119-152713; anti-HIV_cap256-119-151794; anti-HIV_cap256-119-150980; anti-HIV_cap256-119-148895; anti-HIV_cap256-119-148848; anti-HIV_cap256-119-148743; anti-HIV_cap256-119-148595; anti-HIV_cap256-119-148490; anti-HIV_cap256-119-148470; anti-HIV_cap256-119-148107; anti-HIV_cap256-119-147933; anti-HIV_cap256-119-147434; anti-HIV-cap256-119-146106; anti-HIV_cap256-119-145604; anti-HIV_cap256-119-143998; anti-HIV_cap256-119-143441; anti-HIV_cap256-119-141307; anti-HIV_cap256-119-140896; anti-HIV_cap256-119-140090; anti-HIV_cap256-119-140037; anti-HIV_cap256-119-139135; anti-HIV_cap256-119-137881; anti-HIV_cap256-119-137643; anti-HIV_cap256-119-137170; anti-HIV_cap256-119-136616; anti-HIV_cap256-119-136206; anti-HIV_cap256-119-135565; anti-HIV_cap256-119-135025; anti-HIV_cap256-119-133983; anti-HIV_cap256-119-133917; anti-HIV_cap256-119-132663; anti-HIV_cap256-119-132113; anti-HIV_cap256-119-131839; anti-HIV_cap256-119-130626; anti-HIV_cap256-119-130191; anti-HIV_cap256-119-129798; anti-HIV_cap256-119-128745; anti-HIV_cap256-119-128593; anti-HIV_cap256-119-128152; anti-HIV_cap256-119-127693; anti-HIV_cap256-119-126684; anti-HIV_cap256-119-126056; anti-HIV_cap256-119-125765; anti-HIV_cap256-119-125106; anti-HIV_cap256-119-124026; anti-HIV_cap256-119-121783; anti-HIV_cap256-119-121208; anti-HIV_cap256-119-120945; anti-HIV_cap256-119-118229; anti-HIV_cap256-119-118025; anti-HIV_cap256-119-117418; anti-HIV_cap256-119-117250; anti-HIV_cap256-119-117230; anti-HIV_cap256-119-116999; anti-HIV_cap256-119-116558; anti-HIV_cap256-119-116484; anti-HIV_cap256-119-114844; anti-HIV_cap256-119-114141; anti- HIV_cap256-119-111917; anti-HIV_cap256-119-111862; anti-HIV_cap256-119-110064; anti-HIV_cap256-119-109192; anti-HIV_cap256-119-108793; anti-HIV_cap256-119-108127; anti-HIV_cap256-119-107758; anti-HIV_cap256-119-107209; anti-HIV_cap256-119-107184; anti-HIV_cap256-119-106827; anti-HIV_cap256-119-106511; anti-HIV_cap256-119-106327; anti-HIV_cap256-119-105486; anti-HIV_cap256-119-105197; anti-HIV_cap256-119-104946; anti-HIV_cap256-119-103667; anti-HIV_cap256-119-103385; anti-HIV_cap256-119-103267; anti-HIV_cap256-119-103011; anti-HIV_cap256-119-102072; anti-HIV_cap256-119-101945; anti-HIV_cap256-119-101319; anti-HIV_cap256-119-100871; anti-HIV_cap256-119-100838; anti-HIV_cap256-119-100025; anti-HIV_cap256-119-100000; anti-HIV_cap256-119-098890; anti-HIV_cap256-119-098715; anti-HIV_cap256-119-098632; anti-HIV_cap256-119-097199; anti-HIV_cap256-119-096189; anti-HIV_cap256-119-094581; anti-HIV_cap256-119-094200; anti-HIV_cap256-119-094158; anti-HIV_cap256-119-092814; anti-HIV_cap256-119-092808; anti-HIV_cap256-119-092573; anti-HIV_cap256-119-090815; anti-HIV_cap256-119-090368; anti-HIV_cap256-119-089710; anti-HIV_cap256-119-088555; anti-HIV_cap256-119-087962; anti-HIV_cap256-119-086903; anti-HIV_cap256-119-086804; anti-HIV_cap256-119-085910; anti-HIV_cap256-119-085772; anti-HIV_cap256-119-084603; anti-HIV_cap256-119-084276; anti-HIV_cap256-119-082288; anti-HIV_cap256-119-080383; anti-HIV_cap256-119-079333; anti-HIV_cap256-119-078618; anti-HIV_cap256-119-077466; anti-HIV_cap256-119-076284; anti-HIV_cap256-119-074680; anti-HIV_cap256-119-074081; anti-HIV_cap256-119-071704; anti-HIV_cap256-119-071266; anti-HIV_cap256-119-069667; anti-HIV_cap256-119-069591; anti-HIV_cap256-119-068691; anti-HIV_cap256-119-068488; anti-HIV_cap256-119-067536; anti-HIV_cap256-119-065852; anti-HIV_cap256-119-065457; anti-HIV_cap256-119-064501; anti-HIV_cap256-119-063568; anti-HIV_cap256-119-063103; anti-HIV_cap256-119-061027; anti-HIV_cap256-119-058232; anti-HIV_cap256-119-057341; anti-HIV_cap256-119-056895; anti-HIV_cap256-119-056402; anti-HIV_cap256-119-056034; anti-HIV_cap256-119-055042; anti-HIV_cap256-119-054776; anti-HIV_cap256-119-054539; anti-HIV_cap256-119-054112; anti-HIV_cap256-119-053339; anti-HIV_cap256-119-052404; anti-HIV_cap256-119-051123; anti-HIV_cap256-119-051077; anti-HIV_cap256-119-050442; anti-HIV_cap256-119-049433; anti-HIV_cap256-119-047532; anti-HIV_cap256-119-047489; anti-HIV_cap256-119-046020; anti-HIV_cap256-119-044746; anti-HIV_cap256-119-044740; anti-HIV_cap256-119-043790; anti-HIV_cap256-119-042880; anti-HIV_cap256-119-042606; anti-HIV_cap256-119-042444; anti-HIV_cap256-119-040328; anti-HIV_cap256-119-040164; anti-HIV_cap256-119-039130; anti-HIV_cap256-119-038138; anti-HIV_cap256-119-037868; anti-HIV_cap256-119-037102; anti-HIV_cap256-119-036683; anti-HIV_cap256-119-036495; anti-HIV_cap256-119-035375; anti-HIV_cap256-119-035165; anti-HIV_cap256-119-035109; anti-HIV_cap256-119-033789; anti-HIV_cap256-119-033641; anti-HIV_cap256-119-032113; anti-HIV_cap256-119-031739; anti-HIV_cap256-119-030932; anti-HIV_cap256-119-030740; anti-HIV_cap256-119-030197; anti-HIV_cap256-119-027047; anti-HIV_cap256-119-026950; anti-HIV_cap256-119-026279; anti-HIV_cap256-119-025355; anti-HIV_cap256-119-025301; anti-HIV_cap256-119-025010; anti-HIV_cap256-119-024631; anti-HIV_cap256-119-024467; anti-HIV_cap256-119-023805; anti-HIV_cap256-119-021736; anti-HIV_cap256-119-021203; anti-HIV_cap256-119-020569; anti-HIV_cap256-119-019432; anti-HIV_cap256-119-018827; anti-HIV_cap256-119-018483; anti-HIV_cap256-119-018118; anti-HIV_cap256-119-017782; anti-HIV_cap256-119-017669; anti-HIV_cap256-119-016976; anti-HIV_cap256-119-015432; anti-HIV_cap256-119-015281; anti-HIV_cap256-119-014957; anti-HIV_cap256-119-014777; anti-HIV_cap256-119-014313; anti-HIV_cap256-119-014219; anti-HIV_cap256-119-013631; anti-HIV_cap256-119-012924; anti-HIV_cap256-119-011793; anti-HIV_cap256-119-011413; anti-HIV_cap256-119-011323; anti-HIV_cap256-119-011233; anti-HIV_cap256-119-009038; anti-HIV_cap256-119-008756; anti-HIV_cap256-119-008055; anti-HIV_cap256-119-006949; anti-HIV_cap256-119-006685; anti-HIV_cap256-119-006015; anti-HIV_cap256-119-005841; anti-HIV_cap256-119-005824; anti-HIV_cap256-119-005494; anti-HIV_cap256-119-004949; anti-HIV_cap256-119-004422; anti-HIV_cap256-119-003932; anti-HIV_cap256-119-003577; anti-HIV_cap256-119-002155; anti-HIV_cap256-119-002017; anti-HIV_cap256-119-001312; anti-HIV_cap256-119-001017; anti-HIV_cap256-119-000594; anti-HIV_cap256-059-241099; anti-HIV_cap256-059-207529; anti-HIV_cap256-059-205541; anti-HIV_cap256-059-188439; anti-HIV_cap256-059-187234; anti-HIV_cap256-059-187047; anti-HIV_cap256-059-186068; anti-HIV_cap256-059-182835; anti-HIV_cap256-059-176659; anti-HIV_cap256-059-172956; anti-HIV_cap256-059-171272; anti-HIV_cap256-059-168734; anti-HIV_cap256-059-155838; anti-HIV_cap256-059-149799; anti-HIV_cap256-059-148168; anti-HIV_cap256-059-144685; anti-HIV_cap256-059-140017; anti-HIV_cap256-059-137547; anti-HIV_cap256-059-131908; anti-HIV_cap256-059-116006; anti-HIV_cap256-059-115783; anti-HIV_cap256-059-114609; anti-HIV_cap256-059-113952; anti-HIV_cap256-059-113878; anti-HIV_cap256-059-113622; anti-HIV_cap256-059-109427; anti-HIV_cap256-059-109081; anti-HIV_cap256-059-107590; anti-HIV_cap256-059-107504; anti-HIV_cap256-059-099614; anti-HIV_cap256-059-098972; anti-HIV_cap256-059-097236; anti-HIV_cap256-059-091487; anti-HIV_cap256-059-089812; anti-HIV_cap256-059-088468; anti-HIV_cap256-059-088341; anti-HIV_cap256-059-086533; anti-HIV_cap256-059-086043; anti-HIV_cap256-059-084191; anti-HIV_cap256-059-082135; anti-HIV_cap256-059-079417; anti-HIV_cap256-059-076027; anti-HIV_cap256-059-075082; anti-HIV_cap256-059-072575; anti-HIV_cap256-059-071926; anti-HIV_cap256-059-069638; anti-HIV_cap256-059-069165; anti-HIV_cap256-059-068956; anti-HIV_cap256-059-068876; anti-HIV_cap256-059-067733; anti-HIV_cap256-059-067450; anti-HIV_cap256-059-065694; anti-HIV_cap256-059-065109; anti-HIV_cap256-059-065060; anti-HIV_cap256-059-064001; anti-HIV_cap256-059-063270; anti-HIV_cap256-059-061357; anti-HIV_cap256-059-059834; anti-HIV_cap256-059-059313; anti-HIV_cap256-059-057130; anti-HIV_cap256-059-050520; anti-HIV_cap256-059-049839; anti-HIV_cap256-059-048503; anti-HIV_cap256-059-045516; anti-HIV_cap256-059-044188; anti-HIV_cap256-059-044105; anti-HIV_cap256-059-042100; anti-HIV_cap256-059-040742; anti-HIV_cap256-059-040554; anti-HIV_cap256-059-039660; anti-HIV_cap256-059-039298; anti-HIV_cap256-059-037873; anti-HIV_cap256-059-037633; anti-HIV_cap256-059-036817; anti-HIV_cap256-059-

032787; anti-HIV_cap256-059-032427; anti-HIV_cap256-059-029390; anti-HIV_cap256-059-027877; anti-HIV_cap256-059-026640; anti-HIV_cap256-059-026017; anti-HIV_cap256-059-024100; anti-HIV_cap256-059-023966; anti-HIV_cap256-059-020534; anti-HIV_cap256-059-019513; anti-HIV_cap256-059-012963; anti-HIV_cap256-059-010396; anti-HIV_cap256-059-008136; anti-HIV_cap256-059-006147; anti-HIV_cap256-059-005081; anti-HIV_cap256-059-005006; anti-HIV_cap256-059-004451; anti-HIV_cap256-059-003571; anti-HIV_cap256-059-003449; anti-HIV_cap256-059-002712; anti-HIV_cap256-059-001573; anti-HIV_cap256-059-001379; anti-HIV_cap256-059-001029; anti-HIV_cap256-048-165087; anti-HIV_cap256-048-158861; anti-HIV_cap256-048-158280; anti-HIV_cap256-048-157928; anti-HIV_cap256-048-157056; anti-HIV_cap256-048-156422; anti-HIV_cap256-048-152863; anti-HIV_cap256-048-152770; anti-HIV_cap256-048-150027; anti-HIV_cap256-048-148246; anti-HIV_cap256-048-147428; anti-HIV_cap256-048-146603; anti-HIV_cap256-048-145735; anti-HIV_cap256-048-145116; anti-HIV_cap256-048-144077; anti-HIV_cap256-048-142876; anti-HIV_cap256-048-140582; anti-HIV_cap256-048-139355; anti-HIV_cap256-048-139151; anti-HIV_cap256-048-137672; anti-HIV_cap256-048-137506; anti-HIV_cap256-048-137270; anti-HIV_cap256-048-135447; anti-HIV_cap256-048-131966; anti-HIV_cap256-048-131008; anti-HIV_cap256-048-129369; anti-HIV_cap256-048-128476; anti-HIV_cap256-048-128270; anti-HIV_cap256-048-126220; anti-HIV_cap256-048-125713; anti-HIV_cap256-048-123934; anti-HIV_cap256-048-122673; anti-HIV_cap256-048-122208; anti-HIV_cap256-048-121552; anti-HIV_cap256-048-120643; anti-HIV_cap256-048-118458; anti-HIV_cap256-048-118112; anti-HIV_cap256-048-116469; anti-HIV_cap256-048-113917; anti-HIV_cap256-048-112368; anti-HIV_cap256-048-112047; anti-HIV_cap256-048-112029; anti-HIV_cap256-048-110957; anti-HIV_cap256-048-110526; anti-HIV_cap256-048-109336; anti-HIV_cap256-048-108152; anti-HIV_cap256-048-107799; anti-HIV_cap256-048-107384; anti-HIV_cap256-048-106530; anti-HIV_cap256-048-106464; anti-HIV_cap256-048-106411; anti-HIV_cap256-048-106306; anti-HIV_cap256-048-104496; anti-HIV_cap256-048-103074; anti-HIV_cap256-048-100832; anti-HIV_cap256-048-100188; anti-HIV_cap256-048-099645; anti-HIV_cap256-048-098137; anti-HIV_cap256-048-097878; anti-HIV_cap256-048-097510; anti-HIV_cap256-048-097313; anti-HIV_cap256-048-096626; anti-HIV_cap256-048-096483; anti-HIV_cap256-048-095691; anti-HIV_cap256-048-095525; anti-HIV_cap256-048-094783; anti-HIV_cap256-048-094356; anti-HIV_cap256-048-090756; anti-HIV_cap256-048-089065; anti-HIV_cap256-048-084986; anti-HIV_cap256-048-083355; anti-HIV_cap256-048-082462; anti-HIV_cap256-048-082246; anti-HIV_cap256-048-080752; anti-HIV_cap256-048-078409; anti-HIV_cap256-048-078273; anti-HIV_cap256-048-078062; anti-HIV_cap256-048-077798; anti-HIV_cap256-048-073853; anti-HIV_cap256-048-071661; anti-HIV_cap256-048-071360; anti-HIV_cap256-048-070955; anti-HIV_cap256-048-070061; anti-HIV_cap256-048-069669; anti-HIV_cap256-048-069205; anti-HIV_cap256-048-068882; anti-HIV_cap256-048-067764; anti-HIV_cap256-048-066845; anti-HIV_cap256-048-065226; anti-HIV_cap256-048-063717; anti-HIV_cap256-048-063150; anti-HIV_cap256-048-062431; anti-HIV_cap256-048-060745; anti-HIV_cap256-048-060420; anti-HIV_cap256-048-060014; anti-HIV_cap256-048-059747; anti-HIV_cap256-048-058393; anti-HIV_cap256-048-058159; anti-HIV_cap256-048-057127; anti-HIV_cap256-048-056251; anti-HIV_cap256-048-055421; anti-HIV_cap256-048-054989; anti-HIV_cap256-048-054759; anti-HIV_cap256-048-052573; anti-HIV_cap256-048-051477; anti-HIV_cap256-048-051299; anti-HIV_cap256-048-050815; anti-HIV_cap256-048-049884; anti-HIV_cap256-048-049170; anti-HIV_cap256-048-048531; anti-HIV_cap256-048-048259; anti-HIV_cap256-048-047313; anti-HIV_cap256-048-046596; anti-HIV_cap256-048-044781; anti-HIV_cap256-048-042599; anti-HIV_cap256-048-041276; anti-HIV_cap256-048-040200; anti-HIV_cap256-048-039061; anti-HIV_cap256-048-038515; anti-HIV_cap256-048-038255; anti-HIV_cap256-048-038177; anti-HIV_cap256-048-035513; anti-HIV_cap256-048-034112; anti-HIV_cap256-048-033983; anti-HIV_cap256-048-032688; anti-HIV_cap256-048-031092; anti-HIV_cap256-048-030464; anti-HIV_cap256-048-030289; anti-HIV_cap256-048-030261; anti-HIV_cap256-048-029362; anti-HIV_cap256-048-027638; anti-HIV_cap256-048-027613; anti-HIV_cap256-048-026627; anti-HIV_cap256-048-026239; anti-HIV_cap256-048-025518; anti-HIV_cap256-048-024854; anti-HIV_cap256-048-024537; anti-HIV_cap256-048-021781; anti-HIV_cap256-048-021758; anti-HIV_cap256-048-020988; anti-HIV_cap256-048-020663; anti-HIV_cap256-048-020590; anti-HIV_cap256-048-019765; anti-HIV_cap256-048-019254; anti-HIV_cap256-048-018073; anti-HIV_cap256-048-016775; anti-HIV_cap256-048-016069; anti-HIV_cap256-048-015867; anti-HIV_cap256-048-015673; anti-HIV_cap256-048-015156; anti-HIV_cap256-048-014521; anti-HIV_cap256-048-014475; anti-HIV_cap256-048-013798; anti-HIV_cap256-048-013271; anti-HIV_cap256-048-013180; anti-HIV_cap256-048-012148; anti-HIV_cap256-048-011870; anti-HIV_cap256-048-011530; anti-HIV_cap256-048-010968; anti-HIV_cap256-048-010224; anti-HIV_cap256-048-009749; anti-HIV_cap256-048-009623; anti-HIV_cap256-048-008234; anti-HIV_cap256-048-008149; anti-HIV_cap256-048-007301; anti-HIV_cap256-048-007174; anti-HIV_cap256-048-007079; anti-HIV_cap256-048-007033; anti-HIV_cap256-048-006128; anti-HIV_cap256-048-005999; anti-HIV_cap256-048-005394; anti-HIV_cap256-048-004226; anti-HIV_cap256-048-004097; anti-HIV_cap256-048-003289; anti-HIV_cap256-048-002601; anti-HIV_cap256-048-002129; anti-HIV_cap256-048-001875; anti-HIV_cap256-048-001302; anti-HIV_cap256-048-001203; anti-HIV_cap256-048-000383; anti-HIV_cap256-038-261791; anti-HIV_cap256-038-241540; anti-HIV_cap256-038-235677; anti-HIV_cap256-038-234314; anti-HIV_cap256-038-234273; anti-HIV_cap256-038-223164; anti-HIV_cap256-038-220289; anti-HIV_cap256-038-220020; anti-HIV_cap256-038-216853; anti-HIV_cap256-038-213466; anti-HIV_cap256-038-213212; anti-HIV_cap256-038-213120; anti-HIV_cap256-038-212592; anti-HIV_cap256-038-211790; anti-HIV_cap256-038-209916; anti-HIV_cap256-038-207938; anti-HIV_cap256-038-202245; anti-HIV_cap256-038-197721; anti-HIV_cap256-038-196679; anti-HIV_cap256-038-196118; anti-HIV_cap256-038-195382; anti-HIV_cap256-038-180001; anti-HIV_cap256-038-178021; anti-HIV_cap256-038-177104; anti-HIV_cap256-038-171261; anti-HIV_cap256-038-169090; anti-HIV_cap256-038-168705; anti-HIV_cap256-038-167685; anti-HIV_cap256-038-158775; anti-HIV_cap256-038-157318; anti-HIV_cap256-038-153058; anti-HIV_cap256-038-150027; anti- HIV_cap256-038-146372; anti-HIV_cap256-038-141868; anti-HIV_cap256-038-141616; anti-HIV_cap256-038-127989; anti-HIV_cap256-038-118109; anti-HIV_cap256-038-112226; anti-HIV_cap256-038-105918; anti-HIV_cap256-038-104487; anti-HIV_cap256-038-102308; anti-HIV_cap256-038-091115; anti-HIV_cap256-038-090262; anti-HIV_cap256-038-083260; anti-HIV_cap256-038-080981; anti-HIV_cap256-038-080873; anti-HIV_cap256-038-074413; anti-HIV_cap256-038-073153; anti-HIV_cap256-038-064227; anti-HIV_cap256-038-061640; anti-HIV_cap256-038-059482; anti-HIV_cap256-038-054000; anti-HIV_cap256-038-050554; anti-HIV_cap256-038-044256; anti-HIV_cap256-038-040944; anti-HIV_cap256-038-040090; anti-HIV_cap256-038-032874; anti-HIV_cap256-038-025899; anti-HIV_cap256-038-024581; anti-HIV_cap256-038-013345; anti-HIV_cap256-038-011559; anti-HIV_cap256-038-009634; anti-HIV_cap256-038-006730; anti-HIV_cap256-038-004887; anti-HIV_cap256-038-004840; anti-HIV_cap256-038-002181; anti-HIV_cap256-038-001902; anti-HIV_cap256-038-000976; anti-HIV_cap256-038-000384; anti-HIV_cap206-314431; anti-HIV_206-247594; anti-HIV_206-116890; anti-HIV_206-072383; anti-HIV_206-037527; anti-HIV_206-009095; anti-HIV_176-503620; anti-HIV_176-478726; anti-HIV_176-245056; anti-HIV_176-164413; anti-HIV_176-094308; anti-HIV_176-065321; anti-HIV_119-099719; anti-HIV_119-099536; anti-HIV_119-098907; anti-HIV_119-098555; anti-HIV_119-097828; anti-HIV_119-096480; anti-HIV_119-095664; anti-HIV_119-095212; anti-HIV_119-094773; anti-HIV_119-094508; anti-HIV_119-093795; anti-HIV_119-093732; anti-HIV_119-092903; anti-HIV_119-092284; anti-HIV_119-091586; anti-HIV_119-091023; anti-HIV_119-090334; anti-HIV_119-088694; anti-HIV_119-088499; anti-HIV_119-088298; anti-HIV_119-087488; anti-HIV_119-087423; anti-HIV_119-087371; anti-HIV_119-087279; anti-HIV_119-087146; anti-HIV_119-087048; anti-HIV_119-085802; anti-HIV_119-085784; anti-HIV_119-085370; anti-HIV_119-085276; anti-HIV_119-084885; anti-HIV_119-084874; anti-HIV_119-084691; anti-HIV_119-083793; anti-HIV_119-083163; anti-HIV_119-082331; anti-HIV_119-082070; anti-HIV_119-081512; anti-HIV_119-080816; anti-HIV_119-079302; anti-HIV_119-079292; anti-HIV_119-079289; anti-HIV_119-078935; anti-HIV_119-078702; anti-HIV_119-078593; anti-HIV_119-077708; anti-HIV_119-076904; anti-HIV_119-075862; anti-HIV_119-075465; anti-HIV_119-074822; anti-HIV_119-074629; anti-HIV_119-074500; anti-HIV_119-073911; anti-HIV_119-072765; anti-HIV_119-072313; anti-HIV_119-072280; anti-HIV_119-071693; anti-HIV_119-071353; anti-HIV_119-069711; anti-HIV_119-069061; anti-HIV_119-068202; anti-HIV_119-068063; anti-HIV_119-067980; anti-HIV_119-067866; anti-HIV_119-067756; anti-HIV_119-066859; anti-HIV_119-065821; anti-HIV_119-065191; anti-HIV_119-064667; anti-HIV_119-063791; anti-HIV_119-062989; anti-HIV_119-062286; anti-HIV_119-061416; anti-HIV_119-061344; anti-HIV_119-060240; anti-HIV_119-060184; anti-HIV_119-058035; anti-HIV_119-057858; anti-HIV_119-057473; anti-HIV_119-057090; anti-HIV_119-055754; anti-HIV_119-054899; anti-HIV_119-054501; anti-HIV_119-051867; anti-HIV_119-051814; anti-HIV_119-051567; anti-HIV_119-051483; anti-HIV_119-050913; anti-HIV_119-050187; anti-HIV_119-049069; anti-HIV_119-048517; anti-HIV_119-048470; anti-HIV_119-048303; anti-HIV_119-048021; anti-HIV_119-047928; anti-HIV_119-047384; anti-HIV_119-047145; anti-HIV_119-046752; anti-HIV_119-046660; anti-HIV_119-046202; anti-HIV_119-045790; anti-HIV_119-044670; anti-HIV_119-044140; anti-HIV_119-042776; anti-HIV_119-042581; anti-HIV_119-040905; anti-HIV_119-040322; anti-HIV_119-039892; anti-HIV_119-039764; anti-HIV_119-039188; anti-HIV_119-039058; anti-HIV_119-038837; anti-HIV_119-038396; anti-HIV_119-036918; anti-HIV_119-036592; anti-HIV_119-036310; anti-HIV_119-035618; anti-HIV_119-035569; anti-HIV_119-035466; anti-HIV_119-035157; anti-HIV_119-035121; anti-HIV_119-035046; anti-HIV_119-034754; anti-HIV_119-034318; anti-HIV_119-033780; anti-HIV_119-033632; anti-HIV_119-033183; anti-HIV_119-030696; anti-HIV_119-030059; anti-HIV_119-029589; anti-HIV_119-029448; anti-HIV_119-029220; anti-HIV_119-028317; anti-HIV_119-028165; anti-HIV_119-027147; anti-HIV_119-026743; anti-HIV_119-026508; anti-HIV_119-025683; anti-HIV_119-025614; anti-HIV_119-025548; anti-HIV_119-025526; anti-HIV_119-023552; anti-HIV_119-023092; anti-HIV_119-022793; anti-HIV_119-022395; anti-HIV_119-022334; anti-HIV_119-021866; anti-HIV_119-021278; anti-HIV_119-021183; anti-HIV_119-019376; anti-HIV_119-019238; anti-HIV_119-018500; anti-HIV_119-018318; anti-HIV_119-018218; anti-HIV_119-017876; anti-HIV_119-017740; anti-HIV_119-017128; anti-HIV_119-017044; anti-HIV_119-016644; anti-HIV_119-015878; anti-HIV_119-015538; anti-HIV_119-015455; anti-HIV_119-014425; anti-HIV_119-013582; anti-HIV_119-013364; anti-HIV_119-012886; anti-HIV_119-012249; anti-HIV_119-012161; anti-HIV_119-012110; anti-HIV_119-012100; anti-HIV_119-011651; anti-HIV_119-011479; anti-HIV_119-011232; anti-HIV_119-011175; anti-HIV_119-008396; anti-HIV_119-007148; anti-HIV_119-007029; anti-HIV_119-004707; anti-HIV_119-003910; anti-HIV_119-002450; anti-HIV_119-001552; anti-HIV_059-188169; anti-HIV_059-183739; anti-HIV_059-182376; anti-HIV_059-182199; anti-HIV_059-169202; anti-HIV_059-155645; anti-HIV_059-151619; anti-HIV_059-146503; anti-HIV_059-136098; anti-HIV_059-105516; anti-HIV_059-095709; anti-HIV_059-069468; anti-HIV_059-060026; anti-HIV_059-053668; anti-HIV_059-052864; anti-HIV_059-050968; anti-HIV_059-046422; anti-HIV_059-045120; anti-HIV_059-039932; anti-HIV_059-038595; anti-HIV_059-035082; anti-HIV_059-029204; anti-HIV_059-025235; anti-HIV_059-015192; anti-HIV_059-007060; anti-HIV_059-006953; anti-HIV_059-005953; anti-HIV_059-003725; anti-HIV_059-002618; anti-HIV_059-001522; anti-HIV_059-000731; anti-HIV_059-000634; anti-HIV_048-250757; anti-HIV_048-250716; anti-HIV_048-250463; anti-HIV_048-248153; anti-HIV_048-247532; anti-HIV_048-245846; anti-HIV_048-244016; anti-HIV_048-243682; anti-HIV_048-243588; anti-HIV_048-241775; anti-HIV_048-237996; anti-HIV_048-237730; anti-HIV_048-237253; anti-HIV_048-234100; anti-HIV_048-230882; anti-HIV_048-229473; anti-HIV_048-228238; anti-HIV_048-228027; anti-HIV_048-227795; anti-HIV_048-227770; anti-HIV_048-225298; anti-HIV_048-225090; anti-HIV_048-224187; anti-HIV_048-223055; anti-HIV_048-222711; anti-HIV_048-221209; anti-HIV_048-220629; anti-HIV_048-219430; anti-HIV_048-216250; anti-HIV_048-216133; anti-HIV_048-214886; anti-HIV_048-214709; anti-HIV_048-214001; anti-HIV_048-213230; anti-HIV_048-212574; anti-HIV_048-212207; anti-HIV_048-209146; anti-HIV_048-208206; anti-HIV_048-

208194; anti-HIV_048-207744; anti-HIV_048-206501; anti-HIV_048-204221; anti-HIV_048-204015; anti-HIV_048-201240; anti-HIV_048-200455; anti-HIV_048-200319; anti-HIV_048-197896; anti-HIV_048-193813; anti-HIV_048-192098; anti-HIV_048-191786; anti-HIV_048-188746; anti-HIV_048-185937; anti-HIV_048-184849; anti-HIV_048-183089; anti-HIV_048-181509; anti-HIV_048-180990; anti-HIV_048-177532; anti-HIV_048-177426; anti-HIV_048-177389; anti-HIV_048-174266; anti-HIV_048-172847; anti-HIV_048-172845; anti-HIV_048-172363; anti-HIV_048-171609; anti-HIV_048-170705; anti-HIV_048-168381; anti-HIV_048-166619; anti-HIV_048-162036; anti-HIV_048-160042; anti-HIV_048-159676; anti-HIV_048-159500; anti-HIV_048-159421; anti-HIV_048-159333; anti-HIV_048-158932; anti-HIV_048-155811; anti-HIV_048-155464; anti-HIV_048-155392; anti-HIV_048-155389; anti-HIV_048-154449; anti-HIV_048-153379; anti-HIV_048-153171; anti-HIV_048-152324; anti-HIV_048-146102; anti-HIV_048-145984; anti-HIV_048-145371; anti-HIV_048-144907; anti-HIV_048-142298; anti-HIV_048-142277; anti-HIV_048-141934; anti-HIV_048-141207; anti-HIV_048-140796; anti-HIV_048-139893; anti-HIV_048-138820; anti-HIV_048-135858; anti-HIV_048-134968; anti-HIV_048-134312; anti-HIV_048-132253; anti-HIV_048-130710; anti-HIV_048-128564; anti-HIV_048-126702; anti-HIV_048-124521; anti-HIV_048-122740; anti-HIV_048-119536; anti-HIV_048-116929; anti-HIV_048-116577; anti-HIV_048-116046; anti-HIV_048-115875; anti-HIV_048-115599; anti-HIV_048-113988; anti-HIV_048-112989; anti-HIV_048-112435; anti-HIV_048-111339; anti-HIV_048-111055; anti-HIV_048-111027; anti-HIV_048-109721; anti-HIV_048-109666; anti-HIV_048-109196; anti-HIV_048-109051; anti-HIV_048-108570; anti-HIV_048-108033; anti-HIV_048-107279; anti-HIV_048-106271; anti-HIV_048-106054; anti-HIV_048-104848; anti-HIV_048-104638; anti-HIV_048-104567; anti-HIV_048-102804; anti-HIV_048-101676; anti-HIV_048-097603; anti-HIV_048-097107; anti-HIV_048-096871; anti-HIV_048-096668; anti-HIV_048-095236; anti-HIV_048-094155; anti-HIV_048-093219; anti-HIV_048-092976; anti-HIV_048-090866; anti-HIV_048-090650; anti-HIV_048-089009; anti-HIV_048-088654; anti-HIV_048-086513; anti-HIV_048-086024; anti-HIV_048-085857; anti-HIV_048-084277; anti-HIV_048-084245; anti-HIV_048-082487; anti-HIV_048-081787; anti-HIV_048-081062; anti-HIV_048-079639; anti-HIV_048-079126; anti-HIV_048-073118; anti-HIV_048-070264; anti-HIV_048-069426; anti-HIV_048-068564; anti-HIV_048-068345; anti-HIV_048-067337; anti-HIV_048-067180; anti-HIV_048-063017; anti-HIV_048-061885; anti-HIV_048-061671; anti-HIV_048-060700; anti-HIV_048-060592; anti-HIV_048-060300; anti-HIV_048-059141; anti-HIV_048-057777; anti-HIV_048-056928; anti-HIV_048-056131; anti-HIV_048-055864; anti-HIV_048-055094; anti-HIV_048-054343; anti-HIV_048-054193; anti-HIV_048-052521; anti-HIV_048-049037; anti-HIV_048-048720; anti-HIV_048-048542; anti-HIV_048-047777; anti-HIV_048-046841; anti-HIV_048-046202; anti-HIV_048-046059; anti-HIV_048-043568; anti-HIV_048-042713; anti-HIV_048-042440; anti-HIV_048-040511; anti-HIV_048-039195; anti-HIV_048-036935; anti-HIV_048-034478; anti-HIV_048-031641; anti-HIV_048-029760; anti-HIV_048-027970; anti-HIV_048-027337; anti-HIV_048-027217; anti-HIV_048-026760; anti-HIV_048-024800; anti-HIV_048-024313; anti-HIV_048-021748; anti-HIV_048-020991; anti-HIV_048-020340; anti-HIV_048-019993; anti-HIV_048-019947; anti-HIV_048-017871; anti-HIV_048-015931; anti-HIV_048-015920; anti-HIV_048-013898; anti-HIV_048-013429; anti-HIV_048-012358; anti-HIV_048-011158; anti-HIV_048-010720; anti-HIV_048-009445; anti-HIV_048-006126; anti-HIV_048-005652; anti-HIV_048-005532; anti-HIV_048-005189; anti-HIV_048-005088; anti-HIV_048-004023; anti-HIV_048-001580; anti-HIV_038-221120; anti-HIV_038-197677; anti-HIV_038-196765; anti-HIV_038-186200; anti-HIV_038-126170; anti-HIV_038-108545; anti-HIV_038-107263; anti-HIV_038-104530; anti-HIV_038-099169; anti-HIV_038-075067; anti-HIV_038-072368; anti-HIV_038-068503; anti-HIV_038-068016; anti-HIV_038-063958; anti-HIV_038-033733; anti-HIV_038-030557; anti-HIV_038-024298; anti-HIV_038-011154; anti-HIV_5CIN; anti-HIV_5CIL; anti-HIV_5CIP; anti-HIV_4JKP; anti-HIV_3TNN; anti-HIV_3BQU; anti-HIV_IgG; anti-HIV_4P9M; anti-HIV_4P9H; anti-HIV_Ig; anti-HIV; anti-influenza; anti-influenza_Apo; anti-influenza-A; anti-OX40; or a fragment or variant thereof.

More preferably, the at least one coding sequence of the RNA according to the present invention encodes an antibody or a fragment or variant thereof comprising an amino acid sequence selected from the group consisting of amino acid sequences according to SEQ ID NOs: 1-7642, 61212-61214, 61236-61238, 61245-61247, 61269-61271, 61279-61281, 61303-61305, 61312, 61320, 61324, 61332, 61338, 61346, 61349, 61357, 61362, 61370, 61373, 61381, 61384, 61385, 61400, 61401, 61418, 61426, 61429, 61437, 61440, 61441, 61456, 61457, 61469, 61470, 61475, 61476, 61481, 61482, 61487, 61488, 61493, 61494, 61499, 61500, 61515, 61516, 61521, 61522, 61537, 61538, 61543, 61544, 61559, 61560, 61565, 61573, 61576, 61584, 61587, 61588, 61603, 61606, 61609, 61612, 61618, 61619, 61634, 61635, 61639, 61640, 61644, 61645, 61660, 61661, 61667, 61675, 61678, 61686, 61689, 61697, 61700, 61708, 61711, 61719, 61722, and 61730; or a fragment or variant of any one of said amino acid sequences.

According to certain preferred embodiments of the present invention, the RNA is mono-, bi-, or multicistronic as defined herein. The coding sequences in a bi- or multicistronic RNA preferably encode distinct antibodies as defined herein or distinct fragments or variants thereof. In particular, an RNA according to the present invention preferably encodes a full-length (complete) antibody in a multicistronic manner, e.g. by encoding the heavy chain (or a fragment thereof, e.g. the heavy chain variable region) and the light chain (or a fragment thereof, e.g. the light chain variable region) of the same antibody in separate cistrons on one single RNA (molecule). Accordingly, the RNA according to the present invention is preferably bicistronic or multicistronic. However, it is also preferred that the RNA according to the present invention is monocistronic. For example, a full-length (complete) antibody may be encoded in one single cistron, e.g. if the heavy chain (or a fragment thereof, e.g. the heavy chain variable region) and the light chain (or a fragment thereof, e.g. the light chain variable region) are connected via a peptidic linker (linker sequence) as described below. A monocistronic RNA according to the present invention may also encode only a fragment of an antibody, in particular the heavy chain (or a fragment thereof, e.g. the heavy chain variable region) only, or the light chain (or a fragment thereof, e.g. the light chain variable region) only—with the corresponding the heavy chain (or a fragment thereof, e.g. the heavy chain variable region) or the light chain (or a fragment thereof, e.g. the light chain variable region) being encoded (preferably in a similar monocistronic manner) by another RNA (molecule). This embodiment is in particular preferred in the context of a combination of RNA's according to the present invention as described herein.

Preferably, the coding sequences encoding two or more antibodies or fragments thereof may be separated in the bi- or multicistronic RNA by at least one IRES (internal ribosomal entry site) sequence, as defined below. Thus, the term "encoding two or more antibodies or fragments thereof" may mean, without being limited thereto, that the bi- or even multicistronic RNA, may encode e.g. at least two, three, four, five, six or more (preferably different) antibodies or fragments thereof of the antibodies or their fragments within the definitions provided herein. More preferably, without being limited thereto, the bi- or even multicistronic mRNA, may encode, for example, at least two, three, four, five, six or more (preferably different) antibodies as defined herein or their fragments or variants as defined herein. In this context, a so-called IRES (internal ribosomal entry site) sequence as defined above can function as a sole ribosome binding site, but it can also serve to provide a bi- or even multicistronic mRNA as defined above, which encodes several antibodies, which are to be translated by the ribosomes independently of one another. Examples of IRES sequences, which can be used according to the invention, are those from picornaviruses (e.g. FMDV), pestiviruses (CFFV), polioviruses (PV), encephalomyocarditis viruses (ECMV), foot and mouth disease viruses (FMDV), hepatitis C viruses (HCV), classical swine fever viruses (CSFV), mouse leukoma virus (MLV), simian immunodeficiency viruses (SIV) or cricket paralysis viruses (CrPV).

According to a further embodiment the at least one coding sequence of the RNA according to the invention may encode at least two, three, four, five, six, seven, eight and more antibodies (or fragments or variants thereof) as defined herein linked with or without an amino acid linker sequence, wherein said linker sequence can comprise rigid linkers, flexible linkers, cleavable linkers (e.g., self-cleaving peptides) or a combination thereof. Therein, the antibodies may be identical or different or a combination thereof. Particular antibody combinations can be encoded by said mRNA encoding at least two antibodies as explained herein (also referred to herein as 'multi-antibody-constructs/mRNA'). In this way the RNA according to the present invention may, for example, encode the heavy chain and the corresponding light chain of an antibody (such that one RNA molecule is sufficient to encode the complete antibody including heavy and light chain) or the heavy chain variable region and the light chain variable region of an antibody (fragment).

Preferably, the at least one coding sequence of the RNA according to the invention comprises at least two, three, four, five, six, seven, eight and more nucleic acid sequences having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NOs: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant of any one of said nucleic acid sequences.

Preferably, the RNA comprising at least one coding sequence as defined herein typically comprises a length of about 50 to about 20000, or 100 to about 20000 nucleotides, preferably of about 250 to about 20000 nucleotides, more preferably of about 500 to about 10000, even more preferably of about 500 to about 5000.

The RNA according to the invention may further be single stranded or double stranded. When provided as a double stranded RNA, the RNA according to the invention preferably comprises a sense and a corresponding antisense strand.

In a preferred embodiment, the RNA comprising at least one coding sequence as defined herein is an mRNA, a viral RNA or a replicon RNA.

According to a further embodiment, the RNA, preferably an mRNA, according to the invention is a modified RNA, preferably a modified RNA as described herein. In this context, a modification as defined herein preferably leads to a stabilization of the RNA according to the invention. More preferably, the invention thus provides a stabilized RNA comprising at least one coding sequence as defined herein.

According to one embodiment, the RNA of the present invention may thus be provided as a "stabilized mRNA", that is to say as an RNA that is essentially resistant to in vivo degradation (e.g. by an exo- or endo-nuclease). Such stabilization can be effected, for example, by a modified phosphate backbone of the RNA of the present invention. A backbone modification in connection with the present invention is a modification in which phosphates of the backbone of the nucleotides contained in the RNA are chemically modified. Nucleotides that may be preferably used in this connection contain e.g. a phosphorothioate-modified phosphate backbone, preferably at least one of the phosphate oxygens contained in the phosphate backbone being replaced by a sulfur atom. Stabilized RNAs may further include, for example: non-ionic phosphate analogues, such as, for example, alkyl and aryl phosphonates, in which the charged phosphonate oxygen is replaced by an alkyl or aryl group, or phosphodiesters and alkylphosphotriesters, in which the charged oxygen residue is present in alkylated form. Such backbone modifications typically include, without implying any limitation, modifications from the group consisting of methylphosphonates, phosphoramidates and phosphorothioates (e.g. cytidine-5'-O-(1-thiophosphate)).

In the following, specific modifications are described, which are preferably capable of "stabilizing" the RNA as defined herein.

Chemical Modifications:

The term "RNA modification" as used herein may refer to chemical modifications comprising backbone modifications as well as sugar modifications or base modifications.

In this context, a modified RNA as defined herein may contain nucleotide analogues/modifications, e.g. backbone modifications, sugar modifications or base modifications. A backbone modification in connection with the present invention is a modification, in which phosphates of the backbone of the nucleotides contained in an RNA as defined herein are chemically modified. A sugar modification in connection with the present invention is a chemical modification of the sugar of the nucleotides of the RNA as defined herein. Furthermore, a base modification in connection with the present invention is a chemical modification of the base moiety of the nucleotides of the RNA. In this context, nucleotide analogues or modifications are preferably selected from nucleotide analogues, which are applicable for transcription and/or translation.

Sugar Modifications:

The modified nucleosides and nucleotides, which may be incorporated into a modified RNA as described herein, can be modified in the sugar moiety. For example, the 2' hydroxyl group (OH) can be modified or replaced with a number of different "oxy" or "deoxy" substituents. Examples of "oxy"-2' hydroxyl group modifications include, but are not limited to, alkoxy or aryloxy (—OR, e.g., R=H, alkyl, cycloalkyl, aryl, aralkyl, heteroaryl or sugar); polyethyleneglycols (PEG), —O(CH$_2$CH$_2$O)nCH$_2$CH$_2$OR; "locked" nucleic acids (LNA) in which the 2' hydroxyl is connected, e.g., by a methylene bridge, to the 4' carbon of the same ribose sugar; and amino groups (—O-amino, wherein the amino group, e.g., NRR, can be alkylamino, dialkylamino, heterocyclyl, arylamino, diarylamino, heteroarylamino, or diheteroaryl amino, ethylene diamine, polyamino) or aminoalkoxy.

"Deoxy" modifications include hydrogen, amino (e.g. NH$_2$; alkylamino, dialkylamino, heterocyclyl, arylamino, diaryl amino, heteroaryl amino, diheteroaryl amino, or amino acid); or the amino group can be attached to the sugar through a linker, wherein the linker comprises one or more of the atoms C, N, and O.

The sugar group can also contain one or more carbons that possess the opposite stereochemical configuration than that of the corresponding carbon in ribose. Thus, a modified RNA can include nucleotides containing, for instance, arabinose as the sugar.

Backbone Modifications:

The phosphate backbone may further be modified in the modified nucleosides and nucleotides, which may be incorporated into a modified RNA as described herein. The phosphate groups of the backbone can be modified by replacing one or more of the oxygen atoms with a different substituent. Further, the modified nucleosides and nucleotides can include the full replacement of an unmodified phosphate moiety with a modified phosphate as described herein. Examples of modified phosphate groups include, but are not limited to, phosphorothioate, phosphoroselenates, borano phosphates, borano phosphate esters, hydrogen phosphonates, phosphoroamidates, alkyl or aryl phosphonates and phosphotriesters. Phosphorodithioates have both non-linking oxygens replaced by sulfur. The phosphate linker can also be modified by the replacement of a linking oxygen with nitrogen (bridged phosphoroamidates), sulfur (bridged phosphorothioates) and carbon (bridged methylene-phosphonates).

Base Modifications:

The modified nucleosides and nucleotides, which may be incorporated into a modified RNA as described herein can further be modified in the nucleobase moiety. Examples of nucleobases found in RNA include, but are not limited to, adenine, guanine, cytosine and uracil. For example, the nucleosides and nucleotides described herein can be chemically modified on the major groove face. In some embodiments, the major groove chemical modifications can include an amino group, a thiol group, an alkyl group, or a halo group.

In particularly preferred embodiments of the present invention, the nucleotide analogues/modifications are selected from base modifications, which are preferably selected from 2-amino-6-chloropurineriboside-5'-triphosphate, 2-Aminopurine-riboside-5'-triphosphate; 2-aminoadenosine-5'-triphosphate, 2'-Amino-2'-deoxycytidine-triphosphate, 2-thiocytidine-5'-triphosphate, 2-thiouridine-5'-triphosphate, 2'-Fluorothymidine-5'-triphosphate, 2'-O-Methyl-inosine-5'-triphosphate 4-thiouridine-5'-triphosphate, 5-aminoallylcytidine-5'-triphosphate, 5-aminoallyluridine-5'-triphosphate, 5-bromocytidine-5'-triphosphate, 5-bromouridine-5'-triphosphate, 5-Bromo-2'-deoxycytidine-5'-triphosphate, 5-Bromo-2'-deoxyuridine-5'-triphosphate, 5-iodocytidine-5'-triphosphate, 5-Iodo-2'-deoxycytidine-5'-triphosphate, 5-iodouridine-5'-triphosphate, 5-Iodo-2'-deoxyuridine-5'-triphosphate, 5-methylcytidine-5'-triphosphate, 5-methyluridine-5'-triphosphate, 5-Propynyl-2'-deoxycytidine-5'-triphosphate, 5-Propynyl-2'-deoxyuridine-5'-triphosphate, 6-azacytidine-5'-triphosphate, 6-azauridine-5'-triphosphate, 6-chloropurineriboside-5'-triphosphate, 7-deazaadenosine-5'-triphosphate, 7-deazaguanosine-5'-triphosphate, 8-azaadenosine-5'-triphosphate, 8-azidoadenosine-5'-triphosphate, benzimidazole-riboside-5'-triphosphate, N1-methyladenosine-5'-triphosphate, N1-methylguanosine-5'-triphosphate, N6-methyladenosine-5'-triphosphate, 06-methylguanosine-5'-triphosphate, pseudouridine-5'-triphosphate, or puromycin-5'-triphosphate, xanthosine-5'-triphosphate. Particular preference is given to nucleotides for base modifications selected from the group of base-modified nucleotides consisting of 5-methylcytidine-5'-triphosphate, 7-deazaguanosine-5'-triphosphate, 5-bromocytidine-5'-triphosphate, and pseudouridine-5'-triphosphate.

In some embodiments, modified nucleosides include pyridin-4-one ribonucleoside, 5-aza-uridine, 2-thio-5-aza-uridine, 2-thiouridine, 4-thio-pseudouridine, 2-thio-pseudouridine, 5-hydroxyuridine, 3-methyluridine, 5-carboxymethyl-uridine, 1-carboxymethyl-pseudouridine, 5-propynyl-uridine, 1-propynyl-pseudouridine, 5-taurinomethyluridine, 1-taurinomethyl-pseudouridine, 5-taurinomethyl-2-thio-uridine, 1-taurinomethyl-4-thio-uridine, 5-methyl-uridine, 1-methyl-pseudouridine, 4-thio-1-methyl-pseudouridine, 2-thio-1-methyl-pseudouridine, 1-methyl-1-deaza-pseudouridine, 2-thio-1-methyl-1-deaza-pseudouridine, dihydrouridine, dihydropseudouridine, 2-thio-dihydrouridine, 2-thio-dihydropseudouridine, 2-methoxyuridine, 2-methoxy-4-thio-uridine, 4-methoxy-pseudouridine, and 4-methoxy-2-thio-pseudouridine.

In some embodiments, modified nucleosides include 5-aza-cytidine, pseudoisocytidine, 3-methyl-cytidine, N4-acetylcytidine, 5-formylcytidine, N4-methylcytidine, 5-hydroxymethylcytidine, 1-methyl-pseudoisocytidine, pyrrolo-cytidine, pyrrolo-pseudoisocytidine, 2-thio-cytidine, 2-thio-5-methyl-cytidine, 4-thio-pseudoisocytidine, 4-thio-1-methyl-pseudoisocytidine, 4-thio-1-methyl-1-deaza-pseudoisocytidine, 1-methyl-1-deaza-pseudoisocytidine, zebularine, 5-aza-zebularine, 5-methyl-zebularine, 5-aza-2-thio-zebularine, 2-thio-zebularine, 2-methoxy-cytidine, 2-methoxy-5-methyl-cytidine, 4-methoxy-pseudoisocytidine, and 4-methoxy-1-methyl-pseudoisocytidine.

In other embodiments, modified nucleosides include 2-aminopurine, 2,6-diaminopurine, 7-deaza-adenine, 7-deaza-8-aza-adenine, 7-deaza-2-aminopurine, 7-deaza-8-aza-2-aminopurine, 7-deaza-2,6-diaminopurine, 7-deaza-8-aza-2,6-diaminopurine, 1-methyladenosine, N6-methyladenosine, N6-isopentenyladenosine, N6-(cis-hydroxyisopentenyl)adenosine, 2-methylthio-N6-(cis-hydroxyisopentenyl) adenosine, N6-glycinylcarbamoyladenosine, N6-threonylcarbamoyladenosine, 2-methylthio-N6-threonyl carbamoyladenosine, N6,N6-dimethyladenosine, 7-methyladenine, 2-methylthio-adenine, and 2-methoxy-adenine.

In other embodiments, modified nucleosides include inosine, 1-methyl-inosine, wyosine, wybutosine, 7-deaza-guanosine, 7-deaza-8-aza-guanosine, 6-thio-guanosine, 6-thio-7-deaza-guanosine, 6-thio-7-deaza-8-aza-guanosine, 7-methyl-guanosine, 6-thio-7-methyl-guanosine, 7-methyl-inosine, 6-methoxy-guanosine, 1-methylguanosine, N2-methylguanosine, N2,N2-dimethylguanosine, 8-oxo-guanosine, 7-methyl-8-oxo-guanosine, 1-methyl-6-thio-guanosine, N2-methyl-6-thio-guanosine, and N2,N2-dimethyl-6-thio-guanosine.

In some embodiments, the nucleotide can be modified on the major groove face and can include replacing hydrogen on C-5 of uracil with a methyl group or a halo group. In specific embodiments, a modified nucleoside is 5'-O-(1-thiophosphate)-adenosine, 5'-O-(1-thiophosphate)-cytidine, 5'-O-(1-thiophosphate)-guanosine, 5'-O-(1-thiophosphate)-uridine or 5'-O-(1-thiophosphate)-pseudouridine.

In further specific embodiments, a modified RNA may comprise nucleoside modifications selected from 6-aza-cytidine, 2-thio-cytidine, α-thio-cytidine, Pseudo-iso-cytidine, 5-aminoallyl-uridine, 5-iodo-uridine, N1-methyl-pseudouridine, 5,6-dihydrouridine, α-thio-uridine, 4-thio-uridine, 6-aza-uridine, 5-hydroxy-uridine, deoxy-thymidine, 5-methyl-uridine, Pyrrolo-cytidine, inosine, α-thio-guanosine, 6-methyl-guanosine, 5-methyl-cytdine, 8-oxo-guanosine, 7-deaza-guanosine, N1-methyl-adenosine, 2-amino-6-Chloro-purine, N6-methyl-2-amino-purine, Pseudo-iso-cytidine, 6-Chloro-purine, N6-methyl-adenosine, α-thio-adenosine, 8-azido-adenosine, 7-deaza-adenosine.

Lipid Modification:

According to a further embodiment, a modified RNA as defined herein can contain a lipid modification. Such a lipid-modified RNA typically comprises an RNA as defined herein. Such a lipid-modified RNA as defined herein typically further comprises at least one linker covalently linked with that RNA, and at least one lipid covalently linked with the respective linker. Alternatively, the lipid-modified RNA comprises at least one RNA as defined herein and at least one (bifunctional) lipid covalently linked (without a linker) with that RNA. According to a third alternative, the lipid-modified RNA comprises an RNA molecule as defined herein, at least one linker covalently linked with that RNA, and at least one lipid covalently linked with the respective linker, and also at least one (bifunctional) lipid covalently linked (without a linker) with that RNA. In this context, it is particularly preferred that the lipid modification is present at the terminal ends of a linear RNA sequence.

G/C Content Modification:

According to another embodiment, the RNA of the present invention, preferably an mRNA, may be modified, and thus stabilized, by modifying the guanosine/cytosine (G/C) content of the RNA, preferably of the at least one coding sequence of the RNA of the present invention.

In a particularly preferred embodiment of the present invention, the G/C content of the coding region of the RNA of the present invention is modified, particularly increased, compared to the G/C content of the coding region of the respective wild-type RNA, i.e. the unmodified RNA. The amino acid sequence encoded by the RNA is preferably not modified as compared to the amino acid sequence encoded by the respective wild-type RNA. This modification of the RNA of the present invention is based on the fact that the sequence of any RNA region to be translated is important for efficient translation of that RNA. Thus, the composition of the RNA and the sequence of various nucleotides are important. In particular, sequences having an increased G (guanosine)/C (cytosine) content are more stable than sequences having an increased A (adenosine)/U (uracil) content. According to the invention, the codons of the RNA are therefore varied compared to the respective wild-type RNA, while retaining the translated amino acid sequence, such that they include an increased amount of G/C nucleotides. In respect to the fact that several codons code for one and the same amino acid (so-called degeneration of the genetic code), the most favourable codons for the stability can be determined (so-called alternative codon usage). Depending on the amino acid to be encoded by the RNA, there are various possibilities for modification of the RNA sequence, compared to its wild-type sequence. In the case of amino acids, which are encoded by codons, which contain exclusively G or C nucleotides, no modification of the codon is necessary. Thus, the codons for Pro (CCC or CCG), Arg (CGC or CGG), Ala (GCC or GCG) and Gly (GGC or GGG) require no modification, since no A or U is present. In contrast, codons which contain A and/or U nucleotides can be modified by substitution of other codons, which code for the same amino acids but contain no A and/or U. Examples of these are: the codons for Pro can be modified from CCU or CCA to CCC or CCG; the codons for Arg can be modified from CGU or CGA or AGA or AGG to CGC or CGG; the codons for Ala can be modified from GCU or GCA to GCC or GCG; the codons for Gly can be modified from GGU or GGA to GGC or GGG. In other cases, although A or U nucleotides cannot be eliminated from the codons, it is however possible to decrease the A and U content by using codons which contain a lower content of A and/or U nucleotides. Examples of these are: the codons for Phe can be modified from UUU to UUC; the codons for Leu can be modified from UUA, UUG, CUU or CUA to CUC or CUG; the codons for Ser can be modified from UCU or UCA or AGU to UCC, UCG or AGC; the codon for Tyr can be modified from UAU to UAC; the codon for Cys can be modified from UGU to UGC; the codon for His can be modified from CAU to CAC; the codon for Gln can be modified from CAA to CAG; the codons for Ile can be modified from AUU or AUA to AUC; the codons for Thr can be modified from ACU or ACA to ACC or ACG; the codon for Asn can be modified from AAU to AAC; the codon for Lys can be modified from AAA to AAG; the codons for Val can be modified from GUU or GUA to GUC or GUG; the codon for Asp can be modified from GAU to GAC; the codon for Glu can be modified from GAA to GAG; the stop codon UAA can be modified to UAG or UGA. In the case of the codons for Met (AUG) and Trp (UGG), on the other hand, there is no possibility of sequence modification. The substitutions listed above can be used either individually or in all possible combinations to increase the G/C content of the at least one mRNA of the composition of the present invention compared to its particular wild-type mRNA (i.e. the original sequence). Thus, for example, all codons for Thr occurring in the wild-type sequence can be modified to ACC (or ACG). Preferably, however, for example, combinations of the above substitution possibilities are used:

substitution of all codons coding for Thr in the original sequence (wild-type mRNA) to ACC (or ACG) and substitution of all codons originally coding for Ser to UCC (or UCG or AGC); substitution of all codons coding for Ile in the original sequence to AUC and substitution of all codons originally coding for Lys to AAG and substitution of all codons originally coding for Tyr to UAC; substitution of all codons coding for Val in the original sequence to GUC (or GUG) and substitution of all codons originally coding for Glu to GAG and substitution of all codons originally coding for Ala to GCC (or GCG) and substitution of all codons originally coding for Arg to CGC (or CGG); substitution of all codons coding for Val in the original sequence to GUC (or GUG) and substitution of all codons originally coding for Glu to GAG and substitution of all codons originally coding for Ala to GCC (or GCG) and substitution of all codons originally coding for Gly to GGC (or GGG) and substitution of all codons originally coding for Asn to AAC; substitution of all codons coding for Val in the original sequence to GUC (or GUG) and substitution of all codons originally coding for Phe to UUC and substitution of all codons originally coding for Cys to UGC and substitution of all codons originally coding for Leu to CUG (or CUC) and substitution of all codons originally coding for Gln to CAG and substitution of all codons originally coding for Pro to CCC (or CCG); etc.

Preferably, the G/C content of the coding region of the RNA of the present invention is increased by at least 7%, more preferably by at least 15%, particularly preferably by at least 20%, compared to the G/C content of the coding region of the wild-type RNA, which codes for an antibody as defined herein or a fragment or variant thereof. According to a specific embodiment at least 5%, 10%, 20%, 30%, 40%, 50%, 60%, more preferably at least 70%, even more preferably at least 80% and most preferably at least 90%, 95% or even 100% of the substitutable codons in the region coding for an antibody as defined herein or a fragment or variant thereof or the whole sequence of the wild type RNA sequence are substituted, thereby increasing the GC/content of said sequence. In this context, it is particularly preferable to increase the G/C content of the RNA of the present invention, preferably of the at least one coding region of the RNA according to the invention, to the maximum (i.e. 100% of the substitutable codons) as compared to the wild-type sequence. According to the invention, a further preferred modification of the RNA of the present invention is based on the finding that the translation efficiency is also determined by a different frequency in the occurrence of tRNAs in cells. Thus, if so-called "rare codons" are present in the RNA of the present invention to an increased extent, the corresponding modified RNA sequence is translated to a significantly poorer degree than in the case where codons coding for relatively "frequent" tRNAs are present. According to the invention, in the modified RNA of the present invention, the region which codes for an antibody as defined herein or a fragment or variant thereof is modified compared to the corresponding region of the wild-type RNA such that at least one codon of the wild-type sequence, which codes for a tRNA which is relatively rare in the cell, is exchanged for a codon, which codes for a tRNA which is relatively frequent in the cell and carries the same amino acid as the relatively rare tRNA. By this modification, the sequences of the RNA of the present invention is modified such that codons for which frequently occurring tRNAs are available are inserted. In other words, according to the invention, by this modification all codons of the wild-type sequence, which code for a tRNA which is relatively rare in the cell, can in each case be exchanged for a codon, which codes for a tRNA which is relatively frequent in the cell and which, in each case, carries the same amino acid as the relatively rare tRNA. Which tRNAs occur relatively frequently in the cell and which, in contrast, occur relatively rarely is known to a person skilled in the art; cf. e.g. Akashi, Curr. Opin. Genet. Dev. 2001, 11(6): 660-666. The codons, which use for the particular amino acid the tRNA which occurs the most frequently, e.g. the Gly codon, which uses the tRNA, which occurs the most frequently in the (human) cell, are particularly preferred. According to the invention, it is particularly preferable to link the sequential G/C content which is increased, in particular maximized, in the modified RNA of the present invention, with the "frequent" codons without modifying the amino acid sequence of the protein encoded by the coding region of the RNA. This preferred embodiment allows provision of a particularly efficiently translated and stabilized (modified) RNA of the present invention. The determination of a modified RNA of the present invention as described above (increased G/C content; exchange of tRNAs) can be carried out using the computer program explained in WO 02/098443—the disclosure content of which is included in its full scope in the present invention. Using this computer program, the nucleotide sequence of any desired RNA can be modified with the aid of the genetic code or the degenerative nature thereof such that a maximum G/C content results, in combination with the use of codons which code for tRNAs occurring as frequently as possible in the cell, the amino acid sequence coded by the modified RNA preferably not being modified compared to the non-modified sequence. Alternatively, it is also possible to modify only the G/C content or only the codon usage compared to the original sequence. The source code in Visual Basic 6.0 (development environment used: Microsoft Visual Studio Enterprise 6.0 with Servicepack 3) is also described in WO 02/098443. In a further preferred embodiment of the present invention, the A/U content in the environment of the ribosome binding site of the RNA of the present invention is increased compared to the A/U content in the environment of the ribosome binding site of its respective wild-type mRNA. This modification (an increased A/U content around the ribosome binding site) increases the efficiency of ribosome binding to the RNA. An effective binding of the ribosomes to the ribosome binding site (Kozak sequence: SEQ ID NO: 61159 (DNA) or SEQ ID NO:61160 (RNA), respectively; the AUG forms the start codon) in turn has the effect of an efficient translation of the RNA. According to a further embodiment of the present invention, the RNA of the present invention may be modified with respect to potentially destabilizing sequence elements. Particularly, the coding region and/or the 5' and/or 3' untranslated region of this RNA may be modified compared to the respective wild-type RNA such that it contains no destabilizing sequence elements, the encoded amino acid sequence of the modified RNA preferably not being modified compared to its respective wild-type RNA. It is known that, for example in sequences of eukaryotic RNAs, destabilizing sequence elements (DSE) occur, to which signal proteins bind and regulate enzymatic degradation of RNA in vivo. For further stabilization of the modified RNA, optionally in the region which encodes an antibody as defined herein or a fragment or variant thereof, one or more such modifications compared to the corresponding region of the wild-type RNA can therefore be carried out, so that no or substantially no destabilizing sequence elements are contained there. According to the invention, DSE present in the untranslated regions (3'- and/or 5'-UTR) can also be eliminated from the RNA of the present invention by such modifications. Such destabilizing sequences are e.g. AU-rich sequences (AURES), which occur in 3'-UTR sections of numerous unstable RNAs (Caput et al., Proc. Natl. Acad. Sci. USA 1986, 83: 1670 to 1674). The RNA of the present invention is therefore preferably modified compared to the respective wild-type RNA such that the RNA of the present invention contains no such destabilizing sequences. This also applies to those sequence motifs which are recognized by possible endonucleases, e.g. the sequence GAACAAG, which is contained in the 3'-UTR segment of the gene encoding the transferrin receptor (Binder et al., EMBO J. 1994, 13: 1969 to 1980). These sequence motifs are also preferably removed in the RNA of the present invention.

GC Optimized Sequences:

In a preferred embodiment, the present invention provides an RNA comprising at least one coding sequence, wherein the coding sequence comprises a nucleic acid sequence selected from the group consisting of SEQ ID NO: 7643-15284, 61162, 61164, 61165, 61167, 61169, 61170, 61172, 61174, 61175, 61209-61211, 61215-61217, 61239-61242, 61248-61250, 61272-61275, 61282-61284, 61306-61309, 61313, 61321, 61325, 61333, 61336, 61339, 61347, 61350, 61358, 61360, 61363, 61371, 61374, 61382, 61386, 61387, 61402-61404, 61416, 61419, 61427, 61430, 61438, 61442, 61443, 61458, 61459, 61464, 61467, 61471-61473, 61477-61479, 61483-61485, 61489-61491, 61495-61497, 61501, 61502, 61517-61519, 61523, 61524, 61539-61541, 61545, 61546, 61561-61563, 61566, 61574, 61577, 61585, 61589, 61590, 61604, 61607, 61610, 61613, 61615, 61620, 61621, 61636, 61637, 61641, 61642, 61646, 61647, 61662-61664, 61668, 61676, 61679, 61687, 61690, 61698, 61701, 61709, 61712, 61720, 61723, 61731, and 61733; or a fragment or variant of any one of said nucleic acid sequences.

It is also preferred that the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 7643-15284, 61162, 61164, 61165, 61167, 61169, 61170, 61172, 61174, 61175, 61209-61211, 61215-61217, 61239-61242, 61248-61250, 61272-61275, 61282-61284, 61306-61309, 61313, 61321, 61325, 61333, 61336, 61339, 61347, 61350, 61358, 61360, 61363, 61371, 61374, 61382, 61386, 61387, 61402-61404, 61416, 61419, 61427, 61430, 61438, 61442, 61443, 61458, 61459, 61464, 61467, 61471-61473, 61477-61479, 61483-61485, 61489-61491, 61495-61497, 61501, 61502, 61517-61519, 61523, 61524, 61539-61541, 61545, 61546, 61561-61563, 61566, 61574, 61577, 61585, 61589, 61590, 61604, 61607, 61610, 61613, 61615, 61620, 61621, 61636, 61637, 61641, 61642, 61646, 61647, 61662-61664, 61668, 61676, 61679, 61687, 61690, 61698, 61701, 61709, 61712, 61720, 61723, 61731, and 61733; or a fragment or variant of any one of said nucleic acid sequences.

It is also preferred that the RNA comprises at least one coding sequence, wherein the coding sequence comprises a nucleic acid sequence selected from the group consisting of SEQ ID NO: 38211-45852, 61227-1229, 61260-61262, 61294-61296, 61317, 61329, 61343, 61354, 61367, 61378, 61394, 61395, 61423, 61434, 61450, 61451, 61509, 61510, 61531, 61532, 61553, 61554, 61570, 61581, 61597, 61598, 61628, 61629, 61654, 61655, 61672, 61683, 61694, 61705, 61716, and 61727; or a fragment or variant of any one of said nucleic acid sequences.

Preferably, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 38211-45852, 61227-1229, 61260-61262, 61294-61296, 61317, 61329, 61343, 61354, 61367, 61378, 61394, 61395, 61423, 61434, 61450, 61451, 61509, 61510, 61531, 61532, 61553, 61554, 61570, 61581, 61597, 61598, 61628, 61629, 61654, 61655, 61672, 61683, 61694, 61705, 61716, and 61727; or a fragment or variant of any one of said nucleic acid sequences.

It is also preferred that the RNA comprises at least one coding sequence, wherein the coding sequence comprises a nucleic acid sequence selected from the group consisting of SEQ ID NO: 45853-53494, 61230-61232, 61263-61265, 61297-61299, 61318, 61330, 61344, 61355, 61368, 61379, 61396, 61397, 61424, 61435, 61452, 61453, 61511, 61512, 61533, 61534, 61555, 61556, 61571, 61582, 61599, 61600, 61630, 61631, 61656, 61657, 61673, 61684, 61695, 61706, 61717, 61728; or a fragment or variant of any one of said nucleic acid sequences.

Preferably, the at least one coding sequence of the RNA according to the invention comprises or consists of a nucleic acid sequence having a sequence identity of at least 5%, 10%, 20%, 30%, $_{40}$%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 45853-53494, 61230-61232, 61263-61265, 61297-61299, 61318, 61330, 61344, 61355, 61368, 61379, 61396, 61397, 61424, 61435, 61452, 61453, 61511, 61512, 61533, 61534, 61555, 61556, 61571, 61582, 61599, 61600, 61630, 61631, 61656, 61657, 61673, 61684, 61695, 61706, 61717, 61728; or a fragment or variant of any one of said nucleic acid sequences.

It is also preferred that the RNA comprises at least one coding sequence, wherein the coding sequence comprises a nucleic acid sequence selected from the group consisting of SEQ ID NOs: 53495-61136, 61233-61235, 61266-61268, 61300-61302, 61319, 61331, 61345, 61356, 61369, 61380, 61398, 61399, 61425, 61436, 61454, 61455, 61513, 61514, 61535, 61536, 61557, 61558, 61572, 61583, 61601, 61602, 61632, 61633, 61658, 61659, 61674, 61685, 61696, 61707, 61718, and 61729; or a fragment or variant of any one of said nucleic acid sequences.

Preferably, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NOs: 53495-61136, 61233-61235, 61266-61268, 61300-61302, 61319, 61331, 61345, 61356, 61369, 61380, 61398, 61399, 61425, 61436, 61454, 61455, 61513, 61514, 61535, 61536, 61557, 61558, 61572, 61583, 61601, 61602, 61632, 61633, 61658, 61659, 61674, 61685, 61696, 61707, 61718, and 61729; or a fragment or variant of any one of said nucleic acid sequences.

Sequences Adapted to Human Codon Usage:

According to the invention, a further preferred modification of the RNA of the present invention is based on the finding that codons encoding the same amino acid typically occur at different frequencies. According to the invention, in the modified RNA of the present invention, the coding sequence (coding region) as defined herein is preferably modified compared to the corresponding region of the respective wild-type RNA such that the frequency of the codons encoding the same amino acid corresponds to the naturally occurring frequency of that codon according to the human codon usage as e.g. shown in Table 10.

For example, in the case of the amino acid alanine (Ala) present in an amino acid sequence encoded by the at least one coding sequence of the RNA according to the invention, the wild type coding sequence is preferably adapted in a way that the codon "GCC" is used with a frequency of 0.40, the codon "GOT" is used with a frequency of 0.28, the codon "GCA" is used with a frequency of 0.22 and the codon "GCG" is used with a frequency of 0.10 etc. (see Table 10).

TABLE 10

Human codon usage table

| Aminoacid | codon | fraction | /1000 | Aminoacid | codon | fraction | /1000 |
|---|---|---|---|---|---|---|---|
| Ala | GCG | 0.10 | 7.4 | Pro | CCG | 0.11 | 6.9 |
| Ala | GCA | 0.22 | 15.8 | Pro | CCA | 0.27 | 16.9 |
| Ala | GCT | 0.28 | 18.5 | Pro | CCT | 0.29 | 17.5 |
| Ala | GCC* | 0.40 | 27.7 | Pro | CCC* | 0.33 | 19.8 |
| Cys | TGT | 0.42 | 10.6 | Gln | CAG* | 0.73 | 34.2 |
| Cys | TGC* | 0.58 | 12.6 | Gln | CAA | 0.27 | 12.3 |
| Asp | GAT | 0.44 | 21.8 | Arg | AGG | 0.22 | 12.0 |
| Asp | GAC* | 0.56 | 25.1 | Arg | AGA* | 0.21 | 12.1 |
| Glu | GAG* | 0.59 | 39.6 | Arg | CGG | 0.19 | 11.4 |
| Glu | GAA | 0.41 | 29.0 | Arg | CGA | 0.10 | 6.2 |
| Phe | TTT | 0.43 | 17.6 | Arg | CGT | 0.09 | 4.5 |
| Phe | TTC* | 0.57 | 20.3 | Arg | CGC | 0.19 | 10.4 |
| Gly | GGG | 0.23 | 16.5 | Ser | AGT | 0.14 | 12.1 |
| Gly | GGA | 0.26 | 16.5 | Ser | AGC* | 0.25 | 19.5 |
| Gly | GGT | 0.18 | 10.8 | Ser | TCG | 0.06 | 4.4 |
| Gly | GGC* | 0.33 | 22.2 | Ser | TCA | 0.15 | 12.2 |
| His | CAT | 0.41 | 10.9 | Ser | TCT | 0.18 | 15.2 |
| His | CAC* | 0.59 | 15.1 | Ser | TCC | 0.23 | 17.7 |
| Ile | ATA | 0.14 | 7.5 | Thr | ACG | 0.12 | 6.1 |
| Ile | ATT | 0.35 | 16.0 | Thr | ACA | 0.27 | 15.1 |
| Ile | ATC* | 0.52 | 20.8 | Thr | ACT | 0.23 | 13.1 |
| Lys | AAG* | 0.60 | 31.9 | Thr | ACC* | 0.38 | 18.9 |

TABLE 10-continued

Human codon usage table

| Aminoacid | codon | fraction | /1000 | Aminoacid | codon | fraction | /1000 |
|---|---|---|---|---|---|---|---|
| Lys | AAA | 0.40 | 24.4 | Val | GTG* | 0.48 | 28.1 |
| Leu | TTG | 0.12 | 12.9 | Val | GTA | 0.10 | 7.1 |
| Leu | TTA | 0.06 | 7.7 | Val | GTT | 0.17 | 11.0 |
| Leu | CTG* | 0.43 | 39.6 | Val | GTC | 0.25 | 14.5 |
| Leu | CTA | 0.07 | 7.2 | Trp | TGG* | 1 | 13.2 |
| Leu | CTT | 0.12 | 13.2 | Tyr | TAT | 0.42 | 12.2 |
| Leu | CTC | 0.20 | 19.6 | Tyr | TAC* | 0.58 | 15.3 |
| Met | ATG* | 1 | 22.0 | Stop | TGA* | 0.61 | 1.6 |
| Asn | AAT | 0.44 | 17.0 | Stop | TAG | 0.17 | 0.8 |
| Asn | AAC* | 0.56 | 19.1 | Stop | TM | 0.22 | 1.0 |

*most frequent codon

In a preferred embodiment, the present invention provides an RNA comprising at least one coding sequence, wherein the coding sequence comprises a nucleic acid sequence selected from the group consisting of SEQ ID NO: 22927-30568, 61221-61223, 61254-61256, 61288-61290, 61315, 61327, 61341, 61352, 61365, 61376, 61390, 61391, 61421, 61432, 61446, 61447, 61505, 61506, 61527, 61528, 61549, 61550, 61568, 61579, 61593, 61594, 61624, 61625, 61650, 61651, 61670, 61681, 61692, 61703, 61714, and 61725; or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 22927-30568, 61221-61223, 61254-61256, 61288-61290, 61315, 61327, 61341, 61352, 61365, 61376, 61390, 61391, 61421, 61432, 61446, 61447, 61505, 61506, 61527, 61528, 61549, 61550, 61568, 61579, 61593, 61594, 61624, 61625, 61650, 61651, 61670, 61681, 61692, 61703, 61714, and 61725; or a fragment or variant of any one of said nucleic acid sequences.

Codon-Optimized Sequences:

As described above it is preferred according to the invention, that all codons of the wild-type sequence which code for a tRNA, which is relatively rare in the cell, are exchanged for a codon which codes for a tRNA, which is relatively frequent in the cell and which, in each case, carries the same amino acid as the relatively rare tRNA. Therefore it is particularly preferred that the most frequent codons are used for each encoded amino acid (see Table 2, most frequent codons are marked with asterisks). Such an optimization procedure increases the codon adaptation index (CAI) and ultimately maximises the CAI. In the context of the invention, sequences with increased or maximized CAI are typically referred to as "codon-optimized" sequences and/or CAI increased and/or maximized sequences. According to a preferred embodiment, the RNA of the present invention comprises at least one coding sequence, wherein the coding sequence is codon-optimized as described herein. More preferably, the codon adaptation index (CAI) of the at least one coding sequence is at least 0.5, at least 0.8, at least 0.9 or at least 0.95. Most preferably, the codon adaptation index (CAI) of the at least one coding sequence is 1.

For example, in the case of the amino acid alanine (Ala) present in the amino acid sequence encoded by the at least one coding sequence of the RNA according to the invention, the wild type coding sequence is adapted in a way that the most frequent human codon "GCC" is always used for said amino acid, or for the amino acid Cysteine (Cys), the wild type sequence is adapted in a way that the most frequent human codon "TGC" is always used for said amino acid etc.

In a preferred embodiment, the present invention provides an RNA comprising at least one coding sequence, wherein the coding sequence comprises a nucleic acid sequence selected from the group consisting of SEQ ID NO: 30569-38210, 61224-61226, 61257-61259, 61291-61293, 61316, 61328, 61342, 61353, 61366, 61377, 61392, 61393, 61422, 61433, 61448, 61449, 61507, 61508, 61529, 61530, 61551, 61552, 61569, 61580, 61595, 61596, 61626, 61627, 61652, 61653, 61671, 61682, 61693, 61704, 61715, and 61726; or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 30569-38210, 61224-61226, 61257-61259, 61291-61293, 61316, 61328, 61342, 61353, 61366, 61377, 61392, 61393, 61422, 61433, 61448, 61449, 61507, 61508, 61529, 61530, 61551, 61552, 61569, 61580, 61595, 61596, 61626, 61627, 61652, 61653, 61671, 61682, 61693, 61704, 61715, and 61726; or a fragment or variant of any one of said nucleic acid sequences.

C-Optimized Sequences:

According to another embodiment, the RNA of the composition of the present invention may be modified by modifying, preferably increasing, the cytosine (C) content of the RNA, preferably of the coding region of the aRNA.

In a particularly preferred embodiment of the present invention, the C content of the coding region of the RNA of the present invention is modified, preferably increased, compared to the C content of the coding region of the respective wild-type RNA, i.e. the unmodified RNA. The amino acid sequence encoded by the at least one coding sequence of the RNA of the present invention is preferably not modified as compared to the amino acid sequence encoded by the respective wild-type mRNA.

In a preferred embodiment of the present invention, the modified RNA is modified such that at least 10%, 20%, 30%, 40%, 50%, 60%, 70% or 80%, or at least 90% of the theoretically possible maximum cytosine-content or even a maximum cytosine-content is achieved.

In further preferred embodiments, at least 10%, 20%, 30%, 40%, 50%, 60%, 70%, 80%, 90% or even 100% of the codons of the target RNA wild type sequence, which are "cytosine content optimizable" are replaced by codons having a higher cytosine-content than the ones present in the wild type sequence.

In a further preferred embodiment, some of the codons of the wild type coding sequence may additionally be modified such that a codon for a relatively rare tRNA in the cell is exchanged by a codon for a relatively frequent tRNA in the cell, provided that the substituted codon for a relatively frequent tRNA carries the same amino acid as the relatively rare tRNA of the original wild type codon. Preferably, all of the codons for a relatively rare tRNA are replaced by a codon for a relatively frequent tRNA in the cell, except codons encoding amino acids, which are exclusively encoded by codons not containing any cytosine, or except for glutamine (Gln), which is encoded by two codons each containing the same number of cytosines.

In a further preferred embodiment of the present invention, the modified target RNA is modified such that at least 80%, or at least 90% of the theoretically possible maximum cytosine-content or even a maximum cytosine-content is achieved by means of codons, which code for relatively frequent tRNAs in the cell, wherein the amino acid sequence remains unchanged.

Due to the naturally occurring degeneracy of the genetic code, more than one codon may encode a particular amino acid. Accordingly, 18 out of 20 naturally occurring amino acids are encoded by more than one codon (with Tryp and Met being an exception), e.g. by 2 codons (e.g. Cys, Asp, Glu), by three codons (e.g. Ile), by 4 codons (e.g. Al, Gly, Pro) or by 6 codons (e.g. Leu, Arg, Ser). However, not all codons encoding the same amino acid are utilized with the same frequency under in vivo conditions. Depending on each single organism, a typical codon usage profile is established.

The term 'cytosine content-optimizable codon' as used within the context of the present invention refers to codons, which exhibit a lower content of cytosines than other codons encoding the same amino acid. Accordingly, any wild type codon, which may be replaced by another codon encoding the same amino acid and exhibiting a higher number of cytosines within that codon, is considered to be cytosine-optimizable (C-optimizable). Any such substitution of a C-optimizable wild type codon by the specific C-optimized codon within a wild type coding region increases its overall C-content and reflects a C-enriched modified mRNA sequence. According to a preferred embodiment, the RNA of the present invention, preferably the at least one coding sequence of the RNA of the present invention comprises or consists of a C-maximized RNA sequence containing C-optimized codons for all potentially C-optimizable codons. Accordingly, 100% or all of the theoretically replaceable C-optimizable codons are preferably replaced by C-optimized codons over the entire length of the coding region.

In this context, cytosine-content optimizable codons are codons, which contain a lower number of cytosines than other codons coding for the same amino acid.

Any of the codons GCG, GCA, GCU codes for the amino acid Ala, which may be exchanged by the codon GCC encoding the same amino acid, and/or the codon UGU that codes for Cys may be exchanged by the codon UGC encoding the same amino acid, and/or the codon GAU which codes for Asp may be exchanged by the codon GAC encoding the same amino acid, and/or the codon that UUU that codes for Phe may be exchanged for the codon UUC encoding the same amino acid, and/or any of the codons GGG, GGA, GGU that code Gly may be exchanged by the codon GGC encoding the same amino acid, and/or the codon CAU that codes for His may be exchanged by the codon CAC encoding the same amino acid, and/or any of the codons AUA, AUU that code for Ile may be exchanged by the codon AUC, and/or any of the codons UUG, UUA, CUG, CUA, CUU coding for Leu may be exchanged by the codon CUC encoding the same amino acid, and/or the codon AAU that codes for Asn may be exchanged by the codon AAC encoding the same amino acid, and/or any of the codons CCG, CCA, CCU coding for Pro may be exchanged by the codon CCC encoding the same amino acid, and/or any of the codons AGG, AGA, CGG, CGA, CGU coding for Arg may be exchanged by the codon CGC encoding the same amino acid, and/or any of the codons AGU, AGC, UCG, UCA, UCU coding for Ser may be exchanged by the codon UCC encoding the same amino acid, and/or any of the codons ACG, ACA, ACU coding for Thr may be exchanged by the codon ACC encoding the same amino acid, and/or any of the codons GUG, GUA, GUU coding for Val may be exchanged by the codon GUC encoding the same amino acid, and/or the codon UAU coding for Tyr may be exchanged by the codon UAC encoding the same amino acid.

In any of the above instances, the number of cytosines is increased by 1 per exchanged codon. Exchange of all non C-optimized codons (corresponding to C-optimizable codons) of the coding region results in a C-maximized coding sequence. In the context of the invention, at least 70%, preferably at least 80%, more preferably at least 90%, of the non C-optimized codons within the at least one coding region of the RNA according to the invention are replaced by C-optimized codons.

It may be preferred that for some amino acids the percentage of C-optimizable codons replaced by C-optimized codons is less than 70%, while for other amino acids the percentage of replaced codons is higher than 70% to meet the overall percentage of C-optimization of at least 70% of all C-optimizable wild type codons of the coding region.

Preferably, in a C-optimized RNA of the invention, at least 50% of the C-optimizable wild type codons for any given amino acid are replaced by C-optimized codons, e.g. any modified C-enriched RNA preferably contains at least 50% C-optimized codons at C-optimizable wild type codon positions encoding any one of the above mentioned amino acids Ala, Cys, Asp, Phe, Gly, His, Ile, Leu, Asn, Pro, Arg, Ser, Thr, Val and Tyr, preferably at least 60%.

In this context codons encoding amino acids, which are not cytosine content-optimizable and which are, however, encoded by at least two codons, may be used without any further selection process. However, the codon of the wild type sequence that codes for a relatively rare tRNA in the cell, e.g. a human cell, may be exchanged for a codon that codes for a relatively frequent tRNA in the cell, wherein both code for the same amino acid. Accordingly, the relatively rare codon GAA coding for Glu may be exchanged by the relative frequent codon GAG coding for the same amino acid, and/or the relatively rare codon AAA coding for Lys may be exchanged by the relative frequent codon AAG coding for the same amino acid, and/or the relatively rare codon CAA coding for Gln may be exchanged for the relative frequent codon CAG encoding the same amino acid.

In this context, the amino acids Met (AUG) and Trp (UGG), which are encoded by only one codon each, remain unchanged. Stop codons are not cytosine-content optimized, however, the relatively rare stop codons amber, ochre (UAA, UAG) may be exchanged by the relatively frequent stop codon opal (UGA).

The single substitutions listed above may be used individually as well as in all possible combinations in order to optimize the cytosine-content of the modified RNA compared to the wild type mRNA sequence.

Accordingly, the at least one coding sequence as defined herein may be changed compared to the coding region of the respective wild type RNA in such a way that an amino acid encoded by at least two or more codons, of which one comprises one additional cytosine, such a codon may be exchanged by the C-optimized codon comprising one additional cytosine, wherein the amino acid is preferably unaltered compared to the wild type sequence.

In a preferred embodiment, the present invention provides an RNA comprising at least one coding sequence, wherein the coding sequence comprises a nucleic acid sequence selected from the group consisting of SEQ ID NO: 15285-22926, 61218-61220, 61251-61253, 61285-61287, 61314, 61326, 61340, 61351, 61364, 61375, 61388, 61389, 61420, 61431, 61444, 61445, 61503, 61504, 61525, 61526, 61547, 61548, 61567, 61578, 61591, 61592, 61622, 61623, 61648, 61649, 61669, 61680, 61691, 61702, 61713, and 61724; or a fragment or variant of any one of said nucleic acid sequences.

According to a further embodiment, the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 15285-22926, 61218-61220, 61251-61253, 61285-61287, 61314, 61326, 61340, 61351, 61364, 61375, 61388, 61389, 61420, 61431, 61444, 61445, 61503, 61504, 61525, 61526, 61547, 61548, 61567, 61578, 61591, 61592, 61622, 61623, 61648, 61649, 61669, 61680, 61691, 61702, 61713, and 61724; or a fragment or variant of any one of said nucleic acid sequences.

According to a particularly preferred embodiment, the invention provides an RNA, preferably an mRNA, comprising at least one coding sequence as defined herein, wherein the G/C content of the at least one coding sequence of the RNA is increased compared to the G/C content of the corresponding coding sequence of the corresponding wild-type RNA, and/or wherein the C content of the at least one coding sequence of the RNA is increased compared to the C content of the corresponding coding sequence of the corresponding wild-type RNA, and/or wherein the codons in the at least one coding sequence of the RNA are adapted to human codon usage, wherein the codon adaptation index (CAI) is preferably increased or maximised in the at least one coding sequence of the RNA, and wherein the amino acid sequence encoded by the RNA is preferably not being modified compared to the amino acid sequence encoded by the corresponding wild-type RNA.

Accordingly, the nucleic acid sequence, which is comprised by the at least one coding sequence of the inventive RNA, is preferably selected from the group consisting of SEQ ID NO: 7643-61136, 61162, 61164, 61165, 61167, 61169, 61170, 61172, 61174, 61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-

61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant of any one of said nucleic acid sequences.

It is also preferred that the at least one coding sequence of the RNA according to the invention comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 7643-61136, 61162, 61164, 61165, 61167, 61169, 61170, 61172, 61174, 61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant of any one of said nucleic acid sequences.

According to another preferred embodiment of the invention, a modified RNA as defined herein, can be modified by the addition of a so-called '5' cap' structure, which preferably stabilizes the RNA as described herein. A 5'-cap is an entity, typically a modified nucleotide entity, which generally "caps" the 5'-end of a mature mRNA. A 5'-cap may typically be formed by a modified nucleotide, particularly by a derivative of a guanine nucleotide. Preferably, the 5'-cap is linked to the 5'-terminus via a 5'-5'-triphosphate linkage. A 5'-cap may be methylated, e.g. m7GpppN, wherein N is the terminal 5' nucleotide of the nucleic acid carrying the 5'-cap, typically the 5'-end of an mRNA. m7GpppN is the 5'-cap structure, which naturally occurs in mRNA transcribed by polymerase II and is therefore preferably not considered as modification comprised in a modified mRNA in this context. Accordingly, a modified RNA of the present invention may comprise a m7GpppN as 5'-cap, but additionally the modified RNA typically comprises at least one further modification as defined herein.

Further examples of 5'cap structures include glyceryl, inverted deoxy abasic residue (moiety), 4',5' methylene nucleotide, 1-(beta-D-erythrofuranosyl) nucleotide, 4'-thio nucleotide, carbocyclic nucleotide, 1,5-anhydrohexitol nucleotide, L-nucleotides, alpha-nucleotide, modified base nucleotide, threo-pentofuranosyl nucleotide, acyclic 3',4'-seco nucleotide, acyclic 3,4-dihydroxybutyl nucleotide, acyclic 3,5 dihydroxypentyl nucleotide, 3'-3'-inverted nucleotide moiety, 3'-3'-inverted abasic moiety, 3'-2'-inverted nucleotide moiety, 3'-2'-inverted abasic moiety, 1,4-butanediol phosphate, 3'-phosphoramidate, hexylphosphate, aminohexyl phosphate, 3'-phosphate, 3'phosphorothioate, phosphorodithioate, or bridging or non-bridging methylphosphonate moiety. These modified 5'-cap structures are regarded as at least one modification in this context.

Particularly preferred modified 5'-cap structures are cap1 (methylation of the ribose of the adjacent nucleotide of m7G), cap2 (additional methylation of the ribose of the 2nd nucleotide downstream of the m7G), cap3 (additional methylation of the ribose of the 3rd nucleotide downstream of the m7G), cap4 (methylation of the ribose of the 4th nucleotide downstream of the m7G), ARCA (anti-reverse cap analogue, modified ARCA (e.g. phosphothioate modified ARCA), inosine, N1-methyl-guanosine, 2'-fluoro-guanosine, 7-deaza-guanosine, 8-oxo-guanosine, 2-amino-guanosine, LNA-guanosine, and 2-azido-guanosine. Accordingly, the RNA according to the invention preferably comprises a 5'-cap structure.

In a preferred embodiment, the RNA according to the invention comprises at least one 5'- or 3'-UTR element. In this context, an UTR element comprises or consists of a nucleic acid sequence, which is derived from the 5'- or 3'-UTR of any naturally occurring gene or which is derived from a fragment, a homolog or a variant of the 5'- or 3'-UTR of a gene. Preferably, the 5'- or 3'-UTR element used according to the present invention is heterologous to the at least one coding sequence of the RNA of the invention. Even if 5'- or 3'-UTR elements derived from naturally occurring genes are preferred, also synthetically engineered UTR elements may be used in the context of the present invention.

The term '3'UTR element' typically refers to a nucleic acid sequence, which comprises or consists of a nucleic acid sequence that is derived from a 3'UTR or from a variant of a 3'UTR. A 3'UTR element in the sense of the present invention may represent the 3'UTR of an RNA, preferably an mRNA. Thus, in the sense of the present invention, preferably, a 3'UTR element may be the 3'UTR of an RNA, preferably of an mRNA, or it may be the transcription template for a 3'UTR of an RNA. Thus, a 3'UTR element preferably is a nucleic acid sequence which corresponds to the 3'UTR of an RNA, preferably to the 3'UTR of an mRNA, such as an mRNA obtained by transcription of a genetically engineered vector construct. Preferably, the 3'UTR element fulfils the function of a 3'UTR or encodes a sequence which fulfils the function of a 3'UTR.

According to a preferred embodiment, the RNA, preferably an mRNA, according to the invention comprises a 5'-cap structure and/or at least one 3'-untranslated region element (3'-UTR element), preferably as defined herein. More preferably, the RNA further comprises a 5'-UTR element as defined herein.

According to a further preferred embodiment, the RNA of the present invention may contain a poly-A tail on the 3' terminus of typically about 10 to 200 adenosine nucleotides, preferably about 10 to 100 adenosine nucleotides, more preferably about 40 to 80 adenosine nucleotides or even more preferably about 50 to 70 adenosine nucleotides.

Preferably, the poly(A) sequence in the RNA of the present invention is derived from a DNA template by RNA in vitro transcription. Alternatively, the poly(A) sequence may also be obtained in vitro by common methods of chemical-synthesis without being necessarily transcribed from a DNA-progenitor. Moreover, poly(A) sequences, or poly(A) tails may be generated by enzymatic polyadenylation of the RNA according to the present invention using commercially available polyadenylation kits and corresponding protocols known in the art.

Alternatively, the RNA as described herein optionally comprises a polyadenylation signal, which is defined herein as a signal, which conveys polyadenylation to a (transcribed) RNA by specific protein factors (e.g. cleavage and polyadenylation specificity factor (CPSF), cleavage stimulation factor (CstF), cleavage factors I and II (CF I and CF II), poly(A) polymerase (PAP)). In this context, a consensus polyadenylation signal is preferred comprising the NN(U/T)ANA consensus sequence. In a particularly preferred aspect, the polyadenylation signal comprises one of the following sequences: AA(U/T)AAA or A(U/T)(U/T)AAA (wherein uridine is usually present in RNA and thymidine is usually present in DNA).

According to a further preferred embodiment, the RNA of the present invention may contain a poly(C) tail on the 3' terminus of typically about 10 to 200 cytosine nucleotides, preferably about 10 to 100 cytosine nucleotides, more preferably about 20 to 70 cytosine nucleotides or even more preferably about 20 to 60 or even 10 to 40 cytosine nucleotides.

In a further preferred embodiment, the RNA according to the invention further comprises at least one 3'UTR element. Preferably, the at least one 3'UTR element comprises or consists of a nucleic acid sequence derived from the 3'UTR of a chordate gene, preferably a vertebrate gene, more preferably a mammalian gene, most preferably a human gene, or from a variant of the 3'UTR of a chordate gene, preferably a vertebrate gene, more preferably a mammalian gene, most preferably a human gene.

Preferably, the RNA of the present invention comprises a 3'UTR element, which may be derivable from a gene that relates to an mRNA with an enhanced half-life (that provides a stable mRNA), for example a 3'UTR element as defined and described below. Preferably, the 3'-UTR element is a nucleic acid sequence derived from a 3'-UTR of a gene, which preferably encodes a stable mRNA, or from a homolog, a fragment or a variant of said gene In a particularly preferred embodiment, the 3'UTR element comprises or consists of a nucleic acid sequence, which is derived from a 3'UTR of a gene selected from the group consisting of an albumin gene, an α-globin gene, a β-globin gene, a tyrosine hydroxylase gene, a lipoxygenase gene, and a collagen alpha gene, such as a collagen alpha 1(1) gene, or from a variant of a 3'UTR of a gene selected from the group consisting of an albumin gene, an α-globin gene, a β-globin gene, a tyrosine hydroxylase gene, a lipoxygenase gene, and a collagen alpha gene, such as a collagen alpha 1(I) gene according to SEQ ID NOs: 1369-1390 of the patent application WO2013/143700, whose disclosure is incorporated herein by reference, or from a homolog, a fragment or a variant thereof. In a particularly preferred embodiment, the 3'UTR element comprises or consists of a nucleic acid sequence which is derived from a 3'UTR of an albumin gene, preferably a vertebrate albumin gene, more preferably a mammalian albumin gene, most preferably a human albumin gene according to SEQ ID NO: 61151 or the corresponding RNA sequence SEQ ID NO: 61152.

In this context it is particularly preferred that the RNA according to the invention comprises a 3'-UTR element comprising a corresponding RNA sequence derived from the nucleic acids according to SEQ ID NOs: 1369-1390 of the patent application WO2013/143700 or a fragment, homolog or variant thereof.

Most preferably the 3'-UTR element comprises the nucleic acid sequence derived from a fragment of the human albumin gene according to SEQ ID NOs: 61153 or 61155.

In this context, it is particularly preferred that the 3'-UTR element of the RNA according to the present invention comprises or consists of a corresponding RNA sequence of the nucleic acid sequence according to SEQ ID NO: 61153 or 61155 as shown in SEQ ID NOs: 61154 or 61156.

In another particularly preferred embodiment, the 3'UTR element comprises or consists of a nucleic acid sequence which is derived from a 3'UTR of an α-globin gene, preferably a vertebrate α- or β-globin gene, more preferably a mammalian α- or β-globin gene, most preferably a human α- or β-globin gene according to SEQ ID NOs: 61143, 61145 or 61147 or the corresponding RNA sequences SEQ ID NOs: 61144, 61146 or 61148.

For example, the 3'UTR element may comprise or consist of the center, α-complex-binding portion of the 3'UTR of an α-globin gene, such as of a human α-globin gene, or a homolog, a fragment, or a variant of an α-globin gene, preferably according to SEQ ID NO: 61149:

Center, α-complex-binding portion of the 3'UTR of an α-globin gene (also named herein as "muag") GCCC-GATGGGCCTCC-CAACGGGCCCTCCTCCCCTCCTTGCACCG (SEQ ID NO: 61149 corresponding to SEQ ID NO: 1393 of the patent application WO2013/143700).

In this context it is particularly preferred that the 3'-UTR element of the RNA according to the invention comprises or consists of a corresponding RNA sequence of the nucleic acid sequence according to SEQ ID NO: 61149 as shown in SEQ ID NO: 61150, or a homolog, a fragment or variant thereof.

The term 'a nucleic acid sequence which is derived from the 3'UTR of a [ . . . ] gene' preferably refers to a nucleic acid sequence which is based on the 3'UTR sequence of a [ . . . ] gene or on a part thereof, such as on the 3'UTR of an albumin gene, an α-globin gene, a β-globin gene, a tyrosine hydroxylase gene, a lipoxygenase gene, or a collagen alpha gene, such as a collagen alpha 1(I) gene, preferably of an albumin gene or on a part thereof. This term includes sequences corresponding to the entire 3'UTR sequence, i.e. the full length 3'UTR sequence of a gene, and sequences corresponding to a fragment of the 3'UTR sequence of a gene, such as an albumin gene, α-globin gene, β-globin gene, tyrosine hydroxylase gene, lipoxygenase gene, or collagen alpha gene, such as a collagen alpha 1(I) gene, preferably of an albumin gene.

The term 'a nucleic acid sequence which is derived from a variant of the 3'UTR of a [ . . . ] gene' preferably refers to a nucleic acid sequence, which is based on a variant of the 3'UTR sequence of a gene, such as on a variant of the 3'UTR of an albumin gene, an α-globin gene, a β-globin gene, a tyrosine hydroxylase gene, a lipoxygenase gene, or a collagen alpha gene, such as a collagen alpha 1(I) gene, or on a part thereof as described above. This term includes sequences corresponding to the entire sequence of the variant of the 3'UTR of a gene, i.e. the full length variant 3'UTR sequence of a gene, and sequences corresponding to a fragment of the variant 3'UTR sequence of a gene. A fragment in this context preferably consists of a continuous stretch of nucleotides corresponding to a continuous stretch of nucleotides in the full-length variant 3'UTR, which represents at least 20%, preferably at least 30%, more preferably at least 40%, more preferably at least 50%, even more preferably at least 60%, even more preferably at least 70%, even more preferably at least 80%, and most preferably at least 90% of the full-length variant 3'UTR. Such a fragment of a variant, in the sense of the present invention, is preferably a functional fragment of a variant as described herein.

In a particularly preferred embodiment, the at least one mRNA of the inventive composition comprises at least one 5'-untranslated region element (5'UTR element). Preferably, the at least one 5'UTR element comprises or consists of a nucleic acid sequence, which is derived from the 5'UTR of a TOP gene or which is derived from a fragment, homolog or variant of the 5'UTR of a TOP gene.

It is particularly preferred that the 5'UTR element does not comprise a TOP-motif or a 5'TOP, as defined above.

In some embodiments, the nucleic acid sequence of the 5'UTR element, which is derived from a 5'UTR of a TOP gene, terminates at its 3'-end with a nucleotide located at position 1, 2, 3, 4, 5, 6, 7, 8, 9 or 10 upstream of the start codon (e.g. A(U/T)G) of the gene or mRNA it is derived from. Thus, the 5'UTR element does not comprise any part of the protein coding region. Thus, preferably, the only protein coding part of the at least one mRNA of the inventive composition is provided by the coding region.

The nucleic acid sequence derived from the 5'UTR of a TOP gene is preferably derived from a eukaryotic TOP gene, preferably a plant or animal TOP gene, more preferably a chordate TOP gene, even more preferably a vertebrate TOP gene, most preferably a mammalian TOP gene, such as a human TOP gene.

For example, the 5'UTR element is preferably selected from 5'-UTR elements comprising or consisting of a nucleic acid sequence, which is derived from a nucleic acid sequence selected from the group consisting of SEQ ID NOs: 1-1363, SEQ ID NO: 1395, SEQ ID NO: 1421 and SEQ ID NO: 1422 of the patent application WO2013/143700, whose disclosure is incorporated herein by reference, from the homologs of SEQ ID NOs: 1-1363, SEQ ID NO: 1395, SEQ ID NO: 1421 and SEQ ID NO: 1422 of the patent application WO2013/143700, from a variant thereof, or preferably from a corresponding RNA sequence. The term "homologs of SEQ ID NOs: 1-1363, SEQ ID NO: 1395, SEQ ID NO: 1421 and SEQ ID NO: 1422 of the patent application WO2013/143700" refers to sequences of other species than Homo sapiens, which are homologous to the sequences according to SEQ ID NOs: 1-1363, SEQ ID NO: 1395, SEQ ID NO: 1421 and SEQ ID NO: 1422 of the patent application WO2013/143700.

In a preferred embodiment, the 5'UTR element of the RNA according to the invention comprises or consists of a nucleic acid sequence, which is derived from a nucleic acid sequence extending from nucleotide position 5 (i.e. the nucleotide that is located at position 5 in the sequence) to the nucleotide position immediately 5' to the start codon (located at the 3' end of the sequences), e.g. the nucleotide position immediately 5' to the ATG sequence, of a nucleic acid sequence selected from SEQ ID NOs: 1-1363, SEQ ID NO: 1395, SEQ ID NO: 1421 and SEQ ID NO: 1422 of the patent application WO2013/143700, from the homologs of SEQ ID NOs:1-1363, SEQ ID NO: 1395, SEQ ID NO: 1421 and SEQ ID NO: 1422 of the patent application WO2013/143700 from a variant thereof, or a corresponding RNA sequence. It is particularly preferred that the 5' UTR element is derived from a nucleic acid sequence extending from the nucleotide position immediately 3' to the 5'TOP to the nucleotide position immediately 5' to the start codon (located at the 3' end of the sequences), e.g. the nucleotide position immediately 5' to the ATG sequence, of a nucleic acid sequence selected from SEQ ID NOs:1-1363, SEQ ID NO: 1395, SEQ ID NO: 1421 and SEQ ID NO: 1422 of the patent application WO2013/143700, from the homologs of SEQ ID NOs:1-1363, SEQ ID NO: 1395, SEQ ID NO: 1421 and SEQ ID NO: 1422 of the patent application WO2013/143700, from a variant thereof, or a corresponding RNA sequence.

In a particularly preferred embodiment, the 5'UTR element comprises or consists of a nucleic acid sequence, which is derived from a 5'UTR of a TOP gene encoding a ribosomal protein or from a variant of a 5'UTR of a TOP gene encoding a ribosomal protein. For example, the 5'UTR element comprises or consists of a nucleic acid sequence, which is derived from a 5'UTR of a nucleic acid sequence according to any of SEQ ID NOs: 67, 170, 193, 244, 259, 554, 650, 675, 700, 721, 913, 1016, 1063, 1120, 1138, and 1284-1360 of the patent application WO2013/143700, a corresponding RNA sequence, a homolog thereof, or a variant thereof as described herein, preferably lacking the 5'TOP motif. As described above, the sequence extending from position 5 to the nucleotide immediately 5' to the ATG (which is located at the 3'end of the sequences) corresponds to the 5'UTR of said sequences.

Preferably, the 5'UTR element comprises or consists of a nucleic acid sequence, which is derived from a 5'UTR of a TOP gene encoding a ribosomal Large protein (RPL) or from a homolog or variant of a 5'UTR of a TOP gene encoding a ribosomal Large protein (RPL). For example, the 5'UTR element comprises or consists of a nucleic acid sequence, which is derived from a 5'UTR of a nucleic acid sequence according to any of SEQ ID NOs: 67, 259, 1284-1318, 1344, 1346, 1348-1354, 1357, 1358, 1421 and 1422of the patent application WO2013/143700, a corresponding RNA sequence, a homolog thereof, or a variant thereof as described herein, preferably lacking the 5'TOP motif.

In a particularly preferred embodiment, the 5'UTR element comprises or consists of a nucleic acid sequence which is derived from the 5'UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, or from a variant of the 5'UTR of a ribosomal protein Large 32 gene, preferably from a vertebrate ribosomal protein Large 32 (L32) gene, more preferably from a mammalian ribosomal protein Large 32 (L32) gene, most preferably from a human ribosomal protein Large 32 (L32) gene, wherein preferably the 5'UTR element does not comprise the 5'TOP of said gene.

Accordingly, in a particularly preferred embodiment, the 5'UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 61137 (5'-UTR of human ribosomal protein Large 32 lacking the 5' terminal oligopyrimidine tract: GGCGCTGCCTACGGAGGTGGCAGC-CATCTCCTTCTCGGCATC; corresponding to SEQ ID NO: 1368 of the patent application WO2013/143700) or preferably to a corresponding RNA sequence (such as SEQ ID NO: 61138), or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 61137 or more preferably to a corresponding RNA sequence (SEQ ID NO: 61138), wherein, preferably, the fragment is as described above, i.e. being a continuous stretch of nucleotides representing at least 20% etc. of the full-length 5'UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

In some embodiments, the RNA according to the invention comprises a 5'UTR element, which comprises or consists of a nucleic acid sequence, which is derived from the 5'UTR of a vertebrate TOP gene, such as a mammalian, e.g. a human TOP gene, selected from RPSA, RPS2, RPS3, RPS3A, RPS4, RPS5, RPS6, RPS7, RPS8, RPS9, RPS10, RPS11, RPS12, RPS13, RPS14, RPS15, RPS15A, RPS16, RPS17, RPS18, RPS19, RPS20, RPS21, RPS23, RPS24, RPS25, RPS26, RPS27, RPS27A, RPS28, RPS29, RPS30, RPL3, RPL4, RPL5, RPL6, RPL7, RPL7A, RPL8, RPL9, RPL10, RPL10A, RPL11, RPL12, RPL13, RPL13A, RPL14, RPL15, RPL17, RPL18, RPL18A, RPL19, RPL21, RPL22, RPL23, RPL23A, RPL24, RPL26, RPL27, RPL27A, RPL28, RPL29, RPL30, RPL31, RPL32, RPL34, RPL35, RPL35A, RPL36, RPL36A, RPL37, RPL37A, RPL38, RPL39, RPL40, RPL41, RPLP0, RPLP1, RPLP2, RPLP3, RPLP0, RPLP1, RPLP2, EEF1A1, EEF1B2, EEF1D, EEF1G, EEF2, EIF3E, EIF3F, EIF3H, EIF2S3, EIF3C, EIF3K, EIF3EIP, EIF4A2, PABPC1, HNRNPA1, TPT1, TUBB1, UBA52, NPM1, ATP5G2, GNB2L1, NME2, UQCRB, or from a homolog or variant thereof, wherein preferably the 5'UTR element does not comprise a TOP-motif or the 5'TOP of said genes, and wherein optionally the 5'UTR element starts at its 5'-end with a nucleotide located at position 1, 2, 3, 4, 5, 6, 7, 8, 9 or 10 downstream of the 5'terminal oligopyrimidine tract (TOP) and wherein further optionally the 5'UTR element which is derived from a 5'UTR of a TOP gene terminates at its 3'-end with a nucleotide located at position 1, 2, 3, 4, 5, 6, 7, 8, 9 or 10 upstream of the start codon (A(U/T)G) of the gene it is derived from.

In further particularly preferred embodiments, the 5'UTR element comprises or consists of a nucleic acid sequence, which is derived from the 5'UTR of a ribosomal protein Large 32 gene (RPL32), a ribosomal protein Large 35 gene (RPL35), a ribosomal protein Large 21 gene (RPL21), an ATP synthase, H+ transporting, mitochondrial F1 complex, alpha subunit 1, cardiac muscle (ATP5A1) gene, an hydroxysteroid (17-beta) dehydrogenase 4 gene (HSD17B4), an androgen-induced 1 gene (AIG1), cytochrome c oxidase subunit VIc gene (COX6C), or a N-acylsphingosine amidohydrolase (acid ceramidase) 1 gene (ASAH1) or from a variant thereof, preferably from a vertebrate ribosomal protein Large 32 gene (RPL32), a vertebrate ribosomal protein Large 35 gene (RPL35), a vertebrate ribosomal protein Large 21 gene (RPL21), a vertebrate ATP synthase, H+ transporting, mitochondrial F1 complex, alpha subunit 1, cardiac muscle (ATP5A1) gene, a vertebrate hydroxysteroid (17-beta) dehydrogenase 4 gene (HSD17B4), a vertebrate androgen-induced 1 gene (AIG1), a vertebrate cytochrome c oxidase subunit VIc gene (COX6C), or a vertebrate N-acylsphingosine amidohydrolase (acid ceramidase) 1 gene (ASAH1) or from a variant thereof, more preferably from a mammalian ribosomal protein Large 32 gene (RPL32), a ribosomal protein Large 35 gene (RPL35), a ribosomal protein Large 21 gene (RPL21), a mammalian ATP synthase, H+ transporting, mitochondrial F1 complex, alpha subunit 1, cardiac muscle (ATP5A1) gene, a mammalian hydroxysteroid (17-beta) dehydrogenase 4 gene (HSD17B4), a mammalian androgen-induced 1 gene (AIG1), a mammalian cyto-chrome c oxidase subunit VIc gene (COX6C), or a mammalian N-acylsphingosine ami-dohydrolase (acid ceramidase) 1 gene (ASAH1) or from a variant thereof, most preferably from a human ribosomal protein Large 32 gene (RPL32), a human ribosomal protein Large 35 gene (RPL35), a human ribosomal protein Large 21 gene (RPL21), a human ATP syn-thase, H+ transporting, mitochondrial F1 complex, alpha subunit 1, cardiac muscle (ATP5A1) gene, a human hydroxysteroid (17-beta) dehydrogenase 4 gene (HSD17B4), a human androgen-induced 1 gene (AIG1), a human cytochrome c oxidase subunit VIc gene (COX6C), or a human N-acylsphingosine amidohydrolase (acid ceramidase) 1 gene (ASAH1) or from a variant thereof, wherein preferably the 5'UTR element does not comprise the 5'TOP of said gene.

Accordingly, in a particularly preferred embodiment, the 5'UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, or a corresponding RNA sequence, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 1368, or SEQ ID NOs: 1412-1420 of the patent application WO2013/143700, wherein, preferably, the fragment is as described above, i.e. being a continuous stretch of nucleotides representing at least 20% etc. of the full-length 5'UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Accordingly, in a particularly preferred embodiment, the 5'UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 61139 or 61140 (5'-UTR of ATP5A1 lacking the 5' terminal oligopyrimidine tract: GCGGCTCGGCCAT-TTTGTCCCAGTCAGTCCG-GAGGCTGCGGCTGCAGAAGTACCGCCTG CGGAGTAACTGCAAAG; corresponding to SEQ ID NO: 1414 of the patent application WO2013/143700) or preferably to a corresponding RNA sequence, or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 61139or more preferably to a corresponding RNA sequence (SEQ ID NO: 61140), wherein, preferably, the fragment is as described above, i.e. being a continuous stretch of nucleotides representing at least 20% etc. of the full-length 5'UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

As described above, the 5'UTR element preferably comprises or consists of a nucleic acid sequence, which is derived from the 5'UTR of a hydroxysteroid (17-beta) dehydrogenase 4 gene (gene HSD17B4, which encodes peroxisomal multifunctional enzyme type 2, first identified as 17-beta-estradiol dehydrogenase). More preferably, such a 5'UTR element lacks the 5' terminal oligopyrimidine tract.

Accordingly, in a particularly preferred embodiment, the 5'UTR element comprises or consists of a nucleic acid sequence, which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 61141 (5'-UTR of HSD17B4 lacking the 5' terminal oligopyrimidine tract) or preferably to a corresponding RNA sequence (such as SEQ ID NO: 61142), or wherein the at least one 5'UTR element comprises or consists of a fragment of a nucleic acid sequence which has an identity of at least about 40%, preferably of at least about 50%, preferably of at least about 60%, preferably of at least about 70%, more preferably of at least about 80%, more preferably of at least about 90%, even more preferably of at least about 95%, even more preferably of at least about 99% to the nucleic acid sequence according to SEQ ID NO: 61141 or more preferably to a corresponding RNA sequence (SEQ ID NO: 61142), wherein, preferably, the fragment is as described above, i.e. being a continuous stretch of nucleotides representing at least 20% etc. of the full-length 5'UTR. Preferably, the fragment exhibits a length of at least about 20 nucleotides or more, preferably of at least about 30 nucleotides or more, more preferably of at least about 40 nucleotides or more. Preferably, the fragment is a functional fragment as described herein.

Preferably, the at least one 5'UTR element and the at least one 3'UTR element act synergistically to increase protein production from the at least one mRNA of the inventive composition as described above.

In a particularly preferred embodiment, the RNA according to the invention comprises a histone stem-loop sequence/structure. Such histone stem-loop sequences are preferably selected from histone stem-loop sequences as disclosed in WO 2012/019780, the disclosure of which is incorporated herewith by reference.

A histone stem-loop sequence, suitable to be used within the present invention, is preferably selected from at least one of the following formulae (I) or (II):

formula (I)

(stem-loop sequence without stem bordering elements):

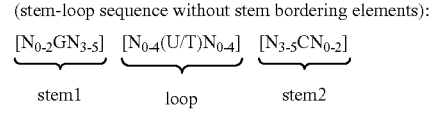

formula (II)

(stem-loop sequence with stem bordering elements):

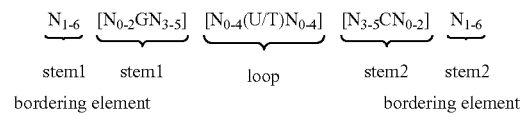

wherein:

stem1 or stem2 bordering elements $N_{1-6}$ is a consecutive sequence of 1 to 6, preferably of 2 to 6, more preferably of 2 to 5, even more preferably of 3 to 5, most preferably of 4 to 5 or 5 N, wherein each N is independently from another selected from a nucleotide selected from A, U, T, G and C, or a nucleotide analogue thereof;

stem1 $[N_{0-2}GN_{3-5}]$ is reverse complementary or partially reverse complementary with element stem2, and is a consecutive sequence between of 5 to 7 nucleotides;

wherein $N_{0-2}$ is a consecutive sequence of 0 to 2, preferably of 0 to 1, more preferably of 1 N, wherein each N is independently from another selected from a nucleotide selected from A, U, T, G and C or a nucleotide analogue thereof;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof; and wherein G is guanosine or an analogue thereof, and may be optionally replaced by a cytidine or an analogue thereof, provided that its complementary nucleotide cytidine in stem2 is replaced by guanosine;

loop sequence $[N_{0-4}(U/T)N_{0-4}]$ is located between elements stem1 and stem2, and is a consecutive sequence of 3 to 5 nucleotides, more preferably of 4 nucleotides;

wherein each $N_{0-4}$ is independent from another a consecutive sequence of 0 to 4, preferably of 1 to 3, more preferably of 1 to 2 N, wherein each N is independently from another selected from a nucleotide selected from A, U, T, G and C or a nucleotide analogue thereof; and wherein U/T represents uridine, or optionally thymidine;

stem2 $[N_{3-5}CN_{0-2}]$ is reverse complementary or partially reverse complementary with element stem1, and is a consecutive sequence between of 5 to 7 nucleotides;

wherein $N_{3-5}$ is a consecutive sequence of 3 to 5, preferably of 4 to 5, more preferably of 4 N, wherein each N is independently from another selected from a nucleotide selected from A, U, T, G and C or a nucleotide analogue thereof;

wherein $N_{0-2}$ is a consecutive sequence of 0 to 2, preferably of 0 to 1, more preferably of 1 N, wherein each N is independently from another selected from a nucleotide selected from A, U, T, G or C or a nucleotide analogue thereof; and wherein C is cytidine or an analogue thereof, and may be optionally replaced by a guanosine or an analogue thereof provided that its complementary nucleoside guanosine in stem1 is replaced by cytidine;

wherein
stem1 and stem2 are capable of base pairing with each other forming a reverse complementary sequence, wherein base pairing may occur between stem1 and stem2, e.g. by Watson-Crick base pairing of nucleotides A and U/T or G and C or by non-Watson-Crick base pairing e.g. wobble base pairing, reverse Watson-Crick base pairing, Hoogsteen base pairing, reverse Hoogsteen base pairing or are capable of base pairing with each other forming a partially reverse complementary sequence, wherein an incomplete base pairing may occur between stem1 and stem2, on the basis that one ore more bases in one stem do not have a complementary base in the reverse complementary sequence of the other stem.

According to a further preferred embodiment, the RNA according to the invention may comprise at least one histone stem-loop sequence according to at least one of the following specific formulae (Ia) or (IIa):

formula (Ia)
(stem-loop sequence without stem bordering elements):

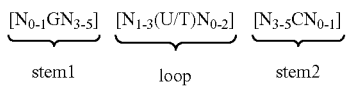

formula (IIa)
(stem-loop sequence with stem bordering elements):

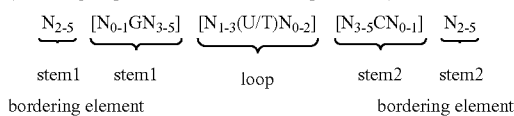

wherein:
N, C, G, T and U are as defined above.

According to a further more particularly preferred embodiment, the RNA according to the invention may comprise at least one histone stem-loop sequence according to at least one of the following specific formulae (Ib) or (IIb):

formula (Ib)
(stem-loop sequence without stem bordering elements):

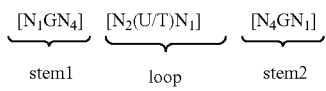

formula (IIb)
(stem-loop sequence with stem bordering elements):

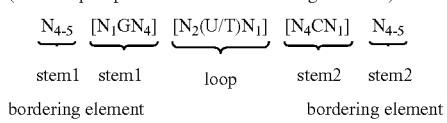

wherein:
N, C, G, T and U are as defined above.

A particular preferred histone stem-loop sequence is the sequence CAAAGGCTCTTTTCAGAGCCACCA (according to SEQ ID NO: 61157) or more preferably the corresponding RNA sequence CAAAGGCUCUUUUCAGAGCCACCA (according to SEQ ID NO: 61158).

According to another particularly preferred embodiment, the RNA according to the invention may additionally or alternatively encode a secretory signal peptide. Such signal peptides are sequences, which typically exhibit a length of about 15 to 30 amino acids and are preferably located at the N-terminus of the encoded peptide, without being limited thereto. Signal peptides as defined herein preferably allow the transport of the antibody or the fragment thereof as encoded by the at least one mRNA of the composition into a defined cellular compartment, preferably the cell surface, the endoplasmic reticulum (ER) or the endosomal-lysosomal compartment. Examples of secretory signal peptide sequences as defined herein include, without being limited thereto, signal sequences of classical or non-classical MHC-molecules (e.g. signal sequences of MHC I and II molecules, e.g. of the MHC class I molecule HLA-A*0201), signal sequences of cytokines or immunoglobulines as defined herein, signal sequences of the invariant chain of immunoglobulines or antibodies as defined herein, signal sequences of Lamp1, Tapasin, Erp57, Calretikulin, Calnexin, and further membrane associated proteins or of proteins associated with the endoplasmic reticulum (ER) or the endosomal-lysosomal compartment. Most preferably, signal sequences of MHC class I molecule HLA-A*0201 may be used according to the present invention. For example, a signal peptide derived from HLA-A is preferably used in order to promote secretion of the encoded antibody as defined herein or a fragment or variant thereof. More preferably, an HLA-A signal peptide is fused to an encoded antibody as defined herein or to a fragment or variant thereof.

Any of the above modifications may be applied to the RNA of the present invention, and further to any RNA as used in the context of the present invention and may be, if suitable or necessary, be combined with each other in any combination, provided, these combinations of modifications do not interfere with each other in the respective at least one mRNA. A person skilled in the art will be able to take his choice accordingly.

The RNA, preferably an mRNA, according to the invention, which comprises at least one coding sequence as defined herein, may preferably comprise a 5' UTR and/or a 3' UTR preferably containing at least one histone stem-loop. Where, in addition to the antibody as defined herein or a fragment or variant thereof, a further peptide or protein is encoded by the at least one coding sequence of the RNA according to the invention, the encoded peptide or protein is preferably no histone protein, no reporter protein and/or no marker or selection protein, as defined herein. The 3' UTR of the RNA according to the invention preferably comprises also a poly(A) and/or a poly(C) sequence as defined herein. The single elements of the 3' UTR may occur therein in any order from 5' to 3' along the sequence of the RNA of the present invention. In addition, further elements as described herein, may also be contained, such as a stabilizing sequence as defined herein (e.g. derived from the UTR of a globin gene), IRES sequences, etc. Each of the elements may also be repeated in the RNA according to the invention at least once (particularly in di- or multicistronic constructs), preferably twice or more. As an example, the single elements may be present in the RNA according to the invention in the following order:

5'—coding region—histone stem-loop—poly(A)/(C) sequence—3'; or

5'—coding region—poly(A)/(C) sequence—histone stem-loop—3'; or

5'—coding region—histone stem-loop—polyadenylation signal—3'; or

5'—coding region—polyadenylation signal—histone stem-loop—3'; or

5'—coding region—histone stem-loop—histone stem-loop—poly(A)/(C) sequence—3'; or 5'—coding region—histone stem-loop—histone stem-loop—polyadenylation signal—3'; or 5'—coding region—stabilizing sequence—poly(A)/(C) sequence—histone stem-loop—3'; or 5'—coding region—stabilizing sequence—poly(A)/(C) sequence—poly(A)/(C) sequence—histone stem-loop—3'; etc.

According to a further embodiment, the RNA, preferably an mRNA, of the present invention preferably comprises at least one of the following structural elements: a 5'- and/or 3'-untranslated region element (UTR element), particularly a 5'-UTR element, which preferably comprises or consists of a nucleic acid sequence which is derived from the 5'-UTR of a TOP gene or from a fragment, homolog or a variant thereof, or a 5'- and/or 3'-UTR element which may preferably be derivable from a gene that provides a stable mRNA or from a homolog, fragment or variant thereof; a histone-stem-loop structure, preferably a histone-stem-loop in its 3' untranslated region; a 5'-cap structure; a poly-A tail; or a poly(C) sequence.

According to some embodiments, it is particularly preferred that—if, in addition to an antibody as defined herein or a fragment or variant thereof, a further peptide or protein is encoded by the at least one coding sequence as defined herein—the encoded peptide or protein is preferably no histone protein, no reporter protein (e.g. Luciferase, GFP, EGFP, β-Galactosidase, particularly EGFP) and/or no marker or selection protein (e.g. alpha-Globin, Galactokinase and Xanthine:Guanine phosphoribosyl transferase (GPT)). In a preferred embodiment, the RNA according to the invention does not comprise a reporter gene or a marker gene. Preferably, the RNA according to the invention does not encode, for instance, luciferase; green fluorescent protein (GFP) and its variants (such as eGFP, RFP or BFP); α-globin; hypoxanthine-guanine phosphoribosyltransferase (HGPRT); β-galactosidase; galactokinase; alkaline phosphatase; secreted embryonic alkaline phosphatase (SEAP)) or a resistance gene (such as a resistance gene against neomycin, puromycin, hygromycin and zeocin). In a preferred embodiment, the RNA according to the invention does not encode luciferase. In another embodiment, the RNA according to the invention does not encode GFP or a variant thereof.

According to a preferred embodiment, the RNA according to the present invention comprises, preferably in 5' to 3' direction, the following elements:
a) a 5'-CAP structure, preferably m7GpppN,
b) at least one coding sequence comprising or consisting of a nucleic acid sequence selected from the group consisting of SEQ ID NOs: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant thereof, c) a poly(A) tail, preferably consisting of 10 to 200, 10 to 100, 40 to 80 or 50 to 70 adenosine nucleotides, d) a poly(C) tail, preferably consisting of 10 to 200, 10 to 100, 20 to 70, 20 to 60 or 10 to 40 cytosine nucleotides, and e) a histone stem-loop, preferably comprising the RNA sequence according to SEQ ID NO: 61158.

More preferably, the RNA according to the invention comprises, preferably in 5' to 3' direction, the following elements:
a) a 5'-CAP structure, preferably m7GpppN,
b) at least one coding sequence comprising or consisting of a nucleic acid sequence selected from the group consisting of SEQ ID NOs: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant thereof, c) a 3'-UTR element comprising a nucleic acid sequence, which is derived from an α-globin gene, preferably comprising the RNA sequence according to SEQ ID NO: 61150, or a homolog, a fragment or a variant thereof,
d) a poly(A) tail, preferably consisting of 10 to 200, 10 to 100, 40 to 80 or 50 to 70 adenosine nucleotides,
e) a poly(C) tail, preferably consisting of 10 to 200, 10 to 100, 20 to 70, 20 to 60 or 10 to 40 cytosine nucleotides, and
f) a histone stem-loop, preferably comprising the RNA sequence according to SEQ ID NO: 61158.

In a further embodiment, the RNA according to the invention comprises, preferably in 5' to 3' direction, the following elements:
a) a 5'-CAP structure, preferably m7GpppN,
b) a 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 61138, or a homolog, a fragment or a variant thereof,
c) at least one coding sequence comprising or consisting of a nucleic acid sequence selected from the group consisting of SEQ ID NOs: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant thereof,
d) a 3'-UTR element comprising a nucleic acid sequence, which is preferably derived from an α-globin gene, preferably comprising the RNA sequence according to SEQ ID NO: 61150, or a homolog, a fragment or a variant thereof; and/or
a 3'-UTR element comprising a nucleic acid sequence, which is derived from an albumin gene, preferably comprising the RNA sequence according to SEQ ID NO: 61154, or a homolog, a fragment or a variant thereof or the RNA sequence according to SEQ ID NO: 61156, or a homolog, a fragment or a variant thereof,
e) a poly(A) tail, preferably consisting of 10 to 200, 10 to 100, 40 to 80 or 50 to 70 adenosine nucleotides,
f) a poly(C) tail, preferably consisting of 10 to 200, 10 to 100, 20 to 70, 20 to 60 or 10 to 40 cytosine nucleotides, and
g) a histone stem-loop, preferably comprising the RNA sequence according to SEQ ID NO: 61158.

Moreover, it is also preferred that the RNA according to the invention comprises, preferably in 5' to 3' direction, the following elements:
a) a 5'-CAP structure, preferably m7GpppN,
b) a 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 61142, or a homolog, a fragment or a variant thereof,
c) at least one coding sequence comprising or consisting of a nucleic acid sequence selected from the group consisting of SEQ ID NOs: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant thereof,
d) a 3'-UTR element comprising a nucleic acid sequence, which is preferably derived from an α-globin gene, preferably comprising the RNA sequence according to SEQ ID NO: 61150, or a homolog, a fragment or a variant thereof; and/or
a 3'-UTR element comprising a nucleic acid sequence, which is derived from an albumin gene, preferably comprising the RNA sequence according to SEQ ID NO: 61154, or a homolog, a fragment or a variant thereof or the RNA sequence according to SEQ ID NO: 61156, or a homolog, a fragment or a variant thereof,
e) a poly(A) tail, preferably consisting of 10 to 200, 10 to 100, 40 to 80 or 50 to 70 adenosine nucleotides,
f) a poly(C) tail, preferably consisting of 10 to 200, 10 to 100, 20 to 70, 20 to 60 or 10 to 40 cytosine nucleotides, and
g) a histone stem-loop, preferably comprising the RNA sequence according to SEQ ID NO: 61158.

Preferably, the RNA according to the present invention additionally codes a tag for purification chosen from the group consisting of a hexahistidine tag (HIS tag, polyhistidine tag), a streptavidin tag (Strep tag), an SBP tag (streptavidin-binding tag) or a GST (glutathione S-transferase) tag, or codes for a tag for purification via an antibody epitope chosen from the group consisting of antibody-binding tags, a Myc tag, a Swa11 epitope, a FLAG tag or an HA tag.

It is also preferred that the RNA according to the present invention additionally (in addition to the antibody or fragment or variant thereof) encodes a signal peptide and/or a localization sequence, in particular a secretion sequence. Such signal peptides are (signal) sequences which conventionally comprise a length of from 15 to 30 amino acids and are preferably localized on the N-terminus of the coded antibody. Signal peptides typically render possible transport of a protein or peptide fused therewith (here e.g. an antibody) to or into a defined cell compartment, preferably the cell surface, the endoplasmic reticulum or the endosomal-lysosomal compartment. Examples of signal sequences which can be used according to the invention are e.g. signal sequences of conventional and non-conventional MHC molecules, cytokines, immunoglobulins, the invariant chain, Lamp1, tapasin, Erp57, calreticulin and calnexin, and all further membrane-located, endosomally-lysosomally or endoplasmic reticulum-associated proteins. The signal peptide of the human MHC class I molecule HLA-A*0201 is preferably used.

Sequences which render possible transport of a protein or peptide fused therewith (here e.g. an antibody) to or into a defined cell compartment, preferably the cell surface, the nucleus, the nucleus region, the plasma membrane, the cytosol, the endoplasmic reticulum, the organelles, the mitochondria, the Golgi apparatus or the endosomal-lysosomal compartment, also include, without being limited thereto, so-called routing signals, sorting signals, retention signals or salvage signals and membrane topology-stop transfer signals (cf. Pugsley, A. P., Protein Targeting, Academic Press, Inc. (1989)) at the level of the RNA according to the invention. In this connection, localization sequences include nucleic acid sequences which encode e.g. signals, i.e. amino acid sequences, such as, for example, KDEL (SEQ ID NO: 61176) (Munro, et al., Cell 48:899-907 (1987)) DDEL (SEQ ID NO: 61177), DEEL (SEQ ID NO: 61178), QEDL (SEQ ID NO: 61179) and RDEL (SEQ ID NO: 61180) (Hangejorden, et al., J. Biol. Chem. 266:6015 (1991)) for the endoplasmic reticulum; PKKKRKV (SEQ ID NO: 61181) (Lanford, et al. Cell 46:575 (1986)) PQKKIKS (SEQ ID NO: 61182) (Stanton, L. W., et al., Proc. Natl. Acad. Sci USA 83:1772 (1986); QPKKP (SEQ ID NO: 61183) (Harlow, et al., Mol. Cell Biol. 5:1605 1985), and RKKR (SEQ ID NO: 61184) for the nucleus; and RKKRRQRRRAHQ (SEQ ID NO: 61185) (Seomi, et al., J. Virology 64:1803 (1990)), RQARRNRRRRWRERQR (SEQ ID NO: 61186) (Kubota, et al., Biochem. and Biophy, Res. Comm. 162:963 (1989)), and MPLTRRRPAASQALAPPTP (SEQ ID NO: 61187) (Siomi, et al., Cell 55:197 (1988)) for the nucleus region; MDDQRDLISNNEQLP (SEQ ID NO: 61188) (Bakke, et al., Cell 63:707-716 (1990)) for the endosomal compartment (see, for example, Letourneur, et al., Cell 69:1183 (1992) for the targeting of liposomes). Myristoylation sequences can furthermore be used in order to lead the expressed protein or peptide (here e.g. an antibody) to the plasma membrane, or to certain various sub-cell compartments, such as the nucleus region, the organelles, the mitochondria and the Golgi apparatus. Corresponding amino acid sequences which are coded by a corresponding codon sequence of the RNA according to the invention are given below. The sequence MLFNLRXXLNNAAF-RHGHNFMVRNFRCGQPLX (SEQ ID NO: 61189) can be used to lead the antibody to the mitochondrial matrix (Pugsley, supra). See Tang, et al., J. Bio. Chem. 207:10122, in respect of the localization of proteins (antibodies) to the Golgi apparatus; for the localization of proteins to the plasma membrane: GCVCSSNP (SEQ ID NO: 61190), GQTVTTPL (SEQ ID NO: 61191), GQELSQHE (SEQ ID NO: 61192), GNSPSYNP (SEQ ID NO: 61193), GVSG-SKGQ (SEQ ID NO: 61194), GQTITTPL (SEQ ID NO: 61195), GQTLTTPL (SEQ ID NO: 61196), GQIFSRSA (SEQ ID NO: 61197), GQIHGLSP (SEQ ID NO: 61198), GARASVLS (SEQ ID NO: 61199), and GCTLSAEE (SEQ ID NO: 61200); to the endoplasmic reticulum GQNLSTSN (SEQ ID NO: 61201); to the nucleus GAALTILV (SEQ ID NO: 61202) and GAALTLLG (SEQ ID NO: 61203); to the endoplasmic reticulum and to the cytoplasm GAQVSSQK (SEQ ID NO: 61204) and GAQLSRNT (SEQ ID NO: 61205); to the Golgi apparatus, to the nucleus, to the cytoplasm and to the cytoskeleton: GNAAAAKK (SEQ ID NO: 61206); to the cytoplasm and to the cytoskeleton GNEASYPL (SEQ ID NO: 61207); and to the plasma membrane and to the cytoskeleton GSSKSKPK (SEQ ID NO: 61208). Such sequences as described above are preferably used for RNAs which code for intrabodies, i.e antibodies which are retained in the cell and are not secreted. Thus, the localization sequence is preferably chosen from one of the sequences according to SEQ ID NO: 61176 to 61208.

It is also preferred that the RNA according to the present invention comprises a nucleic acid sequence selected from the group consisting of nucleic acid sequences according to SEQ ID NOs: 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, 61734.

The RNA according to the present invention may be prepared using any method known in the art, including synthetic methods such as e.g. solid phase RNA synthesis, as well as in vitro methods, such as RNA in vitro transcription reactions.

Combination of at least Two Distinct RNA's

In a further aspect the present invention provides a combination of at least two distinct RNA's as described above, preferably for use in medicine. As used herein, the term "RNA's" refers in particular to "RNA species" (with one RNA species typically referring to one or more identical RNA molecules). Accordingly, the terms "RNA's" and "RNA species" may be used interchangeably. The term "distinct" refers in particular to the coding sequence of the RNA. In other words, the at least two distinct RNA's differ in particular in their coding sequences. Accordingly, the at least two distinct RNA's may relate to (encode) the same or different antibodies. For example, the at least two distinct RNA's may encode two distinct antibodies or fragments or variants thereof as described herein.

However, it is preferred that the at least two distinct RNA's encode different fragments of the same antibody. In other words, an antibody (or a fragment or variant thereof as described herein) may be encoded (i) by one single RNA as described above or (ii) by at least two distinct RNA's, wherein each of the distinct RNA's preferably encodes a distinct fragment of the antibody. More preferably, one RNA of the at least two distinct RNA's encodes a heavy chain variable region of an antibody or a fragment thereof and another RNA of the at least two distinct RNA's encodes the corresponding light chain variable region of the antibody or the fragment thereof. Even more preferably, one RNA of the at least two distinct RNA's encodes a heavy chain of an antibody and another RNA of the at least two distinct RNA's encodes the corresponding light chain of the antibody. Thereby, the term "corresponding" means that heavy and light chain (or heavy chain variable region and light chain variable region) are from the same antibody (or from the same fragment or variant thereof). Accordingly, it is preferred that (i) the RNA according to the present invention as described above or (ii) the combination of the at least two distinct RNA's according to the present invention as a whole encodes a functional antibody (or a functional fragment or variant thereof) as described herein. In other words, an antibody (or a fragment or variant thereof), which is expressed by use of (i) the RNA according to the present invention as described above or (ii) the combination of the at least two distinct RNA's according to the present invention as a whole, is preferably a functional antibody (or a functional fragment or variant thereof) as described herein.

Preferably, in such a combination of at least two distinct RNA's the RNA encoding the complete heavy chain, the heavy chain variable region, or a fragment thereof, and the RNA encoding the complete light chain, the light chain variable region, or a fragment thereof comprise identical 3'UTR elements and/or identical 5'UTR elements. Preferred 3'UTR elements, 5'UTR elements and other structural features are the same as described above for the RNA according to the present invention.

Particularly preferably, in a combination for use according to the present invention the distinct RNA's, in particular the RNA encoding the complete heavy chain, the heavy chain variable region, or a fragment thereof, and the RNA encoding the complete light chain, the light chain variable region, or a fragment thereof may comprise, preferably in 5' to 3' direction, the following elements:
  a) an identical 5'-CAP structure, preferably m7GpppN;
  b) an identical 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 61138, or a homolog, a fragment or a variant thereof;
  c) at least one coding sequence, which is distinct for the at least two distinct RNA's comprised by the combination for use according to the present invention;
  d) an identical 3'-UTR element comprising a nucleic acid sequence, which is preferably derived from an α-globin gene, preferably comprising the RNA sequence according to SEQ ID NO: 61150, or a homolog, a fragment or a variant thereof; and/or
    an identical 3'-UTR element comprising a nucleic acid sequence, which is preferably derived from an albumin gene, preferably comprising the RNA sequence according to SEQ ID NO: 61154, or a homolog, a fragment or a variant thereof or the RNA sequence according to SEQ ID NO: 61156, or a homolog, a fragment or a variant thereof;
  e) an identical poly(A) tail, preferably consisting of 10 to 200, 10 to 100, 40 to 80 or 50 to 70 adenosine nucleotides;
  f) an identical poly(C) tail, preferably consisting of 10 to 200, 10 to 100, 20 to 70, 20 to 60 or 10 to 40 cytosine nucleotides; and/or
  g) an identical histone stem-loop, preferably comprising the RNA sequence according to SEQ ID NO: 61158.

Most preferably, in a combination for use according to the present invention the distinct RNA's, in particular the RNA encoding the complete heavy chain, the heavy chain variable region, or a fragment thereof, and the RNA encoding the complete light chain, the light chain variable region, or a fragment thereof may comprise, preferably in 5' to 3' direction, the following elements:
  a) an identical 5'-CAP structure, preferably m7GpppN;
  b) an identical 5'-UTR element, which preferably comprises or consists of a nucleic acid sequence, which is derived from the 5'-UTR of a TOP gene, preferably comprising an RNA sequence corresponding to the nucleic acid sequence according to SEQ ID NO: 61142, or a homolog, a fragment or a variant thereof;
  c) at least one coding sequence, which is distinct for the at least two distinct RNA's comprised by the combination for use according to the present invention; d) an identical 3'-UTR element comprising a nucleic acid sequence, which is preferably derived from an α-globin gene, preferably comprising the RNA sequence according to SEQ ID NO: 61150, or a homolog, a fragment or a variant thereof; and/or
    an identical 3'-UTR element comprising a nucleic acid sequence, which is preferably derived from an albumin gene, preferably comprising the RNA sequence according to SEQ ID NO: 61154, or a homolog, a fragment or a variant thereof or the RNA sequence according to SEQ ID NO: 61156, or a homolog, a fragment or a variant thereof;
  e) an identical poly(A) tail, preferably consisting of 10 to 200, 10 to 100, 40 to 80 or 50 to 70 adenosine nucleotides;
  f) an identical poly(C) tail, preferably consisting of 10 to 200, 10 to 100, 20 to 70, 20 to 60 or 10 to 40 cytosine nucleotides; and/or
  g) an identical histone stem-loop, preferably comprising the RNA sequence according to SEQ ID NO: 61158.

Thereby, an optimal stoichiometric ratio of the amino acid sequences encoded by the at least two RNA's can be achieved, which in turn results in optimal antibody formation.

In the combination of the at least to distinct RNA's as described herein for use according to the present invention, the at least to distinct RNA's as described herein may be administered separately or in the same composition.

In the combination of the at least to distinct RNA's as described herein for use according to the present invention, the at least to distinct RNA's as described herein are preferably administered at about the same time.

"At about the same time", as used herein, means in particular simultaneous administration or that directly after administration of one RNA the other RNA is administered. The skilled person understands that "directly after" includes the time necessary to prepare the second administration—in particular the time necessary for exposing and disinfecting the location for the second administration as well as appropriate preparation of the "administration device" (e.g., syringe, pump, etc.). The term "simultaneous administration" as used herein also includes if the periods of administration of the at least two distinct RNA's overlap or if, for example, one RNA is administered over a longer period of time, such as 30 min, 1 h, 2 h or even more, e.g. by infusion, and the other RNA is administered at some time during such a long period.

Alternatively, the at least two RNA's may be administered consecutively. However, it is preferred that the at least two distinct RNA's are administered at the same day with the time between administration of the first RNA and administration of the second RNA being preferably no more than 6 hours, more preferably no more than 3 hours, even more preferably no more than 2 hours and most preferably no more than 1 h.

Preferably, the at least two distinct RNA's are administered in a therapeutically effective amount. A "therapeutically effective amount", as used herein, is the amount which is sufficient for the alleviation of the symptoms of the disease or condition being treated and/or for prophylaxis of the symptoms of the disease or condition being prevented. In other words, a "therapeutically effective amount" means an amount of the at least two distinct RNA's that is sufficient to significantly induce a positive modification of a disease or disorder, i.e. an amount of the at least two distinct RNA's, that elicits the biological or medicinal response in a tissue, system, animal or human that is being sought. The term also includes the amount of the at least two distinct RNA's sufficient to reduce the progression of the disease, e.g., to notably reduce or inhibit the tumor growth or infection and thereby elicit the response being sought, in particular such response could be an immune response involving the antibodies or antibody fragments encoded by the RNA according to the invention. At the same time, however, a "therapeutically effective amount" is preferably small enough to avoid serious side-effects, that is to say to permit a sensible relationship between advantage and risk. The determination of these limits typically lies within the scope of sensible medical judgment. A "therapeutically effective amount" of the at least two distinct RNA's will furthermore vary in connection with the particular condition to be treated and also with the age and physical condition of the patient to be treated, the body weight, general health, sex, diet, time of administration, rate of excretion, drug combination, the activity of the at least two distinct RNA's, the severity of the condition, the duration of the treatment, the nature of the accompanying therapy, of the particular pharmaceutically acceptable carrier used, and similar factors, within the knowledge and experience of the accompanying doctor.

In the combination of the at least to distinct RNA's as described herein for use according to the present invention, the at least to distinct RNA's as described herein may be administered via the same or different routes of administration. Preferably, the at least two distinct RNA's are administered via the same route of administration. Preferred routes of administration are described below, in the context of the (pharmaceutical) composition. Those preferred routes of administration apply accordingly for the combination for use according to the present invention.

In the combination of the at least to distinct RNA's as described herein for use according to the present invention, the at least to distinct RNA's as described herein may be provided in the same or in distinct compositions. Preferably, the at least to distinct RNA's as described herein are provided in the same composition. Compositions comprising the RNA according to the present invention are described in detail in the following.

The combination of at least two distinct RNA's is preferably used for the treatment (prevention and/or therapy) of a variety of diseases as described below (in the context of the use of the RNA and the composition according to the invention and in the context of the treatment method) in more detail. Those details and preferred embodiments apply accordingly for the combination for use according to the present invention.

Composition comprising the RNA according to the Present Invention

In a further aspect, the present invention provides a composition comprising the RNA comprising at least one coding sequence as described herein and a pharmaceutically acceptable carrier. The composition according to the invention is preferably provided as a pharmaceutical composition or as a (passive) vaccine. As used herein, the term "passive vaccine" refers to a vaccine for use in passive immunization.

According to a preferred embodiment, the (pharmaceutical) composition or the (passive) vaccine according to the invention comprises the RNA of the present invention, wherein the at least one coding sequence of the RNA comprises or consists of a nucleic acid sequence encoding an antibody, or a fragment or variant of an antibody, wherein the antibody preferably comprises or consists of an amino acid sequence selected from the group consisting of SEQ ID NO: 1-7642, 61212-61214, 61236-61238, 61245-61247, 61269-61271, 61279-61281, 61303-61305, 61312, 61320, 61324, 61332, 61338, 61346, 61349, 61357, 61362, 61370, 61373, 61381, 61384, 61385, 61400, 61401, 61418, 61426, 61429, 61437, 61440, 61441, 61456, 61457, 61469, 61470, 61475, 61476, 61481, 61482, 61487, 61488, 61493, 61494, 61499, 61500, 61515, 61516, 61521, 61522, 61537, 61538, 61543, 61544, 61559, 61560, 61565, 61573, 61576, 61584, 61587, 61588, 61603, 61606, 61609, 61612, 61618, 61619, 61634, 61635, 61639, 61640, 61644, 61645, 61660, 61661, 61667, 61675, 61678, 61686, 61689, 61697, 61700, 61708, 61711, 61719, 61722, and 61730; or a fragment or variant of any one of said amino acid sequences.

Preferably, the (pharmaceutical) composition or the (passive) vaccine according to the invention comprises the RNA of the present invention, wherein the at least one coding sequence of the RNA comprises or consists of a nucleic acid sequence encoding an antibody, or a fragment or variant of an antibody, wherein the antibody preferably comprises or consists of an amino acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with an amino acid sequence selected from the group consisting of SEQ ID NO: 1-7642, 61212-61214, 61236-61238, 61245-61247, 61269-61271, 61279-61281, 61303-61305, 61312, 61320, 61324, 61332, 61338, 61346, 61349, 61357, 61362, 61370, 61373, 61381, 61384, 61385, 61400, 61401, 61418, 61426, 61429, 61437, 61440, 61441, 61456, 61457, 61469, 61470, 61475, 61476, 61481, 61482, 61487, 61488, 61493, 61494, 61499, 61500, 61515, 61516, 61521, 61522, 61537, 61538, 61543, 61544, 61559, 61560, 61565, 61573, 61576, 61584, 61587, 61588, 61603, 61606, 61609, 61612, 61618, 61619, 61634, 61635, 61639, 61640, 61644, 61645, 61660, 61661, 61667, 61675, 61678, 61686, 61689, 61697, 61700, 61708, 61711, 61719, 61722, and 61730; or a fragment or variant of any one of said amino acid sequences.

More preferably, the (pharmaceutical) composition or the (passive) vaccine according to the invention comprises the RNA of the present invention, wherein the at least one coding sequence of the RNA comprises or consists of a nucleic acid sequence encoding an antibody, or a fragment or variant of an antibody, wherein the antibody preferably comprises or consists of an amino acid sequence having a sequence identity of at least 80% with an amino acid sequence selected from the group consisting of SEQ ID NO: 1-7642, 61212-61214, 61236-61238, 61245-61247, 61269-61271, 61279-61281, 61303-61305, 61312, 61320, 61324, 61332, 61338, 61346, 61349, 61357, 61362, 61370, 61373, 61381, 61384, 61385, 61400, 61401, 61418, 61426, 61429, 61437, 61440, 61441, 61456, 61457, 61469, 61470, 61475, 61476, 61481, 61482, 61487, 61488, 61493, 61494, 61499, 61500, 61515, 61516, 61521, 61522, 61537, 61538, 61543, 61544, 61559, 61560, 61565, 61573, 61576, 61584, 61587, 61588, 61603, 61606, 61609, 61612, 61618, 61619, 61634, 61635, 61639, 61640, 61644, 61645, 61660, 61661, 61667, 61675, 61678, 61686, 61689, 61697, 61700, 61708, 61711, 61719, 61722, and 61730; or a fragment or variant of any one of said amino acid sequences.

In preferred embodiments, the (pharmaceutical) composition or the (passive) vaccine according to the invention comprises the RNA of the present invention, wherein the at least one coding sequence of the RNA comprises or consists of a nucleic acid sequence selected from the group consisting of SEQ ID NO: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant of any of said nucleic acid sequences.

According to another embodiment, the (pharmaceutical) composition or the (passive) vaccine according to the invention comprises the RNA of the present invention, wherein the at least one coding sequence of the RNA comprises or consists of a nucleic acid sequence having a sequence identity of at least 5%, 10%, 20%, 30%, 40%, 50%, 60%, 70%, 80%, 85%, 86%, 87%, 88%, 89%, 90%, 91%, 92%, 93%, 94%, 95%, 96%, 97%, 98%, or 99%, preferably of at least 70%, more preferably of at least 80%, even more preferably at least 85%, even more preferably of at least 90% and most preferably of at least 95% or even 97%, with a nucleic acid sequence selected from the group consisting of SEQ ID NO: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant of any one of said nucleic acid sequences.

According to a particularly preferred embodiment, the (pharmaceutical) composition or the (passive) vaccine according to the invention comprises the RNA of the present invention, wherein the at least one coding sequence of the RNA comprises or consists of a nucleic acid sequence having a sequence identity of at least 80% with a nucleic acid sequence selected from the group consisting of SEQ ID NO: 7643-61136, 61161-61175, 61209-61211, 61215-61235, 61239-61242, 61248-61268, 61272-61275, 61282-61302, 61306-61309, 61313-61319, 61321, 61325-61331, 61333, 61336, 61339-61345, 61347, 61350-61356, 61358, 61360, 61363-61369, 61371, 61374-61380, 61382, 61386-61399, 61402-61404, 61416, 61419-61425, 61427, 61430-61436, 61438, 61442-61455, 61458, 61459, 61464, 61467, 61471-61473, 61477-61479, 61483-61485, 61489-61491, 61495-61497, 61501-61514, 61517-61519, 61523-61536, 61539-61541, 61545-61558, 61561-61563, 61566-61572, 61574, 61577-61583, 61585, 61589-61602, 61604, 61607, 61610, 61613, 61615, 61620-61633, 61636, 61637, 61641, 61642, 61646-61659, 61662-61664, 61668-61674, 61676, 61679-61685, 61687, 61690-61696, 61698, 61701-61707, 61709, 61712-61718, 61720, 61723-61729, 61731, 61733, 61243, 61244, 61276, 61277, 61278, 61310, 61311, 61322, 61323, 61334, 61335, 61337, 61348, 61359, 61361, 61372, 61383, 61404, 61405, 61406, 61407, 61410, 61411, 61414, 61415, 61416, 61417, 61428, 61439, 61460, 61461, 61462, 61463, 61465, 61466, 61467, 61468, 61473, 61474, 61479, 61480, 61485, 61486, 61491, 61492, 61497, 61498, 61520, 61542, 61564, 61575, 61586, 61603, 61604, 61605, 61606, 61607, 61608, 61609, 61610, 61611, 61612, 61613, 61614, 61615, 61616, 61617, 61638, 61643, 61665, 61666, 61677, 61688, 61699, 61710, 61721, 61732, 61733, and 61734; or a fragment or variant of any one of said nucleic acid sequences.

In the context of the present invention, the RNA comprised by the (pharmaceutical) composition or the (passive) vaccine may encode one or more of the antibodies defined herein or a fragment or variant thereof.

The (pharmaceutical) composition or (passive) vaccine according to the invention may thus comprise the RNA of the present invention, wherein the RNA encodes one specific antibody of the antibodies defined herein or a fragment or a variant thereof. In that embodiment, the (pharmaceutical) composition or (passive) vaccine preferably comprises the RNA according to the invention comprising the at least one coding sequence as described herein encoding the antibody or a fragment or variant thereof.

Alternatively, the (pharmaceutical) composition or (passive) vaccine of the present invention may comprise at least one RNA according to the invention, wherein the at least one RNA encodes at least two, three, four, five, six, seven, eight, nine, ten, eleven or twelve distinct antibodies as defined herein or a fragment or variant thereof. Preferably, the (pharmaceutical) composition or the (passive) vaccine comprises several classes of the RNA according to the invention, wherein each RNA species encodes one of the antibodies or a fragment or variant thereof. In another embodiment, the RNA comprised in the (pharmaceutical) composition or (passive) vaccine is a bi- or multicistronic RNA as defined herein, which encodes the at least two, three, four, five, six, seven, eight, nine, ten, eleven or twelve distinct antibodies or fragments or variants thereof. Mixtures between these embodiments are also envisaged, such as compositions comprising more than one RNA species, wherein at least one RNA species may be monocistronic, while at least one other RNA species may be bi- or multicistronic.

The RNA according to the present invention as described above, in particular the RNA comprised in the (pharmaceutical) composition or the (passive) vaccine according to the present invention, may thus comprise any combination of the nucleic acid sequences as defined herein.

In a particularly preferred embodiment, the composition according to the present invention comprises at least two distinct RNA's according to the present inventions. Thereby, the details of the at least two distinct RNA's according to the present inventions as described above, in the context of the combination for use according to the present invention, apply accordingly for the at least two distinct RNA's comprised in the composition according to the present invention. Accordingly, it is preferred that one RNA of the at least two distinct RNA's encodes a heavy chain variable region of an antibody or a fragment thereof and another RNA of the at least two distinct RNA's encodes the corresponding light chain variable region of the antibody or the fragment thereof. More preferably, one RNA of the at least two distinct RNA's encodes a heavy chain of an antibody and another RNA of the at least two distinct RNA's encodes the corresponding light chain of the antibody. It is also preferred that the RNA encoding the heavy chain variable region or a fragment thereof and the RNA encoding the light chain variable region or a fragment thereof comprise identical 5'UTR elements and/or identical 3'UTR elements and/or identical further elements as described above, in the context of the combination for use according to the present invention.

In a preferred embodiment of the composition according to the invention, the RNA is complexed with one or more cationic or polycationic compounds, preferably with cationic or polycationic polymers, cationic or polycationic peptides or proteins, e.g. protamine, cationic or polycationic polysaccharides and/or cationic or polycationic lipids.

According to a preferred embodiment, the RNA of the composition according to the present invention may be complexed with lipids to form one or more liposomes, lipoplexes, or lipid nanoparticles. Therefore, in one embodiment, the inventive composition comprises liposomes, lipoplexes, and/or lipid nanoparticles comprising the at least one mRNA.

Lipid-based formulations have been increasingly recognized as one of the most promising delivery systems for RNA due to their biocompatibility and their ease of large-scale production. Cationic lipids have been widely studied as synthetic materials for delivery of RNA. After mixing together, nucleic acids are condensed by cationic lipids to form lipid/nucleic acid complexes known as lipoplexes. These lipid complexes are able to protect genetic material from the action of nucleases and deliver it into cells by interacting with the negatively charged cell membrane.

Lipoplexes can be prepared by directly mixing positively charged lipids at physiological pH with negatively charged nucleic acids.

Conventional liposomes consist of a lipid bilayer that can be composed of cationic, anionic, or neutral (phospho)lipids and cholesterol, which encloses an aqueous core. Both the lipid bilayer and the aqueous space can incorporate hydrophobic or hydrophilic compounds, respectively. Liposome characteristics and behaviour in vivo can be modified by addition of a hydrophilic polymer coating, e.g. polyethylene glycol (PEG), to the liposome surface to confer steric stabilization. Furthermore, liposomes can be used for specific targeting by attaching ligands (e.g., antibodies, peptides, and carbohydrates) to its surface or to the terminal end of the attached PEG chains (Front Pharmacol. 2015 Dec. 1; 6:286).

Liposomes are colloidal lipid-based and surfactant-based delivery systems composed of a phospholipid bilayer surrounding an aqueous compartment. They may present as spherical vesicles and can range in size from 20 nm to a few microns. Cationic lipid-based liposomes are able to complex with negatively charged nucleic acids via electrostatic interactions, resulting in complexes that offer biocompatibility, low toxicity, and the possibility of the large-scale production required for in vivo clinical applications. Liposomes can fuse with the plasma membrane for uptake; once inside the cell, the liposomes are processed via the endocytic pathway and the genetic material is then released from the endosome/carrier into the cytoplasm. Liposomes have long been perceived as drug delivery vehicles because of their superior biocompatibility, given that liposomes are basically analogs of biological membranes, and can be prepared from both natural and synthetic phospholipids (Int J Nanomedicine. 2014; 9: 1833-1843).

Cationic liposomes have been traditionally the most commonly used non-viral delivery systems for oligonucleotides, including plasmid DNA, antisense oligos, and siRNA/small hairpin RNA-shRNA). Cationic lipids, such as DOTAP, (1,2-dioleoyl-3-trimethylammonium-propane) and DOTMA (N-[1-(2,3-dioleoyloxy)propyl]-N,N,N-trimethyl-ammonium methyl sulfate) can form complexes or lipoplexes with negatively charged nucleic acids to form nanoparticles by electrostatic interaction, providing high in vitro transfection efficiency. Furthermore, neutral lipid-based nanoliposomes for RNA delivery as e.g. neutral 1,2-dioleoyl-sn-glycero-3-phosphatidylcholine (DOPC)-based nanoliposomes were developed. (Adv Drug Deliv Rev. 2014 February; 66: 110-116.).

Therefore, in one embodiment the RNA of the composition according to the present invention is complexed with cationic lipids and/or neutral lipids and thereby forms liposomes, lipid nanoparticles, lipoplexes or neutral lipid-based nanoliposomes.

In a preferred embodiment, the composition according to the invention comprises the RNA according to the invention that is formulated together with a cationic or polycationic compound and/or with a polymeric carrier. Accordingly, in a further embodiment of the invention, it is preferred that the RNA as defined herein or any other nucleic acid comprised in the inventive (pharmaceutical) composition or (passive) vaccine is associated with or complexed with a cationic or polycationic compound or a polymeric carrier, optionally in a weight ratio selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w) of mRNA or nucleic acid to cationic or polycationic compound and/or with a polymeric carrier; or optionally in a nitrogen/phosphate (N/P) ratio of mRNA or nucleic acid to cationic or polycationic compound and/or polymeric carrier in the range of about 0.1-10, preferably in a range of about 0.3-4 or 0.3-1, and most preferably in a range of about 0.5-1 or 0.7-1, and even most preferably in a range of about 0.3-0.9 or 0.5-0.9. More preferably, the N/P ratio of the at least one mRNA to the one or more polycations is in the range of about 0.1 to 10, including a range of about 0.3 to 4, of about 0.5 to 2, of about 0.7 to 2 and of about 0.7 to 1.5.

Therein, the RNA as defined herein or any other nucleic acid comprised in the (pharmaceutical) composition or (passive) vaccine according to the invention can also be associated with a vehicle, transfection or complexation agent for increasing the transfection efficiency and/or the immunostimulatory properties of the RNA according to the invention or of optionally comprised further included nucleic acids.

Cationic or polycationic compounds, being particularly preferred agents in this context include protamine, nucleoline, spermine or spermidine, or other cationic peptides or proteins, such as poly-L-lysine (PLL), poly-arginine, basic polypeptides, cell penetrating peptides (CPPs), including HIV-binding peptides, HIV-1 Tat (HIV), Tat-derived peptides, Penetratin, VP22 derived or analog peptides, HSV VP22 (Herpes simplex), MAP, KALA or protein transduction domains (PTDs), PpT620, prolin-rich peptides, arginine-rich peptides, lysine-rich peptides, MPG-peptide(s), Pep-1, L-oligomers, Calcitonin peptide(s), Antennapedia-derived peptides (particularly from *Drosophila antennapedia*), pAntp, plsl, FGF, Lactoferrin, Transportan, Buforin-2, Bac715-24, SynB, SynB(1), pVEC, hCT-derived peptides, SAP, or histones. More preferably, the RNA according to the invention is complexed with one or more polycations, preferably with protamine or oligofectamine, most preferably with protamine. In this context protamine is particularly preferred.

Additionally, preferred cationic or polycationic proteins or peptides may be selected from the following proteins or peptides having the following total formula (III):

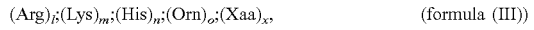

$(Arg)_l;(Lys)_m;(His)_n;(Orn)_o;(Xaa)_x,$ (formula (III))

wherein l+m+n+o+x=8-15, and l, m, n or o independently of each other may be any number selected from 0, 1, 2, 3, 4, 5, 6, 7, 8, 9, 10, 11, 12, 13, 14 or 15, provided that the overall content of Arg, Lys, His and Orn represents at least 50% of all amino acids of the oligopeptide; and Xaa may be any amino acid selected from native (=naturally occurring) or non-native amino acids except of Arg, Lys, His or Orn; and x may be any number selected from 0, 1, 2, 3 or 4, provided, that the overall content of Xaa does not exceed 50% of all amino acids of the oligopeptide. Particularly preferred cationic peptides in this context are e.g. $Arg_7$, $Arg_8$, $Arg_9$, $H_3R_9$, $R_9H_3$, $H_3R_9H_3$, $YSSR_9SSY$, $(RKH)_4$, $Y(RKH)_2R$, etc. In this context the disclosure of WO 2009/030481 is incorporated herewith by reference.

Further preferred cationic or polycationic compounds, which can be used as transfection or complexation agent may include cationic polysaccharides, for example chitosan, polybrene, cationic polymers, e.g. polyethyleneimine (PEI), cationic lipids, e.g. DOTMA: [1-(2,3-sioleyloxy)propyl)]-N,N,N-trimethylammonium chloride, DMRIE, di-C14-amidine, DOTIM, SAINT, DC-Chol, BGTC, CTAP, DOPC, DODAP, DOPE: Dioleyl phosphatidylethanol-amine, DOSPA, DODAB, DOIC, DMEPC, DOGS: Dioctadecylamidoglicylspermin, DIMRI: Dimyristo-oxypropyl dimethyl hydroxyethyl ammonium bromide, DOTAP: dioleoyloxy-3-(trimethylammonio)propane, DC-6-14: O,O-ditetradecanoyl-N-(α-trimethylammonioacetyl) diethanolamine chloride, CLIP1: rac-[(2,3-dioctadecyloxypropyl)(2-hydroxyethyl)]-dimethylammonium chloride, CLIP6: rac-[2(2,3-dihexadecyloxypropyl-oxymethyloxy)ethyl] trimethylammonium, CLIP9: rac-[2(2,3-dihexadecyloxypropyl-oxysuccinyloxy)ethyl]-trimethylammonium, oligofectamine, or cationic or polycationic polymers, e.g. modified polyaminoacids, such as β-aminoacid-polymers or reversed polyamides, etc., modified polyethylenes, such as PVP (poly(N-ethyl-4-vinylpyridinium bromide)), etc., modified acrylates, such as pDMAEMA (poly(dimethylaminoethyl methylacrylate)), etc., modified amidoamines such as pAMAM (poly(amidoamine)), etc., modified polybetaaminoester (PBAE), such as diamine end modified 1,4 butanediol diacrylate-co-5-amino-1-pentanol polymers, etc., dendrimers, such as polypropylamine dendrimers or pAMAM based dendrimers, etc., polyimine(s), such as PEI: poly(ethyleneimine), poly(propyleneimine), etc., polyallylamine, sugar backbone based polymers, such as cyclodextrin based polymers, dextran based polymers, chitosan, etc., silan backbone based polymers, such as PMOXA-PDMS copolymers, etc., blockpolymers consisting of a combination of one or more cationic blocks (e.g. selected from a cationic polymer as mentioned above) and of one or more hydrophilic or hydrophobic blocks (e.g. polyethyleneglycole); etc.

According to a preferred embodiment, the composition of the present invention comprises the RNA as defined herein and a polymeric carrier. A polymeric carrier used according to the invention might be a polymeric carrier formed by disulfide-crosslinked cationic components. The disulfide-crosslinked cationic components may be the same or different from each other. The polymeric carrier can also contain further components. It is also particularly preferred that the polymeric carrier used according to the present invention comprises mixtures of cationic peptides, proteins or polymers and optionally further components as defined herein, which are crosslinked by disulfide bonds as described herein. In this context, the disclosure of WO 2012/013326 is incorporated herewith by reference.

In this context, the cationic components, which form basis for the polymeric carrier by disulfide-crosslinkage, are typically selected from any suitable cationic or polycationic peptide, protein or polymer suitable for this purpose, particular any cationic or polycationic peptide, protein or polymer capable of complexing the RNA as defined herein or a further nucleic acid comprised in the composition, and thereby preferably condensing the RNA or the nucleic acid. The cationic or polycationic peptide, protein or polymer, is preferably a linear molecule, however, branched cationic or polycationic peptides, proteins or polymers may also be used.

Every disulfide-crosslinking cationic or polycationic protein, peptide or polymer of the polymeric carrier, which may be used to complex the RNA according to the invention or any further nucleic acid comprised in the (pharmaceutical) composition or (passive) vaccine of the present invention contains at least one —SH moiety, most preferably at least one cysteine residue or any further chemical group exhibiting an —SH moiety, capable of forming a disulfide linkage upon condensation with at least one further cationic or polycationic protein, peptide or polymer as cationic component of the polymeric carrier as mentioned herein.

As defined above, the polymeric carrier, which may be used to complex the RNA of the present invention or any further nucleic acid comprised in the (pharmaceutical) composition or (passive) vaccine according to the invention may be formed by disulfide-crosslinked cationic (or polycationic) components. Preferably, such cationic or polycationic peptides or proteins or polymers of the polymeric carrier, which comprise or are additionally modified to comprise at least one —SH moiety, are selected from, proteins, peptides and polymers as defined herein for complexation agent.

In a further particular embodiment, the polymeric carrier which may be used to complex the RNA as defined herein or any further nucleic acid comprised in the (pharmaceutical) composition or (passive) vaccine according to the invention may be selected from a polymeric carrier molecule according to generic formula (IV):

$$L\text{-}P^1\text{-}S\text{-}[S\text{-}P^2\text{-}S]_n\text{-}S\text{-}P^3\text{-}L \qquad \text{formula (IV)}$$

wherein, $P^1$ and $P^3$ are different or identical to each other and represent a linear or branched hydrophilic polymer chain, each $P^1$ and $P^3$ exhibiting at least one —SH-moiety, capable to form a disulfide linkage upon condensation with component $P^2$, or alternatively with (AA), (AA)$_x$, or [(AA)$_x$]$_z$ if such components are used as a linker between $P^1$ and $P^2$ or $P^3$ and $P^2$) and/or with further components (e.g. (AA), (AA)$_x$, [(AA)$_x$]$_z$ or L), the linear or branched hydrophilic polymer chain selected independent from each other from polyethylene glycol (PEG), poly-N-(2-hydroxypropyl)methacrylamide, poly-2-(methacryloyloxy)ethyl phosphorylcholines, poly(hydroxyalkyl L-asparagine), poly(2-(methacryloyloxy)ethyl phosphorylcholine), hydroxyethylstarch or poly(hydroxyalkyl L-glutamine), wherein the hydrophilic polymer chain exhibits a molecular weight of about 1 kDa to about 100 kDa, preferably of about 2 kDa to about 25 kDa; or more preferably of about 2 kDa to about 10 kDa, e.g. about 5 kDa to about 25 kDa or 5 kDa to about 10 kDa;

$P^2$ is a cationic or polycationic peptide or protein, e.g. as defined above for the polymeric carrier formed by disulfide-crosslinked cationic components, and preferably having a length of about 3 to about 100 amino acids, more preferably having a length of about 3 to about 50 amino acids, even more preferably having a length of about 3 to about 25 amino acids, e.g. a length of about 3 to 10, 5 to 15, 10 to 20 or 15 to 25 amino acids, more preferably a length of about 5 to about 20 and even more preferably a length of about 10 to about 20; or is a cationic or polycationic polymer, e.g. as defined above for the polymeric carrier formed by disulfide-crosslinked cationic components, typically having a molecular weight of about 0.5 kDa to about 30 kDa, including a molecular weight of about 1 kDa to about 20 kDa, even more preferably of about 1.5 kDa to about 10 kDa, or having a molecular weight of about 0.5 kDa to about 100 kDa, including a molecular weight of about 10 kDa to about 50 kDa, even more preferably of about 10 kDa to about 30 kDa; each $P^2$ exhibiting at least two —SH-moieties, capable to form a disulfide linkage upon condensation with further components $P^2$ or component(s) $P^1$ and/or $P^3$ or alternatively with further components (e.g. (AA), (AA)$_x$, or [(AA)$_x$]$_z$);

—S—S— is a (reversible) disulfide bond (the brackets are omitted for better readability), wherein S preferably represents sulphur or a —SH carrying moiety, which has formed a (reversible) disulfide bond. The (reversible) disulfide bond is preferably formed by condensation of —SH-moieties of either components $P^1$ and $P^2$, $P^2$ and $P^2$, or $P^2$ and $P^3$, or optionally of further components as defined herein (e.g. L, (AA), (AA)$_x$, [(AA)$_x$]$_z$, etc); The —SH-moiety may be part of the structure of these components or added by a modification as defined below;

L is an optional ligand, which may be present or not, and may be selected independent from the other from RGD, Transferrin, Folate, a signal peptide or signal sequence, a localization signal or sequence, a nuclear localization signal or sequence (NLS), an antibody, a cell penetrating peptide, (e.g. TAT or KALA), a ligand of a receptor (e.g. cytokines, hormones, growth factors etc), small molecules (e.g. carbohydrates like mannose or galactose or synthetic ligands), small molecule agonists, inhibitors or antagonists of receptors (e.g. RGD peptidomimetic analogues), or any further protein as defined herein, etc.;

n is an integer, typically selected from a range of about 1 to 50, preferably from a range of about 1, 2 or 3 to 30, more preferably from a range of about 1, 2, 3, 4, or 5 to 25, or a range of about 1, 2, 3, 4, or 5 to 20, or a range of about 1, 2, 3, 4, or 5 to 15, or a range of about 1, 2, 3, 4, or 5 to 10, including e.g. a range of about 4 to 9, 4 to 10, 3 to 20, 4 to 20, 5 to 20, or 10 to 20, or a range of about 3 to 15, 4 to 15, 5 to 15, or 10 to 15, or a range of about 6 to 11 or 7 to 10. Most preferably, n is in a range of about 1, 2, 3, 4, or 5 to 10, more preferably in a range of about 1, 2, 3, or 4 to 9, in a range of about 1, 2, 3, or 4 to 8, or in a range of about 1, 2, or 3 to 7.

In this context, the disclosure of WO 2011/026641 is incorporated herewith by reference. Each of hydrophilic polymers $P^1$ and $P^3$ typically exhibits at least one —SH-moiety, wherein the at least one —SH-moiety is capable to form a disulfide linkage upon reaction with component $P^2$ or with component (AA) or (AA)$_x$, if used as linker between $P^1$ and $P^2$ or $P^3$ and $P^2$ as defined below and optionally with a further component, e.g. L and/or (AA) or (AA)$_x$, e.g. if two or more —SH-moieties are contained. The following sub-formulae "$P^1$—S—S—$P^2$" and "$P^2$—S—S—$P^3$" within generic formula (IV) above (the brackets are omitted for better readability), wherein any of S, $P^1$ and $P^3$ are as defined herein, typically represent a situation, wherein one-SH-moiety of hydrophilic polymers $P^1$ and $P^3$ was condensed with one —SH-moiety of component $P^2$ of generic formula (IV) above, wherein both sulphurs of these —SH-moieties form a disulfide bond —S—S— as defined herein in formula (IV). These —SH-moieties are typically provided by each of the hydrophilic polymers $P^1$ and $P^3$, e.g. via an internal cysteine or any further (modified) amino acid or compound which carries a —SH moiety. Accordingly, the subformulae "$P^1$—S—S—$P^2$" and "$P^2$—S—S—$P^3$" may also be written as "$P^1$-Cys-Cys-$P^2$" and "$P^2$-Cys-Cys-$P^3$", if the —SH-moiety is provided by a cysteine, wherein the term Cys-Cys represents two cysteines coupled via a disulfide bond, not via a peptide bond. In this case, the term "—S—S—" in these formulae may also be written as "—S-Cys", as "-Cys-S" or as "-Cys-Cys-". In this context, the term "-Cys-Cys-" does not represent a peptide bond but a linkage of two cysteines via their —SH-moieties to form a disulfide bond. Accordingly, the term "-Cys-Cys-" also may be understood generally as "-(Cys-S)—(S-Cys)-", wherein in this specific case S indicates the sulphur of the —SH-moiety of cysteine. Likewise, the terms "—S-Cys" and "-Cys-S" indicate a disulfide bond between a —SH containing moiety and a cysteine, which may also be written as "—S—(S-Cys)" and "-(Cys-S)—S". Alternatively, the hydrophilic polymers $P^1$ and $P^3$ may be modified with a —SH moiety, preferably via a chemical reaction with a compound carrying a —SH moiety, such that each of the hydrophilic polymers $P^1$ and $P^3$ carries at least one such —SH moiety. Such a compound carrying a —SH moiety may be e.g. an (additional) cysteine or any further (modified) amino acid, which carries a —SH moiety. Such a compound may also be any non-amino compound or moiety, which contains or allows to introduce a —SH moiety into hydrophilic polymers $P^1$ and $P^3$ as defined herein. Such non-amino compounds may be attached to the hydrophilic polymers $P^1$ and $P^3$ of formula (IV) of the polymeric carrier according to the present invention via chemical reactions or binding of compounds, e.g. by binding of a 3-thio propionic acid or thioimolane, by amide formation (e.g. carboxylic acids, sulphonic acids, amines, etc), by Michael addition (e.g maleinimide moieties, $\alpha,\beta$-unsatured carbonyls, etc), by click chemistry (e.g. azides or alkines), by alkene/alkine methatesis (e.g. alkenes or alkines), imine or hydrozone formation (aldehydes or ketons, hydrazins, hydroxylamins, amines), complexation reactions (avidin, biotin, protein G) or components which allow $S_n$-type substitution reactions (e.g halogenalkans, thiols, alcohols, amines, hydrazines, hydrazides, sulphonic acid esters, oxyphosphonium salts) or other chemical moieties which can be utilized in the attachment of further components. A particularly preferred PEG derivate in this context is alpha-Methoxy-omega-mercapto poly(ethylene glycol). In each case, the SH-moiety, e.g. of a cysteine or of any further (modified) amino acid or compound, may be present at the terminal ends or internally at any position of hydrophilic polymers $P^1$ and $P^3$. As defined herein, each of hydrophilic polymers $P^1$ and $P^3$ typically exhibits at least one —SH-moiety preferably at one terminal end, but may also contain two or even more —SH-moieties, which may be used to additionally attach further components as defined herein, preferably further functional peptides or proteins e.g. a ligand, an amino acid component (AA) or $(AA)_x$, antibodies, cell penetrating peptides or enhancer peptides (e.g. TAT, KALA), etc.

Preferably, the inventive composition comprises at least one RNA as defined herein, which is complexed with one or more polycations, and at least one free RNA, wherein the at least one complexed RNA is preferably identical to the at least one free RNA. In this context, it is particularly preferred that the composition of the present invention comprises the RNA according to the invention that is complexed at least partially with a cationic or polycationic compound and/or a polymeric carrier, preferably cationic proteins or peptides. In this context, the disclosure of WO 2010/037539 and WO 2012/113513 is incorporated herewith by reference. Partially means that only a part of the RNA as defined herein is complexed in the composition according to the invention with a cationic compound and that the rest of the RNA as defined herein is (comprised in the inventive (pharmaceutical) composition or (passive) vaccine) in uncomplexed form ("free"). Preferably, the molar ratio of the complexed RNA to the free RNA is selected from a molar ratio of about 0.001:1 to about 1:0.001, including a ratio of about 1:1. More preferably the ratio of complexed RNA to free RNA (in the (pharmaceutical) composition or (passive) vaccine of the present invention) is selected from a range of about 5:1 (w/w) to about 1:10 (w/w), more preferably from a range of about 4:1 (w/w) to about 1:8 (w/w), even more preferably from a range of about 3:1 (w/w) to about 1:5 (w/w) or 1:3 (w/w), and most preferably the ratio of complexed mRNA to free mRNA in the inventive pharmaceutical composition or (passive) vaccine is selected from a ratio of about 1:1 (w/w).

The complexed RNA in the (pharmaceutical) composition or (passive) vaccine according to the present invention, is preferably prepared according to a first step by complexing the RNA according to the invention with a cationic or polycationic compound and/or with a polymeric carrier, preferably as defined herein, in a specific ratio to form a stable complex. In this context, it is highly preferable, that no free cationic or polycationic compound or polymeric carrier or only a negligibly small amount thereof remains in the component of the complexed RNA after complexing the RNA. Accordingly, the ratio of the RNA and the cationic or polycationic compound and/or the polymeric carrier in the component of the complexed RNA is typically selected in a range so that the RNA is entirely complexed and no free cationic or polycationic compound or polymeric carrier or only a negligibly small amount thereof remains in the composition.

Preferably the ratio of the RNA as defined herein to the cationic or polycationic compound and/or the polymeric carrier, preferably as defined herein, is selected from a range of about 6:1 (w/w) to about 0.25:1 (w/w), more preferably from about 5:1 (w/w) to about 0.5:1 (w/w), even more preferably of about 4:1 (w/w) to about 1:1 (w/w) or of about 3:1 (w/w) to about 1:1 (w/w), and most preferably a ratio of about 3:1 (w/w) to about 2:1 (w/w). Alternatively, the ratio of the RNA as defined herein to the cationic or polycationic compound and/or the polymeric carrier, preferably as defined herein, in the component of the complexed mRNA, may also be calculated on the basis of the nitrogen/phosphate ratio (N/P-ratio) of the entire complex. In the context of the present invention, an N/P-ratio is preferably in the range of about 0.1-10, preferably in a range of about 0.3-4 and most preferably in a range of about 0.5-2 or 0.7-2 regarding the ratio of RNA: cationic or polycationic compound and/or polymeric carrier, preferably as defined herein, in the complex, and most preferably in a range of about 0.7-1.5, 0.5-1 or 0.7-1, and even most preferably in a range of about 0.3-0.9 or 0.5-0.9, preferably provided that the cationic or polycationic compound in the complex is a cationic or polycationic cationic or polycationic protein or peptide and/or the polymeric carrier as defined above. In this specific embodiment the complexed RNA as defined herein is also encompassed in the term "adjuvant component".

In other embodiments, the composition according to the invention comprising the RNA as defined herein may be administered naked without being associated with any further vehicle, transfection or complexation agent.

It has to be understood and recognized, that according to the present invention, the inventive composition may comprise at least one naked RNA as defined herein, preferably an mRNA, and/or at least one formulated/complexed RNA as defined herein, preferably an mRNA, wherein every formulation and/or complexation as disclosed above may be used.

In a further aspect, the present invention provides a (passive) vaccine, which is based on the RNA according to the invention comprising at least one coding sequence as defined herein. The (passive) vaccine according to the invention is preferably a (pharmaceutical) composition as defined herein.

Accordingly, the (passive) vaccine according to the invention is based on the same components as the (pharmaceutical) composition described herein. Insofar, it may be referred to the description of the (pharmaceutical) composition as provided herein. In particular, in embodiments, where the (passive) vaccine comprises more than one RNA component (such as a plurality of RNAs according to the invention, wherein each encodes a distinct antibody or, preferably, distinct fragments of the same antibody), the (passive) vaccine may, however, be provided in physically separate form and may be administered by separate administration steps, for example as described above in the context of a combination for use according to the present invention. The (passive) vaccine according to the invention may correspond to the (pharmaceutical) composition as described herein, especially where the mRNA components are provided by one single composition. However, the inventive (passive) vaccine may also be provided physically separated. For instance, in embodiments, wherein the (passive) vaccine comprises more than one RNA (e.g. as described above in the context of a combination for use according to the present invention), these RNA's may be provided such that, for example, two, three, four, five or six separate compositions, which may contain at least one RNA species each (e.g. three distinct mRNA species), each encoding distinct antibodies or distinct fragments of the same antibody, are provided, which may or may not be combined. Also, the inventive (passive) vaccine may be a combination of at least two distinct compositions, each composition comprising at least one mRNA encoding at least one of the antibodies as defined herein or encoding at least one fragment of an antibody. Alternatively, the (passive) vaccine may be provided as a combination of at least one mRNA, preferably at least two, three, four, five, six or more mRNAs, each encoding one of the antibodies defined herein or one fragment of the same antibody. The (passive) vaccine may be combined to provide one single composition prior to its use or it may be used such that more than one administration is required to administer the distinct mRNA species encoding any of the antibody combinations as defined herein or encoding any of the antibody fragment combinations as defined herein (such as, for example, heavy and light chain of the same antibody encoded by distinct mRNA's). If the (passive) vaccine contains at least one mRNA molecule, typically at least two mRNA molecules, encoding an antibody combination or an antibody fragment combination as defined herein, it may e.g. be administered by one single administration (combining all mRNA species), by at least two separate administrations. Accordingly; any combination of mono-, bi- or multicistronic mRNAs encoding the at least one antibody or any combination of antibodies or of antibody fragments as defined herein (and optionally further antibodies), provided as separate entities (containing one mRNA species) or as combined entity (containing more than one mRNA species), is understood as a (passive) vaccine according to the present invention. According to a preferred embodiment of the inventive (passive) vaccine, the at least one antibody or the fragment thereof, preferably a combination as defined herein of at least two, three, four, five, six or more antibodies or fragments thereof encoded by the inventive composition as a whole, is provided as an individual (monocistronic) mRNA, which is administered separately.

As with the (pharmaceutical) composition according to the present invention, the entities of the (passive) vaccine may be provided in liquid and or in dry (e.g. lyophilized) form. They may contain further components, in particular further components allowing for its pharmaceutical use. The (passive) vaccine or the (pharmaceutical) composition may, e.g., additionally contain a pharmaceutically acceptable carrier and/or further auxiliary substances and additives and/or adjuvants.

The (passive) vaccine or (pharmaceutical) composition typically comprises a safe and effective amount of the RNA according to the invention as defined herein, encoding an antibody or a fragment or variant thereof as defined herein or a combination of antibodies as defined herein. As used herein, "safe and effective amount" means an amount of the RNA that is sufficient to significantly induce a positive modification of a disease or disorder to be treated with the inventive composition. At the same time, however, a "safe and effective amount" is small enough to avoid serious side-effects, that is to say to permit a sensible relationship between advantage and risk. The determination of these limits typically lies within the scope of sensible medical judgment. In relation to the (passive) vaccine or (pharmaceutical) composition of the present invention, the expression "safe and effective amount" preferably means an amount of the RNA (and thus of the encoded antibody or fragment thereof) that is suitable for treating a disease or disorder as described herein. Such a "safe and effective amount" of the RNA of the (pharmaceutical) composition or (passive) vaccine as defined herein may furthermore be selected in dependence of the type of RNA, e.g. monocistronic, bi- or even multicistronic RNA, since a bi- or even multicistronic RNA may lead to a significantly higher expression of the encoded antibody(s) than the use of an equal amount of a monocistronic RNA. A "safe and effective amount" of the RNA of the (pharmaceutical) composition or (passive) vaccine as defined above will furthermore vary in connection with the particular condition to be treated and also with the age and physical condition of the patient to be treated, the severity of the condition, the duration of the treatment, the nature of the accompanying therapy, of the particular pharmaceutically acceptable carrier used, and similar factors, within the knowledge and experience of the accompanying doctor. The (passive) vaccine or composition according to the invention can be used according to the invention for human and also for veterinary medical purposes, as a pharmaceutical composition or as a (passive) vaccine.

In a preferred embodiment, the RNA of the (pharmaceutical) composition, (passive) vaccine or kit of parts according to the invention is provided in lyophilized form. Preferably, the lyophilized RNA is reconstituted in a suitable buffer, advantageously based on an aqueous carrier, prior to administration, e.g. Ringer-Lactate solution, which is preferred, Ringer solution, a phosphate buffer solution. In a preferred embodiment, the (pharmaceutical) composition, the (passive) vaccine or the kit of parts according to the invention contains at least two, three, four, five, six or more RNAs, preferably mRNAs which are provided separately in lyophilized form (optionally together with at least one further additive) and which are preferably reconstituted separately in a suitable buffer (such as Ringer-Lactate solution) prior to their use so as to allow individual administration of each of the (monocistronic) RNAs.

The (passive) vaccine or (pharmaceutical) composition according to the invention may typically contain a pharmaceutically acceptable carrier. The expression "pharmaceutically acceptable carrier" as used herein preferably includes the liquid or non-liquid basis of the inventive (passive) vaccine. If the inventive (passive) vaccine is provided in liquid form, the carrier will be water, typically pyrogen-free water; isotonic saline or buffered (aqueous) solutions, e.g phosphate, citrate etc. buffered solutions. Particularly for injection of the inventive (passive) vaccine, water or preferably a buffer, more preferably an aqueous buffer, may be used, containing a sodium salt, preferably at least 50 mM of a sodium salt, a calcium salt, preferably at least 0.01 mM of a calcium salt, and optionally a potassium salt, preferably at least 3 mM of a potassium salt. According to a preferred embodiment, the sodium, calcium and, optionally, potassium salts may occur in the form of their halogenides, e.g. chlorides, iodides, or bromides, in the form of their hydroxides, carbonates, hydrogen carbonates, or sulfates, etc. Without being limited thereto, examples of sodium salts include e.g. NaCl, NaI, NaBr, $Na_2CO_3$, $NaHCO_3$, $Na_2SO_4$, examples of the optional potassium salts include e.g. KCl, KI, KBr, $K_2CO_3$, $KHCO_3$, $K_2SO_4$, and examples of calcium salts include e.g. $CaCl_2$, $CaI_2$, $CaBr_2$, $CaCO_3$, $CaSO_4$, $Ca(OH)_2$. Furthermore, organic anions of the aforementioned cations may be contained in the buffer. According to a more preferred embodiment, the buffer suitable for injection purposes as defined above, may contain salts selected from sodium chloride (NaCl), calcium chloride ($CaCl_2$) and optionally potassium chloride (KCl), wherein further anions may be present additional to the chlorides. $CaCl_2$ can also be replaced by another salt like KCl. Typically, the salts in the injection buffer are present in a concentration of at least 50 mM sodium chloride (NaCl), at least 3 mM potassium chloride (KCl) and at least 0.01 mM calcium chloride ($CaCl_2$). The injection buffer may be hypertonic, isotonic or hypotonic with reference to the specific reference medium, i.e. the buffer may have a higher, identical or lower salt content with reference to the specific reference medium, wherein preferably such concentrations of the afore mentioned salts may be used, which do not lead to damage of cells due to osmosis or other concentration effects. Reference media are e.g. in "in vivo" methods occurring liquids such as blood, lymph, cytosolic liquids, or other body liquids, or e.g. liquids, which may be used as reference media in "in vitro" methods, such as common buffers or liquids. Such common buffers or liquids are known to a skilled person. Ringer-Lactate solution is particularly preferred as a liquid basis.

However, one or more compatible solid or liquid fillers or diluents or encapsulating compounds may be used as well, which are suitable for administration to a person. The term "compatible" as used herein means that the constituents of the inventive (passive) vaccine are capable of being mixed with the RNA according to the invention as defined herein, in such a manner that no interaction occurs, which would substantially reduce the pharmaceutical effectiveness of the inventive (passive) vaccine under typical use conditions. Pharmaceutically acceptable carriers, fillers and diluents must, of course, have sufficiently high purity and sufficiently low toxicity to make them suitable for administration to a person to be treated. Some examples of compounds which can be used as pharmaceutically acceptable carriers, fillers or constituents thereof are sugars, such as, for example, lactose, glucose, trehalose and sucrose; starches, such as, for example, corn starch or potato starch; dextrose; cellulose and its derivatives, such as, for example, sodium carboxymethylcellulose, ethylcellulose, cellulose acetate; powdered tragacanth; malt; gelatin; tallow; solid glidants, such as, for example, stearic acid, magnesium stearate; calcium sulfate; vegetable oils, such as, for example, groundnut oil, cottonseed oil, sesame oil, olive oil, corn oil and oil from theobroma; polyols, such as, for example, polypropylene glycol, glycerol, sorbitol, mannitol and polyethylene glycol; alginic acid.

The choice of a pharmaceutically acceptable carrier is determined, in principle, by the manner, in which the pharmaceutical composition or (passive) vaccine according to the invention is administered. The composition or (passive) vaccine can be administered, for example, systemically or locally. Routes for systemic administration in general include, for example, transdermal, oral, parenteral routes, including subcutaneous, intravenous, intramuscular, intraarterial, intradermal and intraperitoneal injections and/or intranasal administration routes. Routes for local administration in general include, for example, topical administration routes but also intradermal, transdermal, subcutaneous, or intramuscular injections or intralesional, intracranial, intrapulmonal, intracardial, and sublingual injections. More preferably, composition or (passive) vaccines according to the present invention may be administered by an intradermal, subcutaneous, or intramuscular route, preferably by injection, which may be needle-free and/or needle injection. Compositions/vaccines are therefore preferably formulated in liquid or solid form. The suitable amount of the vaccine or composition according to the invention to be administered can be determined by routine experiments, e.g. by using animal models. Such models include, without implying any limitation, rabbit, sheep, mouse, rat, dog and non-human primate models. Preferred unit dose forms for injection include sterile solutions of water, physiological saline or mixtures thereof. The pH of such solutions should be adjusted to about 7.4. Suitable carriers for injection include hydrogels, devices for controlled or delayed release, polylactic acid and collagen matrices. Suitable pharmaceutically acceptable carriers for topical application include those which are suitable for use in lotions, creams, gels and the like. If the inventive composition or vaccine is to be administered perorally, tablets, capsules and the like are the preferred unit dose form. The pharmaceutically acceptable carriers for the preparation of unit dose forms which can be used for oral administration are well known in the prior art. The choice thereof will depend on secondary considerations such as taste, costs and storability, which are not critical for the purposes of the present invention, and can be made without difficulty by a person skilled in the art.

Further additives which may be included in the inventive vaccine or composition are emulsifiers, such as, for example, Tween; wetting agents, such as, for example, sodium lauryl sulfate; colouring agents; taste-imparting agents, pharmaceutical carriers; tablet-forming agents; stabilizers; antioxidants; preservatives.

Kit comprising the RNA according to the Present Invention

According to another aspect of the present invention, the present invention also provides a kit, in particular a kit of parts, comprising the RNA according to the present invention, the (pharmaceutical) composition, and/or the vaccine according to the invention, optionally a liquid vehicle for solubilising and optionally technical instructions with information on the administration and dosage of the RNA, the composition and/or the vaccine. The technical instructions may contain information about administration and dosage of the RNA, the composition and/or the vaccine. Such kits, preferably kits of parts, may be applied e.g. for any of the applications or uses as described herein, preferably for the use of the RNA according to the invention (for the preparation of an inventive medicament, preferably a vaccine), for the treatment (prophylaxis or therapy) of a disease or disorder as described herein. The kits may also be applied for the use of the RNA, the composition or the vaccine as defined herein (for the preparation of an inventive vaccine)

for the treatment (prophylaxis or therapy) of a disease or disorder as described herein. Such kits may further be applied for the use of the RNA, the composition or the vaccine as defined herein (for the preparation of an inventive vaccine) for modulating, preferably for eliciting, e.g. to induce or enhance, an immune response in a mammal as defined above, and preferably for supporting treatment (prophylaxis or therapy) of a disease or disorder as described herein. Kits of parts, as a special form of kits, may contain one or more identical or different compositions and/or one or more identical or different vaccines as described herein in different parts of the kit. Kits of parts may also contain an (e.g. one) composition, an (e.g. one) vaccine and/or the RNA according to the invention in different parts of the kit, e.g. each part of the kit containing an RNA as defined herein, preferably encoding a distinct antibody or distinct fragments of the same antibody. Preferably, the kit or the kit of parts contains as a part a vehicle for solubilising the RNA according to the invention, the vehicle preferably being Ringer-lactate solution. Any of the above kits may be used in a treatment or prophylaxis as defined above.

In a further embodiment, the kit according to the present invention may additionally contain at least one further pharmaceutically active component, preferably a therapeutic compound suitable for treatment (prophylaxis or therapy) of a disease or disorder as described herein. Moreover, in another embodiment, the kit may additionally contain parts and/or devices necessary or suitable for the administration of the composition or the vaccine according to the invention, including needles, applicators, patches, injection-devices.

Preferably, the kit according to the present invention contains, in particular as a part, Ringer-Lactate solution. It is also preferred that the kit according to the present invention contains, in particular as a part, at least one modulator of an inhibitory and/or a stimulatory checkpoint molecule, such as an inhibitor of an inhibitory checkpoint molecule, preferably CTLA4 inhibitors and PD-1 pathway inhibitors.

Moreover, in a particularly preferred embodiment, the kit according to the present invention contains, in particular as distinct parts, at least two distinct RNA's according to the present invention. Thereby, the details of the at least two distinct RNA's according to the present invention as described above, in the context of the combination for use according to the present invention, apply accordingly for the at least two distinct RNA's contained in the kit according to the present invention. Accordingly, it is preferred that one RNA of the at least two distinct RNA's encodes a heavy chain variable region of an antibody or a fragment thereof and another RNA of the at least two distinct RNA's encodes the corresponding light chain variable region of the antibody or the fragment thereof. More preferably, one RNA of the at least two distinct RNA's encodes a heavy chain of an antibody and another RNA of the at least two distinct RNA's encodes the corresponding light chain of the antibody. It is also preferred that the RNA encoding the heavy chain variable region or a fragment thereof and the RNA encoding the light chain variable region or a fragment thereof comprise identical 5'UTR elements and/or identical 3'UTR elements and/or identical further elements as described above, in the context of the combination for use according to the present invention.

Uses and methods according to the Present Invention

According to a further aspect of the present invention, the RNA, the combination of RNA's according to the present invention, the (pharmaceutical) composition, the (passive) vaccine or the kit according to the present invention may be used (for the preparation of a medicament) for the treatment (prophylaxis or therapy) of any disorder/disease, which can be treated by use of an antibody, in particular cancer, cardiovascular diseases, neurological diseases, infectious diseases, autoimmune diseases, virus diseases, monogenetic diseases and diseases or disorders related thereto. Preferably, the RNA, the combination of RNA's, the (pharmaceutical) composition, the (passive) vaccine or the kit according to the present invention may be used (for the preparation of a medicament) for the treatment (prophylaxis or therapy) of cancer or infectious diseases.

As used herein, the term "cancer" refers to the broad class of disorders and malignancies characterized by hyperproliferative cell growth, either in vitro (e.g., transformed cells) or in vivo. Conditions which can be treated or prevented by the compositions and methods of the invention include, e.g., a variety of neoplasms, including benign or malignant tumours, a variety of hyperplasias, or the like. Compositions and methods of the invention can achieve the inhibition and/or reversion of undesired hyperproliferative cell growth involved in such conditions. Specific examples of cancers to be treated in the context of the present invention include Acute Lymphoblastic Leukemia, Adult; Acute Lymphoblastic Leukemia, Childhood; Acute Myeloid Leukemia, Adult; Adrenocortical Carcinoma; Adrenocortical Carcinoma, Childhood; AIDS-Related Lymphoma; AIDS-Related Malignancies; Anal Cancer; Astrocytoma, Childhood Cerebellar; Astrocytoma, Childhood Cerebral; Bile Duct Cancer, Extrahepatic; Bladder Cancer; Bladder Cancer, Childhood; Bone Cancer, Osteosarcoma/Malignant Fibrous Histiocytoma; Brain Stem Glioma, Childhood; Brain Tumor, Adult; Brain Tumor, Brain Stem Glioma, Childhood; Brain Tumor, Cerebellar Astrocytoma, Childhood; Brain Tumor, Cerebral Astrocytoma/Malignant Glioma, Childhood; Brain Tumor, Ependymoma, Childhood; Brain Tumor, Medulloblastoma, Childhood; Brain Tumor, Supratentorial Primitive Neuroectodermal Tumors, Childhood; Brain Tumor, Visual Pathway and Hypothalamic Glioma, Childhood; Brain Tumor, Childhood (Other); Breast Cancer; Breast Cancer and Pregnancy; Breast Cancer, Childhood; Breast Cancer, Male; Bronchial Adenomas/Carcinoids, Childhood: Carcinoid Tumor, Childhood; Carcinoid Tumor, Gastrointestinal; Carcinoma, Adrenocortical; Carcinoma, Islet Cell; Carcinoma of Unknown Primary; Central Nervous System Lymphoma, Primary; Cerebellar Astrocytoma, Childhood; Cerebral Astrocytoma/Malignant Glioma, Childhood; Cervical Cancer; Childhood Cancers; Chronic Lymphocytic Leukemia; Chronic Myelogenous Leukemia; Chronic Myeloproliferative Disorders; Clear Cell Sarcoma of Tendon Sheaths; Colon Cancer; Colorectal Cancer, Childhood; Cutaneous T-Cell Lymphoma; Endometrial Cancer; Ependymoma, Childhood; Epithelial Cancer, Ovarian; Esophageal Cancer; Esophageal Cancer, Childhood; Ewing's Family of Tumors; Extracranial Germ Cell Tumor, Childhood; Extragonadal Germ Cell Tumor; Extrahepatic Bile Duct Cancer; Eye Cancer, Intraocular Melanoma; Eye Cancer, Retinoblastoma; Gallbladder Cancer; Gastric (Stomach) Cancer; Gastric (Stomach) Cancer, Childhood; Gastrointestinal Carcinoid Tumor; Germ Cell Tumor, Extracranial, Childhood; Germ Cell Tumor, Extragonadal; Germ Cell Tumor, Ovarian; Gestational Trophoblastic Tumor; Glioma. Childhood Brain Stem; Glioma. Childhood Visual Pathway and Hypothalamic; Hairy Cell Leukemia; Head and Neck Cancer; Hepatocellular (Liver) Cancer, Adult (Primary); Hepatocellular (Liver) Cancer, Childhood (Primary); Hodgkin's Lymphoma, Adult; Hodgkin's Lymphoma, Childhood; Hodgkin's Lymphoma During Pregnancy; Hypopharyngeal Cancer; Hypothalamic and Visual Pathway Glioma, Childhood; Intraocular Melanoma; Islet Cell Carcinoma (Endocrine Pancreas); Kaposi's Sarcoma; Kidney Cancer; Laryngeal Cancer; Laryngeal Cancer, Childhood; Leukemia, Acute Lymphoblastic, Adult; Leukemia, Acute Lymphoblastic, Childhood; Leukemia, Acute Myeloid, Adult; Leukemia, Acute Myeloid, Childhood; Leukemia, Chronic Lymphocytic; Leukemia, Chronic Myelogenous; Leukemia, Hairy Cell; Lip and Oral Cavity Cancer; Liver Cancer, Adult (Primary); Liver Cancer, Childhood (Primary); Lung Cancer, Non-Small Cell; Lung Cancer, Small Cell; Lymphoblastic Leukemia, Adult Acute; Lymphoblastic Leukemia, Childhood Acute; Lymphocytic Leukemia, Chronic; Lymphoma, AIDS—Related; Lymphoma, Central Nervous System (Primary); Lymphoma, Cutaneous T-Cell; Lymphoma, Hodgkin's, Adult; Lymphoma, Hodgkin's; Childhood; Lymphoma, Hodgkin's During Pregnancy; Lymphoma, Non-Hodgkin's, Adult; Lymphoma, Non-Hodgkin's, Childhood; Lymphoma, Non-Hodgkin's During Pregnancy; Lymphoma, Primary Central Nervous System; Macroglobulinemia, Waldenstrom's; Male Breast Cancer; Malignant Mesothelioma, Adult; Malignant Mesothelioma, Childhood; Malignant Thymoma; Medulloblastoma, Childhood; Melanoma; Melanoma, Intraocular; Merkel Cell Carcinoma; Mesothelioma, Malignant; Metastatic Squamous Neck Cancer with Occult Primary; Multiple Endocrine Neoplasia Syndrome, Childhood; Multiple Myeloma/Plasma Cell Neoplasm; Mycosis Fungoides; Myelodysplasia Syndromes; Myelogenous Leukemia, Chronic; Myeloid Leukemia, Childhood Acute; Myeloma, Multiple; Myeloproliferative Disorders, Chronic; Nasal Cavity and Paranasal Sinus Cancer; Nasopharyngeal Cancer; Nasopharyngeal Cancer, Childhood; Neuroblastoma; Neurofibroma; Non-Hodgkin's Lymphoma, Adult; Non-Hodgkin's Lymphoma, Childhood; Non-Hodgkin's Lymphoma During Pregnancy; Non-Small Cell Lung Cancer; Oral Cancer, Childhood; Oral Cavity and Lip Cancer; Oropharyngeal Cancer; Osteosarcoma/Malignant Fibrous Histiocytoma of Bone; Ovarian Cancer, Childhood; Ovarian Epithelial Cancer; Ovarian Germ Cell Tumor; Ovarian Low Malignant Potential Tumor; Pancreatic Cancer; Pancreatic Cancer, Childhood'; Pancreatic Cancer, Islet Cell; Paranasal Sinus and Nasal Cavity Cancer; Parathyroid Cancer; Penile Cancer; Pheochromocytoma; Pineal and Supratentorial Primitive Neuroectodermal Tumors, Childhood; Pituitary Tumor; Plasma Cell Neoplasm/Multiple Myeloma; Pleuropulmonary Blastoma; Pregnancy and Breast Cancer; Pregnancy and Hodgkin's Lymphoma; Pregnancy and Non-Hodgkin's Lymphoma; Primary Central Nervous System Lymphoma; Primary Liver Cancer, Adult; Primary Liver Cancer, Childhood; Prostate Cancer; Rectal Cancer; Renal Cell (Kidney) Cancer; Renal Cell Cancer, Childhood; Renal Pelvis and Ureter, Transitional Cell Cancer; Retinoblastoma; Rhabdomyosarcoma, Childhood; Salivary Gland Cancer; Salivary Gland'Cancer, Childhood; Sarcoma, Ewing's Family of Tumors; Sarcoma, Kaposi's; Sarcoma (Osteosarcoma)/Malignant Fibrous Histiocytoma of Bone; Sarcoma, Rhabdomyosarcoma, Childhood; Sarcoma, Soft Tissue, Adult; Sarcoma, Soft Tissue, Childhood; Sezary Syndrome; Skin Cancer; Skin Cancer, Childhood; Skin Cancer (Melanoma); Skin Carcinoma, Merkel Cell; Small Cell Lung Cancer; Small Intestine Cancer; Soft Tissue Sarcoma, Adult; Soft Tissue Sarcoma, Childhood; Squamous Neck Cancer with Occult Primary, Metastatic; Stomach (Gastric) Cancer; Stomach (Gastric) Cancer, Childhood; Supratentorial Primitive Neuroectodermal Tumors, Childhood; T-Cell Lymphoma, Cutaneous; Testicular Cancer; Thymoma, Childhood; Thymoma, Malignant; Thyroid Cancer; Thyroid Cancer, Childhood; Transitional Cell Cancer of the Renal Pelvis and Ureter; Trophoblastic Tumor, Gestational; Unknown Primary Site, Cancer of, Childhood; Unusual Cancers of Childhood; Ureter and Renal Pelvis, Transitional Cell Cancer; Urethral Cancer; Uterine Sarcoma; Vaginal Cancer; Visual Pathway and Hypothalamic Glioma, Childhood; Vulvar Cancer; Waldenstrom's Macro globulinemia; and Wilms' Tumor.

Infectious diseases are typically caused by pathogenic microorganisms, such as bacteria, viruses, parasites or fungi. Infectious diseases can usually be spread, directly or indirectly, from one person to another. Infectious diseases to be treated in the context of the present invention preferably include viral, retroviral, bacterial or protozoological infectious diseases. Specific examples of infectious diseases to be treated in the context of the present invention include influenza, malaria, SARS, yellow fever, AIDS, Lyme borreliosis, leishmaniasis, anthrax, meningitis, viral infectious diseases, such as AIDS, condyloma acuminata, molluscum contagiosum, dengue fever, three-day fever, Ebola virus, colds, early summer meningoencephalitis (ESME), influenza, shingles, hepatitis, herpes simplex type I, herpes simplex type II, herpes zoster, influenza, Japanese encephalitis, Lassa fever, Marburg virus, measles, foot and mouth disease, mononucleosis, mumps, Norwalk virus infection, Pfeiffer's glandular fever, smallpox, polio (poliomyelitis), pseuodcroup, infectious erythema, rabies, warts, West Nile fever, chicken-pox, cytomegalovirus (CMV), bacterial infectious diseases, such as abortion (infectious, septic), prostatitis (prostate inflammation), anthrax, appendicitis (inflammation of the caecum), borreliosis, botulism, *Campylobacter*, *Chlamydia trachomatis* (inflammation of the urethra, conjunctiva), cholera, diphtheria, donavonosis, epiglottitis, louse-borne typhus, typhoid fever, gas gangrene, gonorrhoea, hare plague, Helicobacter pylori, whooping-cough, climatic bubo, osteomyelitis, legionnaires' disease, leprosy, listeriosis, pneumonia, meningitis, bacterial meningitis, anthrax, inflammation of the middle ear, *Mycoplasma hominis*, neonatal sepsis (chorioamnionitis), noma, paratyphoid fever, plague, Reiter's syndrome, Rocky Mountain spotted fever, *Salmonella paratyphoid* fever, *Salmonella typhoid* fever, scarlet fever, syphilis, tetanus, gonorrhoea, tsutsugamushi fever, tuberculosis, typhus, vaginitis (colpitis), soft chancre, and infectious diseases caused by parasites, protozoa or fungi, such as amoebic dysentery, bilharziosis, Chagas' disease, Echinococcus, fish tapeworm, ichthyotoxism (ciguatera), fox tapeworm, mycosis pedis, dog tapeworm, candiosis, ptyriasis, the itch (scabies), cutaneous leishmaniasis, lamblian dysentery (giadiasis), lice, malaria, onchocercosis (river blindness), fungal diseases, beef tapeworm, schistosomiasis, sleeping sickness, pork tapeworm, toxoplasmosis, trichomoniasis, trypanosomiasis (sleeping sickness), visceral leishmaniasis, nappy dermatitis, or infections caused by the dwarf tapeworm.

The term "cardiovascular disease" as used herein typically includes any disorders/diseases of the cardiovascular system. Specific examples of cardiovascular diseases include coronary heart disease, arteriosclerosis, apoplexy and hypertension. The term "neurological disease" as used herein typically includes disorders/diseases of the nervous system. Specific examples of neurological diseases include Alzheimer's disease, amyotrophic lateral sclerosis, dystonia, epilepsy, multiple sclerosis and Parkinson's disease.

The term "autoimmune disease" as used herein typically refers to a pathological state rising from an abnormal immune response of the body to substances and tissues that are normally present in the body. Specific examples of autoimmune diseases include autoimmune type I diseases or autoimmune type II diseases or autoimmune type III diseases or autoimmune type IV diseases, such as, for example, multiple sclerosis (MS), rheumatoid arthritis, diabetes, diabetes type I (diabetes mellitus), systemic lupus erythematosus (SLE), chronic polyarthritis, Basedow's disease, autoimmune forms of chronic hepatitis, colitis ulcerosa, allergy type I diseases, allergy type II diseases, allergy type III diseases, allergy type IV diseases, fibromyalgia, hair loss, Bechterew's disease, Crohn's disease, myasthenia gravis, neurodermatitis, polymyalgia rheumatica, progressive systemic sclerosis (PSS), psoriasis, Reiter's syndrome, rheumatic arthritis, psoriasis or vasculitis.

It is particularly preferred that the RNA, the combination of RNA's according to the present invention, the (pharmaceutical) composition, the (passive) vaccine or the kit according to the present invention may be used (for the preparation of a medicament) for the treatment (prophylaxis or therapy) of any disorder/disease, which is related to the antibody, or the fragment thereof, encoded by the RNA. Particularly preferably, the antibody is any of the antibodies listed in Table 11 below. In this case, it is most preferred that the disease, disorder or condition to be treated and/or prevented is any disease, disorder or condition related to the antibody, in particular as described in Table 11 below.

TABLE 11

Antibodies, their targets and diseases, disorders or conditions related to the antibodies.

| Antibody Name | Target | Related Disease, Disorder or Condition |
| --- | --- | --- |
| AAB-003 | Amyloid Beta Peptide; A beta P; Abeta; Beta Amyloid | Alzheimer's Disease |
| Abagovomab | Tumour Antigen; CA-125 | Epithelial Ovarian Cancer; Ovarian Cancer |
| Abciximab | Integrin Alpha 2b; GPalpha IIb; Platelet Membrane Glycoprotein IIb; CD41; ITGA2B | Ischemia; Percutaneous Coronary Intervention; Unstable Angina Myocardial Infarction; Myocardial Ischemia; Percutaneous Coronary Intervention; Unstable Angina |
| Abituzumab | Integrin Alpha V; Vitronectin Receptor Subunit Alpha; CD51; ITGAV | Interstitial Lung Diseases (Diffuse Parenchymal Lung Disease) Advanced Malignancy; Metastatic Cancer; Solid Tumor; Metastatic Colorectal Cancer; Metastatic Hormone Refractory (Castration Resistant; androgen-Independent) Prostate Cancer; Ovarian Cancer; Cancer |
| Abrilumab | Integrin Alpha 4; CD49 Antigen Like Family Member D; VLA4 Subunit Alpha; CD49d; ITGA4; Integrin Beta 7; Gut Homing Receptor Beta Subunit; ITGB7; integrin α4β7 | Crohn's Disease (Regional Enteritis); Ulcerative Colitis; Inflammatory Bowel Disease |
| Actoxumab | *Clostridium difficile* Toxin A; toxA; EC 3.4.22. | *Clostridium difficile* Infections (*Clostridium difficile* Associated Disease); *Clostridium difficile* Colitis |
| Adalimumab | Tumor Necrosis Factor; Cachectin; TNF Alpha; Tumor Necrosis Factor Ligand Superfamily Member 2; TNF a; TNF; TNFa; TNF-α | Intermediate Uveitis; Posterior Uveitis; Uveitis Crohn's Disease (Regional Enteritis); Ulcerative Colitis; Plaque Psoriasis (Psoriasis Vulgaris); Rheumatoid Arthritis; Ankylosing Spondylitis (Bekhterev's Disease); Polyarticular Juvenile Idiopathic Arthritis (PJIA); Crohn's Disease (Regional Enteritis); Psoriasis; Hidradenitis Suppurative; Axial Spondyloarthritis; Polyarticular Juvenile Idiopathic Arthritis (PJIA); Psoriatic Arthritis; Behcet Disease; Ulcerative Colitis; Polyarticular Juvenile Idiopathic Arthritis (PJIA); Interstitial Cystitis (Painful Bladder Syndrome); Ankylosing Spondylitis (Bekhterev's Disease); Axial Spondyloarthritis Spondyloarthritis (Spondyloarthropathy); Autoimmune Disease; Hemolytic disease of the newborn |
| Adrecizumab | Adrenomedullin | Septic Shock |
| Aducanumab | Amyloid Beta Peptide; A beta P; Abeta; Beta Amyloid | Alzheimer's Disease |
| Afasevikumab | Interleukin 17; IL17; IL17A; IL17F | Autoimmune Disorders |
| Aflibercept | Placenta Growth Factor; Vascular Endothelial Growth Factor Related Protein; PGF; Vascular Endothelial Growth Factor A; Vascular Permeability Factor; VEGFA; Vascular Endothelial Growth Factor B; VEGF Related Factor; VEGFB | Age Related Macular Degeneration; Branch Retinal Vein Occlusion; Central Retinal Vein Occlusion; Macular Edema; Wet (Neovascular/Exudative) Macular Degeneration; Choroidal Neovascularization; Myopia; Diabetic Macular Edema; Diabetic Retinopathy; Central Retinal Vein Occlusion; Macular Edema; Wet (Neovascular/Exudative) Macular Degeneration; Diabetic Macular Edema; Branch Retinal Vein Occlusion; Central Retinal Vein Occlusion; Choroidal Neovascularization; Macular Edema; Wet (Neovascular/Exudative) Macular Degeneration; Age Related Macular Degeneration; Central Retinal Vein Occlusion; Choroidal Neovascularization; Macular Edema; Wet (Neovascular/Exudative) Macular Degeneration; Branch Retinal Vein Occlusion; Central Retinal Vein Occlusion; Macular Edema; Wet (Neovascular/Exudative) Macular Degeneration; Branch Retinal Vein Occlusion; Central Retinal Vein Occlusion; Macular Edema; Wet (Neovascular/Exudative) Macular Degeneration; Branch Retinal Vein Occlusion; Central Retinal Vein Occlusion; Choroidal Neovascularization; Macular Edema; Myopia; Wet (Neovascular/Exudative) Macular Degeneration; Choroidal Neovascularization; Macular Edema; Wet (Neovascular/Exudative) Macular Degeneration; Age Related Macular Degeneration; Central Retinal Vein Occlusion; Choroidal Neovascularization; Macular Edema; Wet (Neovascular/Exudative) Macular Degeneration; Neovascular Glaucoma; Non-Proliferative Diabetic Retinopathy (NPDR); Optic Neuropathy; Retinopathy; Corneal Neovascularization |

TABLE 11-continued

Antibodies, their targets and diseases, disorders or conditions related to the antibodies.

| Antibody Name | Target | Related Disease, Disorder or Condition |
| --- | --- | --- |
| Afutuzumab, Obinutuzumab | B Lymphocyte Antigen CD20; B Lymphocyte Surface Antigen B1; Bp35; Leukocyte Surface Antigen Leu 16; Membrane Spanning 4 Domains Subfamily A Member 1; CD20; MS4A1 | Chronic Lymphocytic Leukemia (CLL); Follicular Lymphoma; Non-Hodgkin Lymphoma; Lupus Nephritis; Diffuse Large B-Cell Lymphoma; Follicular Lymphoma; Splenic Marginal Zone B-Cell Lymphoma; End-Stage Kidney Disease (End-Stage Renal Disease; ESRD); Graft Versus Host Disease (GVHD); Diffuse Large B-Cell Lymphoma; Follicular Lymphoma; Refractory Chronic Lymphocytic Leukemia (CLL); Relapsed Chronic Lymphocytic Leukemia (CLL) Waldenstrom Macroglobulinemia; Diffuse Large B-Cell Lymphoma; |
| Alacizumab, Alacizumab pegol | Vascular Endothelial Growth Factor Receptor 2; Fetal Liver Kinase I; Kinase Insert Domain Receptor; Protein Tyrosine Kinase Receptor flk 1; VEGFR2; CD309; KDR; EC 2.7.10.1 | Non-Small Cell Lung Cancer |
| Alemtuzumab | CAMPATH 1 Antigen; CDw52; Cambridge Pathology 1 Antigen; Epididymal Secretory Protein E5; Human Epididymis Specific Protein 5; CD52 | Progressive Relapsing Multiple Sclerosis (PRMS); Relapsing Remitting Multiple Sclerosis (RRMS); B-Cell Chronic Lymphocytic Leukemia; Peripheral T-Cell Lymphomas (PTCL); T-Cell Leukemia Graft Versus Host Disease (GVHD); B-Cell Chronic Lymphocytic Leukemia; Mycosis Fungoides; Sezary Syndrome Refractory Chronic Lymphocytic Leukemia (CLL); Relapsed Chronic Lymphocytic Leukemia (CLL); Multiple Sclerosis |
| Alirocumab | Proprotein Convertase Subtilisin/Kexin Type 9; Proprotein Convertase 9; Neural Apoptosis Regulated Convertase 1; Subtilisin/Kexin Like Protease PC9; PCSK9; EC 3.4.21. | Heterozygous familial hypercholesterolemia (heFH); Hypercholesterolemia; Mixed Dyslipidemia Familial Hypercholesterolemia (Type II Hyperlipoproteinemia); Hypercholesterolemia |
| ALX-0061, vobarilizumab | Interleukin 6 Receptor; IL6R | Rheumatoid Arthritis; Systemic Lupus Erythematosus |
| Amatuximab | Mesothelin; CAKI Antigen; Pre Pro Megakaryocyte Potentiating Factor; MSLN | Malignant Pleural Mesothelioma; Non-Small Cell Lung Cancer; Ovarian Cancer; Pancreatic Cancer |
| Andecaliximab | MMP9; matrix metallopeptidase 9 | Gastroesophageal Junction Adenocarcinoma; Gastric Adenocarcinoma |
| Anetumab, Anetumab ravtansine | Mesothelin; CAKI Antigen; Pre Pro Megakaryocyte Potentiating Factor; MSLN | Lung Adenocarcinoma; Malignant Pleural Mesothelioma Advanced Malignancy; Solid Tumor Bile Duct Cancer (Cholangiocarcinoma); Breast Cancer; Colon Cancer; Endometrial Cancer; Epithelial Ovarian Cancer; Fallopian Tube Cancer; Gastroesophageal (GE) Junction Carcinomas; Metastatic Pancreatic Cancer; Non-Small Cell Lung Cancer; Ovarian Cancer; Pancreatic Cancer; Peritoneal Cancer; Thymic Carcinoma; Uterine Cancer |
| Anifrolumab | Interferon Alpha/Beta Receptor 1; Cytokine Receptor Class II Member 1; Cytokine Receptor Family 2 Member 1; Type I Interferon Receptor 1; IFNAR1 | Systemic Lupus; Erythematosus Systemic Sclerosis (Scleroderma) |
| Anrukinzumab, IMA-638 | Interleukin 13; IL13 | Asthma; Ulcerative Colitis |
| Apolizumab | HLA-DR | Hodgkin Lymphoma (B-Cell Hodgkin Lymphoma); Acute Lymphocytic Leukemia (ALL; Acute Lymphoblastic Leukemia); Chronic Lymphocytic Leukemia (CLL); Non-Hodgkin Lymphoma; Hematological Cancers |
| Apomab | Death receptor 5; DR5/TNF-related apoptosis inducing ligand-receptor 2; TRAIL-R2. | Cancer |
| Aprutumab | FGFR2 | low blood neutrophils; Neutropenia; Febrile Neutropenia; Chemotherapy Induced Neutropenia; Acute Myelocytic Leukemia (AML; Acute Myeloblastic Leukemia) |
| Aquaporumab | Aquaporin-4; AQP4 | Acute and Chronic Management of Neuromyelitis Optica Spectrum Disorder |
| Arcitumomab | Carcinoembryonales Antigen; CEA | Diagnostic Imaging of Colorectal Cancers; Gastrointestinal Cancers (Diagnosis) |
| Ascrinvacumab | Serine/Threonine Protein Kinase Receptor R3; Activin Receptor Like Kinase 1; TGF B Superfamily Receptor Type I; ALK1; ACVRL1; EC 2.7.11.30 | Malignant Pleural Mesothelioma; Metastatic Colorectal Cancer; Transitional Cell Carcinoma (Urothelial Cell Carcinoma); Hepatocellular Carcinoma |
| Aselizumab | L-Selectin; CD62L | Chronic Lymphocytic Leukemia (CLL);; Chronic Obstructive Pulmonary Disease (COPD); Inflammatory Bowel Disease; Vaso-Occlusive Crisis Associated With Sickle Cell Disease |

TABLE 11-continued

Antibodies, their targets and diseases, disorders or conditions related to the antibodies.

| Antibody Name | Target | Related Disease, Disorder or Condition |
| --- | --- | --- |
| Atezolizumab | Programmed Cell Death I Ligand 1; PD L1; B7 Homolog 1; CD274 | Metastatic Transitional (Urothelial) Tract Cancer; Non-Small Cell Lung Cancer; Transitional Cell Carcinoma (Urothelial Cell Carcinoma) Bladder Cancer; Transitional Cell Carcinoma (Urothelial Cell Carcinoma) Epithelial Ovarian Cancer; Fallopian Tube Cancer; Metastatic Breast Cancer; Metastatic Colorectal Cancer; Metastatic Hormone Refractory (Castration Resistant; androgen-Independent) Prostate Cancer; Metastatic Melanoma; Muscle Invasive Bladder Cancer (MIBC); Non-Small Cell Lung Cancer; Peritoneal Cancer; Renal Cell Carcinoma; Small-Cell Lung Cancer; Squamous Non-Small Cell Lung Cancer Bladder Cancer; Breast Cancer; Muscle Invasive Bladder Cancer (MIBC); Non-Small Cell Lung Carcinoma; Renal Cell Carcinoma; Small-Cell Lung Cancer; Transitional Cell Cancer (Urothelial Cell Cancer) Cervical Cancer; Diffuse Large B-Cell Lymphoma; Follicular Lymphoma; Metastatic Colorectal Cancer; Non Muscle Invasive Bladder Cancer (NMIBC) (Superficial Bladder Cancer); Non-Small Cell Lung Cancer; Soft Tissue Sarcoma; Solid Tumor; Uterine Cancer Acute Myelocytic Leukemia (AML; Acute Myeloblastic Leukemia); Adenocarcinoma Of The Gastroesophageal Junction; Breast Cancer; Chronic Lymphocytic Leukemia (CLL); Diffuse Large B-Cell Lymphoma; Esophageal Cancer; Follicular Lymphoma; Gastric Cancer; Hepatocellular Carcinoma; Malignant Pleural Mesothelioma; Merkel Cell Carcinoma; Metastatic Melanoma; Metastatic Pancreatic Cancer; Multiple Myeloma (Kahler Disease); Myelodysplastic Syndrome; Nasopharyngeal Cancer; Neuroendocrine Gastroenteropancreatic Tumors (GEP-NET); Refractory Acute Myeloid Leukemia; Refractory Chronic Lymphocytic Leukemia (CLL); Relapsed Acute Myeloid Leukemia; Relapsed Chronic Lymphocytic Leukemia (CLL) |
| Atinumab | Reticulon 4; Human NogoA; Neurite Outgrowth Inhibitor; Foocen; Neuroendocrine Specific Protein; Neuroendocrine Specific Protein C Homolog; RTN x; Reticulon 5; RTN4 | Acute Spinal Cord Injury |
| Atlizumab, Tocilizumab | IL6 receptor | rheumatoid arthritis; Crohn's disease; multiple myeloma and the lymphoproliferative disorder giant lymph node hyperplasia (Castleman's disease). |
| Aurograb | *Staphylococcus aureus* | Methicillin-Resistant *Staphylococcus aureus* (MRSA) Infections |
| Avelumab | Programmed Cell Death 1 Ligand 1; PD L1; B7 Homolog 1; CD274 | Merkel Cell Carcinoma; Metastatic Transitional (Urothelial) Tract Cancer; Bladder Cancer; Diffuse Large B-Cell Lymphoma; Epithelial Ovarian Cancer; Fallopian Tube Cancer; Gastric Cancer; Gastroesophageal (GE) Junction Carcinomas; Head and Neck Cancer Squamous Cell Carcinoma; Metastatic Renal Cell Carcinoma; Metastatic Transitional (Urothelial) Tract Cancer; Non-Small Cell Lung Cancer; Ovarian Cancer; Peritoneal Cancer Choriocarcinoma (Gestational Trophoblastic Neoplasia); Epithelial Ovarian Cancer; Fallopian Tube Cancer; Peritoneal Cancer; Thymic Carcinoma; Thymoma (Thymic Epithelial Tumor) Adenocarcinoma Of The Gastroesophageal Junction; Gastric Cancer Adrenocortical Carcinoma (Adrenal Cortex Cancer); Breast Cancer; Endometrial Cancer; Fallopian Tube Cancer; Glioblastoma Multiforme (GBM); Head and Neck Cancer Squamous Cell Carcinoma; Hodgkin Lymphoma (B-Cell Hodgkin Lymphoma); Hormone Refractory (Castration Resistant; androgen-Independent) Prostate Cancer; Malignant Mesothelioma; Melanoma; Metastatic Cancer; Metastatic Colorectal Cancer; Nasopharyngeal Cancer; Osteosarcoma; Peritoneal Cancer; Renal Cell Carcinoma; Solid Tumor Leiomyosarcoma; Liposarcoma; Refractory Acute Myeloid Leukemia; Relapsed Acute Myeloid Leukemia |
| Azintuxizumab | SLAMF7 | Multiple Myeloma (Kahler Disease); Refractory Multiple Myeloma; Relapsed Multiple Myeloma; B-Cell Chronic Lymphocytic Leukemia |
| Bapineuzumab | Amyloid Beth Peptide; A beta P; Abeta; Beta Amyloid | Alzheimer's Disease |
| Basiliximab | Interleukin 2 Receptor Subunit Alpha; TAC Antigen; p55; CD25; IL2RA | Inflammatory Bowel Disease; Ulcerative Colitis; Uveitis; Kidney Transplant Rejection |
| Bavituximab | Phosphatidylserine | Hepatocellular Carcinoma Adenocarcinoma; Rectal Cancer Ebolavirus Infections (Ebola Hemorrhagic Fever); Hemorrhagic Fever; Unspecified Influenza Virus Infections Hepatitis C Melanoma; Metastatic Breast Cancer; Non-Small Cell Lung Cancer; Pancreatic Cancer Hormone Refractory (Castration Resistant; androgen-Independent) Prostate Cancer; Non-Small Cell Lung Cancer |

TABLE 11-continued

Antibodies, their targets and diseases, disorders or conditions related to the antibodies.

| Antibody Name | Target | Related Disease, Disorder or Condition |
|---|---|---|
| Begelomab | Dipeptidyl Peptidase 4; ADABP; Adenosine Deaminase Complexing Protein 2; T Cell Activation Antigen CD26; TP103; CD26; DPP4; EC 3.4.14.5 | Graft Versus Host Disease (GVHD) |
| Belimumab | Tumor Necrosis Factor Ligand Superfamily Member 13B; B Lymphocyte Stimulator; Dendritic Cell Derived TNF Like Molecule; TNF and APOL Related Leukocyte Expressed Ligand 1; CD257; TNFSF13B | Systemic Lupus Erythematosus; Polymyositis/Idiopathic Inflammatory Myopathy; Microscopic Polyangiitis (MPA); Anti-Neutrophil Cytoplasmic Antibody-Associated Vasculitis (ANCA Vasculitis); Granulomatosis with Polyangiitis (Wegener Polyangiitis); Lupus Nephritis; Membranous Glomerulonephritis; Kidney Transplant Rejection; Myasthenia Gravis; Sicca Syndrome (Sjogren); Systemic Sclerosis (Scleroderma); Idiopathic Thrombocytopenic Purpura (Immune Thrombocytopenic Purpura); Rheumatoid Arthritis Waldenstrom Macroglobulinemia |
| Benralizumab | Interleukin 5 Receptor Subunit Alpha; IL 5 Receptor Subunit Alpha; CDw125; CD125; IL5RA | Asthma Chronic Obstructive Pulmonary Disease (COPD); Rhinosinusitis; Hypereosinophilic Syndrome; Granulomatosis with Polyangiitis (Wegener Polyangiitis) |
| Bertilimumab | Eotaxin; C-C Motif Chemokine II; Eosinophil Chemotactic Protein; Small Inducible Cytokine A11; CCL11 | Atopic Dermatitis; Bullous Pemphigoid; Crohn's Disease (Regional Enteritis); Non-Alcoholic Steatohepatitis; Ulcerative Colitis; Atopic Keratoconjunctivitis; Vernal Keratoconjunctivitis; Wet (Neovascular/Exudative) Macular Degeneration; Primary Sclerosing Cholangitis; Psoriasis; Asthma; |
| Betalutin | Leukocyte Antigen CD37; Tetraspanin 26; CD37 | Follicular Lymphoma; Mantle Cell Lymphoma; Marginal Zone B-cell Lymphoma; Diffuse Large B-Cell Lymphoma |
| Bevacizumab, Bevacizumab beta, Bevacizumab-rhuMAb-VEGF, Bevacituzuab | Vascular endothelial growth factor; VEGF; VEGF-A | Breast Cancer; Cervical Cancer; Epithelial Ovarian Cancer; Fallopian Tube Cancer; Metastatic Ovarian Cancer; Metastatic Renal Cell Carcinoma; Peritoneal Cancer Colorectal Cancer; Metastatic Breast Cancer; Non-Small Cell Lung Cancer; Glioma; Renal Cell Carcinoma Colorectal Cancer; Metastatic Breast Cancer; Non-Small Cell Lung Cancer; Metastatic Colorectal Cancer; Ovarian Cancer; Cervical Cancer; Epithelial Ovarian Cancer; Fallopian Tube Cancer; Glioblastoma Multiforme (GBM); Metastatic Breast Cancer; Metastatic Colorectal Cancer; Metastatic Renal Cell Carcinoma; Non-Small Cell Lung Cancer; Peritoneal Cancer; Breast Cancer; Cervical Cancer; Colorectal Cancer; Glioblastoma Multiforme (GBM); Malignant Glioma; Non-Small Cell Lung Cancer; Ovarian Cancer Lung Cancer; Metastatic Colorectal Cancer; Cervical Cancer; Epithelial Ovarian Cancer; Fallopian Tube Cancer; Malignant Glioma; Metastatic Breast Cancer; Metastatic Colorectal Cancer; Metastatic Renal Cell Carcinoma; Non-Small Cell Lung Cancer; Peritoneal Cancer; Cervical Cancer; Epithelial Ovarian Cancer; Fallopian Tube Cancer; Metastatic Colorectal Cancer; Peritoneal Cancer; Metastatic Breast Cancer; Metastatic Renal Cell Carcinoma; Non-Small Cell Lung Cancer; Ovarian Cancer; Metastatic Breast Cancer; Metastatic Renal Cell Carcinoma; Non-Small Cell Lung Cancer; Fallopian Tube Cancer; Metastatic Breast Cancer; Metastatic Colorectal Cancer; Metastatic Renal Cell Carcinoma; Non-Small Cell Lung Cancer; Ovarian Cancer; Peritoneal Cancer; Glioma; Metastatic Breast Cancer; Non-Small Cell Lung Cancer; Cervical Cancer; Epithelial Ovarian Cancer; Fallopian Tube Cancer; Metastatic Colorectal Cancer; Peritoneal Cancer; Cervical Cancer; Epithelial Ovarian Cancer; Fallopian Tube Cancer; Metastatic Breast Cancer; Metastatic Colorectal Cancer; Metastatic Renal Cell Carcinoma; Non-Small Cell Lung Cancer; Peritoneal Cancer; Glioblastoma Multiforme (GBM); Malignant Pleural Mesothelioma; Metastatic Breast Cancer; Renal Cell Carcinoma; Neuroblastoma; Oligodendroglioma; Malignant Pleural Mesothelioma; Merkel Cell Carcinoma; Nasopharyngeal Cancer; Bladder Cancer; Chronic Lymphocytic Leukemia (CLL); Diffuse Large B-Cell Lymphoma; Metastatic Liver Cancer; Non-Rhabdomyosarcoma; Rhabdomyosarcoma; Small-Cell Lung Cancer; Gastrointestinal Tumor; Meningioma; Metastatic Melanoma; Metastatic Pancreatic Cancer; Refractory Multiple Myeloma; Relapsed Multiple Myeloma; Breast Cancer; Neuroendocrine Tumors; Non-Small Cell Lung Cancer; Cancer |
| Bezlotoxumab | *Clostridium difficile* Toxin B; toxB; EC 3.4.22. | *Clostridium difficile* Infections (*Clostridium difficile* Associated Disease) |
| Bimagrumab | Activin Receptor Type 2B; ACVR2B; EC 2.7.11.30 | Type 2 Diabetes; Bone Fracture; Sarcopenia; Cachexia; Cancer Anorexia-Cachexia Syndrome; Sporadic Inclusion Body Myositis (s-IBM) |
| Bimekizumab | Interleukin 17A; Cytotoxic T Lymphocyte Associated Antigen 8; CTLA8; IL17A; Interleukin 17F; Cytokine ML 1; IL17F | Ulcerative Colitis; Plaque Psoriasis (Psoriasis Vulgaris); Rheumatoid Arthritis; Ankylosing Spondylitis (Bekhterev's Disease); Psoriatic Arthritis |

TABLE 11-continued

Antibodies, their targets and diseases, disorders or conditions related to the antibodies.

| Antibody Name | Target | Related Disease, Disorder or Condition |
| --- | --- | --- |
| Bleselumab | Tumor Necrosis Factor Receptor Superfamily Member 5; B Cell Surface Antigen CD40; Bp50; CDw40; CD40L Receptor; TNFRSF5; CD40 | Kidney Transplant Rejection; Plaque Psoriasis (Psoriasis Vulgaris) |
| Blinatumomab, Blinatumumab | B Lymphocyte Antigen CD19; B Lymphocyte Surface Antigen B4; Differentiation Antigen CD19; T Cell Surface Antigen Lau 12; CD19; T Cell Surface Glycoprotein CD3 Epsilon Chain; T Cell Surface Antigen T3/Leu 4 Epsilon Chain; CD3E; CD3 | Acute Lymphocytic Leukemia (ALL; Acute Lymphoblastic Leukemia); Extranodal Marginal Zone B-Cell Lymphoma (Mucosa-Associated Lymphoid Tissue; MALT-Lymphoma); Follicular Lymphoma; Nodal Marginal Zone B-Cell Lymphoma; Splenic Marginal Zone B-Cell Lymphoma; Acute Lymphocytic Leukemia (ALL; Acute Lymphoblastic Leukemia); Diffuse Large B-Cell Lymphoma; B-Cell Chronic Lymphocytic Leukemia; Hairy Cell Leukemia; Mantle Cell Lymphoma; |
| Blontuvetmab | Beth 2 Glycoprotein 1; APC Inhibitor; Activated Protein C Binding Protein; Anticardiolipin Cofactor; Apolipoprotein H; APOH; Phosphatidylserine | Infectious Disease; Oncology |
| Blosozumab | Sclerostin; SOST | Post Menopausal Osteoporosis |
| Bococizumab | Proprotein Convertase Subtilisin/Kexin Type 9; Proprotein Convertase 9; Neural Apoptosis Regulated Convertase 1; Subtilisin/Kexin Like Protease PC9; PCSK9; EC 3.4.21. | Hyperlipidemia; Heterozygous familial hypercholesterolemia (heFH); Mixed Dyslipidemia; Atherosclerosis; Post Acute Coronary Syndrome |
| Brazikumab | Interleukin 23; IL23 | Crohn's Disease (Regional Enteritis); Psoriasis |
| Brentuximab, Brentuximab vedotin | Tumor Necrosis Factor Receptor Superfamily Member 8; CD30L Receptor; Ki 1 Antigen; Lymphocyte Activation Antigen CD30; CD30; TNFRSF8 | Hodgkin Lymphoma (B-Cell Hodgkin Lymphoma); Mycosis Fungoides; Anaplastic Large Cell Lymphoma (ALCL); Cutaneous T-Cell Lymphoma; Mycosis Fungoides; Hodgkin Lymphoma (B-Cell Hodgkin Lymphoma); T-Cell Lymphomas; Systemic Mastocytosis; Diffuse Large B-Cell Lymphoma; Mast Cell Leukemia; Systemic Lupus Erythematosus; Acute Lymphocytic Leukemia (ALL; Acute Lymphoblastic Leukemia); Acute Myelocytic Leukemia (AML; Acute Myeloblastic Leukemia); Anaplastic Large Cell Lymphoma (ALCL); Angioimmunoblastic T-Cell Lymphoma (AITL)/Immunoblastic Lymphadenopathy; Diffuse Large B-Cell Lymphoma; Hodgkin Lymphoma (B-Cell Hodgkin Lymphoma); Lymphoma; Mycosis Fungoides; Peripheral T-Cell Lymphomas (PTCL); Solid Tumor; T-Cell Leukemia; Malignant Mesothelioma; Graft Versus Host Disease (GVHD); Anaplastic Large Cell Lymphoma (ALCL); Hodgkin Lymphoma (B-Cell Hodgkin Lymphoma) |
| Briakinumab | Interleukin 12 Subunit Beta; Cytotoxic Lymphocyte Maturation Factor 40 kDa Subunit; CLMF p40; IL12 Subunit p40 NK Cell Stimulatory Factor Chain 2; IL12B | Multiple Sclerosis; Crohn's Disease (Regional Enteritis); Plaque Psoriasis (Psoriasis Vulgaris) |
| Brodalumab | Interleukin 17 Receptor; IL17R | Plaque Psoriasis (Psoriasis Vulgaris); Psoriatic Arthritis; Axial Spondyloarthritis; Crohn's Disease (Regional Enteritis); Rheumatoid Arthritis; Asthma |
| Brolucizumab | Vascular Endothelial Growth Factor A; Vascular Permeability Factor; VEGFA | Diabetic Macular Edema; Wet (Neovascular/Exudative) Macular Degeneration; Keloids; Rosacea; Kaposi Sarcoma; Glioblastoma Multiforme (GBM) |
| Brontictuzumab | Neurogenic Locus Notch Homolog Protein 1; Translocation Associated Notch Protein TAN 1; NOTCH1 | Adenoid Cystic Carcinoma (ACC); Bile Duct Cancer (Cholangiocarcinoma); Breast Cancer; Esophageal Cancer; Gastric Cancer; Metastatic Colorectal Cancer; Pancreatic Cancer; Small-Cell Lung Cancer; Solid Tumor; Hematological Tumor |
| BTT-ID23, Timolumab | Membrane Primary Amine Oxidase; Copper Amine Oxidase; Semicarbazide-Sensitive Amine Oxidase; Vascular Adhesion Protein 1; HPAO; ADO3; EC 1.4.3.21 | Primary Sclerosing Cholangitis; Inflammatory Bowel Disease; Neurology; Psoriasis; Rheumatoid Arthritis; Plaque Psoriasis (Psoriasis Vulgaris); Rheumatoid Arthritis |
| Burosumab | Fibroblast Growth Factor 23; Phosphatonin; Tumor Derived Hypophosphatemia Inducing Factor; FGF23 | X-Linked Hypophosphatemic Rickets; Osteomalacia |
| Cabiralizumab | Macrophage Colony Stimulating Factor 1 Receptor; CSF 1 Receptor; Proto Oncogene c Fms; CD115; CSFIR; EC 2.7.10.1 | Pigmented Villonodular Synovitis; Tenosynovial Giant Cell Tumor; Glioblastoma Multiforme (GBM); Head and Neck Cancer Squamous Cell Carcinoma; Melanoma; Non-Small Cell Lung Cancer; Ovarian Cancer; Pancreatic Cancer; Renal Cell Carcinoma; Colorectal Cancer; Rheumatoid Arthritis |

TABLE 11-continued

Antibodies, their targets and diseases, disorders or conditions related to the antibodies.

| Antibody Name | Target | Related Disease, Disorder or Condition |
|---|---|---|
| Camrelizumab | PDCD1 | Solid tumours Breast cancer Melanoma |
| Canakinumab | Interleukin 1 Beta; IL 1 Beta; Catabolin; IL1B | Cryopyrin-Associated Periodic Syndromes; Familial Cold Autoinflammatory Syndrome (Familial Cold Urticaria); Mevalonate Kinase Deficiency (Hyperimmunoglobulin D Syndrome (HIDS)); Muckle-Wells Syndrome; Tumor Necrosis Factor Receptor-Associated Periodic Syndrome (Familial Hibernian Fever); Systemic Idiopathic Juvenile Arthritis; Cryopyrin-Associated Periodic Syndromes; Familial Cold Autoinflammatory Syndrome (Familial Cold Urticaria); Muckle-Wells Syndrome; Tumor Necrosis Factor Receptor-Associated Periodic Syndrome (Familial Hibernian Fever); Familial Mediterranean Fever; Familial Cold Autoinflammatory Syndrome (Familial Cold Urticaria); Muckle-Wells Syndrome; Neonatal Onset Multisystem Inflammatory Disease; Systemic Idiopathic Juvenile Arthritis; Cryopyrin-Associated Periodic Syndromes; Familial Cold Autoinflammatory Syndrome (Familial Cold Urticaria); Muckle-Wells Syndrome; Neonatal Onset Multisystem Inflammatory Disease; Cryopyrin-Associated Periodic Syndromes; Familial Cold Autoinflammatory Syndrome (Familial Cold Urticaria); Muckle-Wells Syndrome; Neonatal Onset Multisystem Inflammatory Disease; Cryopyrin-Associated Periodic Syndromes; Familial Cold Autoinflammatory Syndrome (Familial Cold Urticaria); Muckle-Wells Syndrome; Neonatal Onset Multisystem Inflammatory Disease; Cryopyrin-Associated Periodic Syndromes; Familial Cold Autoinflammatory Syndrome (Familial Cold Urticaria); Muckle-Wells Syndrome; Gouty Arthritis (Gout); Cryopyrin-Associated Periodic Syndromes; Familial Cold Autoinflammatory Syndrome (Familial Cold Urticaria); Muckle-Wells Syndrome; Neonatal Onset Multisystem Inflammatory Disease; Cryopyrin-Associated Periodic Syndromes; Familial Cold Autoinflammatory Syndrome (Familial Cold Urticaria); Muckle-Wells Syndrome Systemic Idiopathic Juvenile Arthritis; Mevalonate Kinase Deficiency (Hyperimmunoglobulin D Syndrome (HIDS)); Tumor Necrosis Factor Receptor-Associated Periodic Syndrome (Familial Hibernian Fever); Familial Mediterranean Fever; Systemic Idiopathic Juvenile Arthritis; Cardiovascular Risk Factors; Behcet Disease; Peripheral Arterial Disease (PAD)/Peripheral Vascular Disease (PVD); Sarcoidosis; Pain; Abdominal Aortic Aneurysms; Polymyalgia Rheumatica; Mucocutaneous Lymph Node Syndrome (Kawasaki Disease); Choroidal Neovascularization; Keratoconjunctivitis sicca (Dry Eye); Chronic Obstructive Pulmonary Disease (COPD); Vasculitis; Rheumatoid Arthritis; Type I Diabetes (Juvenile Diabetes); Type 2 Diabetes; Gouty Arthritis (Gout) |
| Cantuzumab, Cantuzumab mertansine | CanAg antigen; Mucin CanAg | Colorectal Cancer; Gastric Cancer; Non-Small Cell Lung Cancer; Pancreatic Cancer |
| Cantuzumab, Cantuzumab ravtansine | CanAg antigen; MUCI | Colorectal Cancer; Gastric Cancer; Gastroesophageal (GE) Junction Carcinomas; Non-Small Cell Lung Cancer; Pancreatic Cancer; Solid Tumor |
| Caplacizumab | Von Willebrand Factor; VWF | Thrombotic Thrombocytopenic Purpura; Acute Coronary Syndrome |
| Carlumab | C-C chemokine ligand 2 | Inflammatory Bowel Disease; Ovarian Cancer; Solid Tumor; Metastatic Hormone Refractory (Castration Resistant; androgen-Independent) Prostate Cancer; Pancreatic Cancer; Idiopathic Pulmonary Fibrosis |
| Catumaxomab | CD3; Epithelial Cell Adhesion Molecule; Adenocarcinoma Associated Antigen; Cell Surface Glycoprotein Trop 1; Epithelial Cell Surface Antigen; Epithelial Glycoprotein 314; KS ¼ Antigen; KSA; Tumor Associated Calcium Signal Transducer 1; CD326; EPCAM | Ascites; Adenocarcinoma Of The Gastroesophageal Junction; Peritoneal Cancer; Epithelial Ovarian Cancer; Epithelial Tumor |
| Cergutuzumab, Cergutuzumab amunaleukin | Interleukin 2 Receptor; IL2R | Solid Tumor |
| Certolizumab, Certolizumab pegol | Tumor Necrosis Factor; Cachectin; TNF Alpha; Tumor Necrosis Factor Ligand Superfamily Member 2; TNF a; TNF | Rheumatoid Arthritis; Ankylosing Spondylitis (Bekhterev's Disease); Axial Spondyloarthritis; Psoriatic Arthritis; Plaque Psoriasis (Psoriasis Vulgaris); Crohn's Disease (Regional Enteritis) |

TABLE 11-continued

Antibodies, their targets and diseases, disorders or conditions related to the antibodies.

| Antibody Name | Target | Related Disease, Disorder or Condition |
|---|---|---|
| Cetuximab, Erbitux | Epidermal Growth Factor Receptor; Proto Oncogene c ErbB 1; Receptor Tyrosine Protein Kinase erbB 1; HER1; ERBB1; EGFR; EC 2.7.10.1 | Head and Neck Cancer Squamous Cell Carcinoma; Metastatic Colorectal Cancer; Recurrent Head and Neck Cancer Squamous Cell Carcinoma; Metastatic Colorectal Cancer; Chronic Pain; Neuropathic Pain; Adenocarcinoma Of The Gastroesophageal Junction; Gastric Cancer; Metastatic Biliary Tract Cancer; Prostate Cancer; Fallopian Tube Cancer; Metastatic Pancreatic Cancer; Ovarian Cancer; Peritoneal Cancer; Non-Small Cell Lung Cancer; Pancreatic Cancer; Metastatic Breast Cancer; Non-Small Cell Lung Cancer; Squamous Cell Carcinoma |
| Citatuzumab, Citatuzumab bogatox | Epithelial Cell Adhesion Molecule; Adenocarcinoma Associated Antigen; Cell Surface Glycoprotein Trop 1; Epithelial Cell Surface Antigen; Epithelial Glycoprotein 314; KS ¼ Antigen; KSA; Tumor Associated Calcium Signal Transducer 1; CD326; EPCAM | Solid Tumor |
| Cixutumumab | Insulin Like Growth Factor 1 Receptor; CD221; IGFIR; EC 2.7.10.1 | Carcinomas; Colon Cancer; Rectal Cancer; Advanced Malignancy; Ewing Sarcoma; Head and Neck Cancer Squamous Cell Carcinoma; Hepatocellular Carcinoma; Islet Cell Carcinoma (Insulinoma); Leiomyosarcoma; Metastatic Breast Cancer; Metastatic Colorectal Cancer; Metastatic Hepatocellular Carcinoma (HCC); Metastatic Hormone Refractory (Castration Resistant; androgen-Independent) Prostate Cancer; Metastatic Pancreatic Cancer; Neuroendocrine Tumors; Non-Small Cell Lung Cancer; Primitive Neuroectodermal Tumor (PNET); Rhabdomyosarcoma; Sarcomas; Soft Tissue Sarcoma |
| Clazakizumab | Interleukin 6; B Cell Stimulatory Factor 2; BSF2; CTL Differentiation Factor; CDF; Hybridoma Growth Factor; Interferon Beta 2; IFNB2; IL6 | Rheumatoid Arthritis; Psoriatic Arthritis; Fatigue; Crohn's Disease (Regional Enteritis); Oral Mucositis; Anemia; Graft Versus Host Disease (GVHD); Cancer Anorexia-Cachexia Syndrome |
| Clivatuzumab, Clivatuzumab tetraxetan, Yttrium (90Y) clivatuzumab tetraxetan | Mucin 1; Breast Carcinoma Associated Antigen DF3; Episialin; H23AG; Krebs Von Den Lungen 6; PEMT: Peanut Reactive Urinary Mucin; Polymorphic Epithelial Mucin; Tumor Associated Epithelial Membrane Antigen; Tumor Associated Mucin; CD227; MUC1 | Metastatic Pancreatic Cancer; Pancreatic Cancer |
| Codrituzumab | Glypican 3; Heparan Sulphate Proteoglycan; Intestinal Protein DCI 5; GTR2 2; MXR7; GPC3 | Metastatic Hepatocellular Carcinoma (HCC) |
| Coltuximab ravtansine | B Lymphocyte Antigen CD19; B Lymphocyte Surface Antigen B4; Differentiation Antigen CD19; T Cell Surface Antigen Leu 12; CD19 | Acute Lymphocytic Leukemia (ALL; Acute Lymphoblastic Leukemia); Diffuse Large B-Cell Lymphoma |
| Conatumumab | Tumor Necrosis Factor Receptor Superfamily Member 10B; Death Receptor 5; TNF Related Apoptosis Inducing Ligand Receptor 2; TRAIL Receptor 2; DRS; CD262; TNFRSF108 | Colorectal Cancer; Lymphoma; Metastatic Cancer; Metastatic Colorectal Cancer; Metastatic Pancreatic Cancer; Neuroendocrine Tumors; Non-Hodgkin Lymphoma; Non-Small Cell Lung Cancer; Sarcomas; Soft Tissue Sarcoma; Solid Tumor; Non-Small Cell Lung Cancer; Solid Tumor |
| Concizumab | Tissue Factor Pathway Inhibitor; Extrinsic Pathway Inhibitor; EPI; Lipoprotein Associated Coagulation Inhibitor; LACI; TFPI | Hemophilia A; Hemophilia B |
| Cosfroviximab | Ebolavirus glycoprotein | Ebola virus infections |
| Crenezumab | Amylaid Beta Peptide; A beta P; Abate; Beta Amyloid | Alzheimer's Disease |
| Crizanlizumab | P Selectin; CD62 Antigen Like Family Member P; Granule Membrane Protein 140; Leukocyte Endothelial Cell Adhesion Molecule 3; LECAM3; Platelet Activation Dependent Granule External Membrane Protein; CD62P; SELP | Vaso-Occlusive Crisis Associated With Sickle Cell Disease; Sickle Cell Disease |
| Crotedumab | Glucagon Receptor; GL R; GCGR | Type 2 Diabetes |
| Dacetuzumab | Tumor Necrosis Factor Receptor Superfamily Member 5; B Cell Surface Antigen CD40; Bp50; CDw40; CD40L Receptor; TNFRSF5; CD40 | Multiple Myeloma (Kehler Disease); Chronic Lymphocytic Leukemia (CLL); Diffuse Large B-Cell Lymphoma; B-Cell Non-Hodgkin Lymphoma |
| Dacliximab | Interleukin 2 Receptor Subunit Alpha; TAC Antigen; p55; CD25; IL2RA | Relapsing Remitting Multiple Sclerosis (RRMS); Ulcerative Colitis; Kidney Transplant Rejection |
| Daclizumab | Interleukin 2 Receptor Subunit Alpha; TAC Antigen; p55; CD25; IL2RA | Relapsing Remitting Multiple Sclerosis (RRMS); Ulcerative Colitis; Kidney Transplant Rejection |
| Dalotuzumab | Insulin Like Growth Factor I Receptor; CD221; IGFIR; EC 2.7.10.1 | Metastatic Breast Cancer; Pancreatic Cancer; Metastatic Colorectal Cancer; Multiple Myeloma (Kehler Disease); Neuroendocrine Tumors; Non-Small Cell Lung Cancer |
| Dapirolizumab, Dapirolizumab pegal | CD40 Ligand; T Cell Antigen Gp39; TNF Related Activation Protein; Tumor Necrosis Factor Ligand Superfamily Member 5; CD154; CD40LG; CD40L | Amyotrophic Lateral Sclerosis; Systemic Lupus Erythematosus |

TABLE 11-continued

Antibodies, their targets and diseases, disorders or conditions related to the antibodies.

| Antibody Name | Target | Related Disease, Disorder or Condition |
| --- | --- | --- |
| Daratumumab | ADP Ribosyl Cyclase/Cyclic ADP Ribose Hydrolase 1; Cyclic ADP Ribose Hydrolase 1; T10; 2' Phospho ADP Ribosyl Cyclase/2' Phospho Cyclic ADP Ribose Transferase; ADP Ribosyl Cyclase 1; CD3B; EC 3.2.2.6; EC 2.4.99.20 | Multiple Myeloma (Kehler Disease); Refractory Multiple Myeloma; Amyloidosis; Diffuse Large B-Cell Lymphoma; Follicular Lymphoma; Mantle Cell Lymphoma; Myelodysplastic Syndrome; Non-Small Cell Lung Cancer; Multiple Myeloma (Kehler Disease); Natural Killer Cell Lymphomas; Refractory Acute Myeloid Leukemia; Relapsed Acute Myeloid Leukemia; T-Cell Lymphomas; Refractory Multiple Myeloma; Relapsed Multiple Myeloma; Acute Lymphocytic Leukemia (ALL; Acute Lymphoblastic Leukemia); Chronic Lymphocytic Leukemia (CLL); Prostate Cancer |
| Dectrekumab | Interleukin 13; IL13; | Lymphedema; Asthma; Eosinophilic Esophagitis; Anal Fistula; Asthma; Idiopathic Pulmonary Fibrosis; Pulmonary Fibrosis; Seasonal Allergic Rhinitis |
| Demcizumab | Delta Like Protein 4; Delta Like Ligand 4; *Drosophila* Delta Homolog 4; DLL4 | Fallopian Tube Cancer; Non-Small Cell Lung Cancer; Ovarian Cancer; Pancreatic Ductal Adenocarcinoma; Peritoneal Cancer; Metastatic Colorectal Cancer; Solid Tumor; Breast Cancer; Colon Cancer |
| Denintuzumab, Denintuzumab mafodotin | Expressing B Lymphocyte Antigen CD19; B Lymphocyte Surface Antigen B4; Differentiation Antigen CD19; T Cell Surface Antigen Leu 12; CD19 | Burkitt Lymphoma; Acute Lymphocytic Leukemia (ALL; Acute Lymphoblastic Leukemia); B-Cell Non-Hodgkin Lymphoma; Lymphoblastic Lymphoma; Mantle Cell Lymphoma; Follicular Lymphoma; Diffuse Large B-Cell Lymphoma |
| Denosumab | Tumor Necrosis Factor Ligand Superfamily Member II; Receptor Activator Of Nuclear Factor Kappa B Ligand; Osteoclast Differentiation Factor; TNF Related Activation Induced Cytokine; Osteoprotegerin Ligand; CD254; TNFSF11 | Humoral Hypercalcemia of Malignancy; Bone Metastasis; Giant Cell Tumor Of Bone; Humoral Hypercalcemia of Malignancy; Osteoporosis; Post Menopausal Osteoporosis; Chemotherapy Effects; Rheumatoid Arthritis; Osteogenesis Imperfecta; Bone Disorders; Bone Metastasis; Glucocorticoid-Induced Osteoporosis; Non-Small Cell Lung Cancer; Breast Cancer; Osteoarthritis; Metastatic Breast Cancer |
| Depatuxizumab, Depatuxizumab mafodotin | Epidermal Growth Factor Receptor; Proto Oncogene c ErbB 1; Receptor Tyrosine Protein Kinase erbB1; HER1; ERBB1; EGFR; EC 2.7.10.1 | Glioma; Colorectal Cancer; Glioblastoma Multiforme (GBM); Head and Neck Cancer Squamous Cell Carcinoma; Non-Small Cell Lung Cancer; Solid Tumor |
| Derlotuximab, Iodine (131I) derlotuximab biotin | histone complex | Glioma; Anaplastic Astrocytoma; Glioblastoma Multiforme (GBM) |
| Dezamizumab | Serum Amyloid Protein; SAP | Amyloidosis |
| Dinutuximab | Ganglioside GD2 | Neuroblastoma; Osteosarcoma |
| Dinutuximabbeta | Ganglioside GD2 | Neuroblastoma |
| Diridavumab | Hemagglutinin | Influenza A Virus; H5N1 Subtype Infections; Pandemic Influenza |
| Domagrozumab | Growth/Differentiation Factor 8; Myostatin; GDF8; MSTN | Duchenne Muscular Dystrophy; Muscular Dystrophy; Becker Muscular Dystrophy |
| Drozitumab, Drozituab | Tumor Necrosis Factor Receptor Superfamily Member 10B; Death Receptor 5; TNF Related Apoptosis Inducing Ligand Receptor 2; TRAIL Receptor 2; DR5; CD262; TNFRSF10B | Non-Small Cell Lung Cancer; Follicular Lymphoma; Colorectal Cancer; Lymphoma; Non-Hodgkin Lymphoma; Chondrosarcoma; Metastatic Colorectal Cancer; Cancer |
| Duligotuzumab, Duligotumab | Epidermal Growth Factor Receptor; Proto Oncogene c ErbB 1; Receptor Tyrosine Protein Kinase erbB 1; HER1; ERBB1; EGFR; EC 2.7.10.1; Receptor Tyrosine Protein Kinase ERBB 3; Proto Oncogene Like Protein c ErbB 3; Tyrosine Kinase Type Cell Surface Receptor HER3; HER3; ERBB3; EC 2.7.10.1 | Non-Small Cell Lung Cancer; Epithelial Tumor; Metastatic Colorectal Cancer; Recurrent Head and Neck Cancer; Squamous Cell Carcinoma; Testicular Cancer |
| Dupilumab | Interleukin 4 Receptor Subunit Alpha; CD124; IL4R | Atopic Dermatitis; Nasal Polyposis; Sinusitis; Asthma; Eosinophilic Esophagitis; Food Allergy |

TABLE 11-continued

Antibodies, their targets and diseases, disorders or conditions related to the antibodies.

| Antibody Name | Target | Related Disease, Disorder or Condition |
|---|---|---|
| Durvalumab | Programmed Cell Death 1 Ligand 1; PD L1; B7 Homolog 1; CD274 | Bladder Cancer; Metastatic Transitional (Urothelial) Tract Cancer; Head and Neck Cancer Squamous Cell Carcinoma; Non-Small Cell Lung Cancer; Recurrent Head and Neck Cancer Squamous Cell Carcinoma; Acute Myelocytic Leukemia (AML; Acute Myeloblastic Leukemia); Adenocarcinoma Of The Gastroesophageal Junction; B-Cell Chronic Lymphocytic Leukemia; Diffuse Large B-Cell Lymphoma; Esophageal Cancer; Follicular Lymphoma; Gastric Cancer; Germ Cell Tumors; Glioblastoma Multiforme (GBM); Hepatocellular Carcinoma; Hodgkin Lymphoma (B-Cell Hodgkin Lymphoma); Lymphoma; Malignant Pleural Mesothelioma; Mantle Cell Lymphoma; Metastatic Breast Cancer; Metastatic Colorectal Cancer; Metastatic Renal Cell Carcinoma; Multiple Myeloma (Kahler Disease); Myelodysplastic Syndrome; Ovarian Cancer; Pancreatic Ductal Adenocarcinoma; Papillary Renal Cell Carcinoma; Refractory Multiple Myeloma; Relapsed Multiple Myeloma; Small-Cell Lung Cancer; Ureter Cancer; Urethral Cancer; Urinary Tract Cancer; B-Cell Non-Hodgkin Lymphoma; Cervical Cancer; Endometrial Cancer; Melanoma; Metastatic Biliary Tract Cancer; Multiple Myeloma (Kahler Disease); Muscle Invasive Bladder Cancer (MIBC); Myelodysplastic Syndrome; T-Cell Lymphomas Metastatic Hormone Refractory (Castration Resistant; androgen-Independent) Prostate Cancer; Mycosis Fungoides; Ovarian Cancer; Post-Essential Thrombocythemia Myelofibrosis (Post-ET MF); Post-Polycythemia Vera Myelofibrosis (PPV-MF); Sezary Syndrome; Soft Tissue Sarcoma; Non-Small Cell Lung Cancer; Advanced Malignancy; Solid Tumor; Muscle Invasive Bladder Cancer (MIBC) |
| Dusigitumab | Insulin Like Growth Factor I; Mechano Growth Factor; Somatomedin C; IGF1; Insulin Like Growth Factor II; Somatomedin A; T3M II Derived Growth Factor; IGF2 | Hormone Sensitive Breast Cancer; Metastatic Breast Cancer; Advanced Malignancy; Solid Tumor; Metastatic Hepatocellular Carcinoma (HCC) |
| Duvortuxizumab (JNJ-B4052781) | B Lymphocyte Antigen CD19; B Lymphocyte Surface Antigen B4; Differentiation Antigen CD19; T Cell Surface Antigen Lou 12; CD19; CD3 | Follicular Lymphoma; B-Cell Chronic Lymphocytic Leukemia; Acute Lymphocytic Leukemia (ALL; Acute Lymphoblastic Leukemia); Diffuse Large B-Cell Lymphoma; Mantle Cell Lymphoma |
| Ecromeximab | Ganglioside GD3 | Metastatic Melanoma |
| Eculizumab, Erlizuab | Complement C5; C3 and PLP Like Alpha 2 Macroglobulin Domain Containing Protein 4; C5 | Atypical Hemolytic Uremic Syndrome (Nondiarrhea-Associated Hemolytic Uremic Syndrome); Paroxysmal Nocturnal Hemoglobinuria; Myasthenia Gravis; Neuromyelitis Optica (Devic's Syndrome); Membranoproliferative Glomerulonephritis (Mesangiocapillary Glomerulonephritis); Acquired (Autoimmune) Hemolytic Anemia; Membraneproliferative Glomerulonephritis Type II (Dense Deposit Disease); Transplant Rejection; Vasculitis; Rheumatoid Arthritis; Dermatomyositis; Dry (Atrophic) Macular Degeneration; Allergic Asthma; Kidney Transplant Rejection; Typical Hemolytic Uremic Syndrome (Shiga-Toxin Associated Hemolytic Uremic Syndrome); Atypical HUS |
| Efalizumab | Integrin Alpha L; CDH Antigen Like Family Member A; Leukocyte Adhesion Glycoprotein LFA 1Alpha Chain; CDIIa; ITGAL | Plaque Psoriasis (Psoriasis Vulgaris); Kidney Transplant Rejection; Rheumatoid Arthritis |
| Efungumab | Fungal Hsp90 | Candida infection |
| Eldelumab | C—X—C Motif Chemokine 10; 10 kDa Interferon Gamma Induced Protein; Small Inducible Cytokine B10; Gamma IP10; CXCL10 | Crohn's Disease (Regional Enteritis); Ulcerative Colitis; Rheumatoid Arthritis |
| Elezanumab | Repulsive Guidance Molecule-a; RGMA: | Multiple Sclerosis |
| Elgemtumab | Receptor Tyrosine Protein Kinase ERBB 3; Proto Oncogene Like Protein c ErbB 3; Tyrosine Kinase Type Cell Surface Receptor HER3; HER3; ERBB3; EC 2.7.10.1 | Esophageal Cancer; Squamous Cell Carcinoma; Gastric Cancer; Metastatic Breast Cancer; Recurrent Head and Neck Cancer Squamous Cell Carcinoma |
| Elotuzumab | LOIXC Monoclonal antibodies | Refractory Multiple Myeloma; Relapsed Multiple Myeloma; Multiple Myeloma (Kehler Disease) |
| Emactuzumab | Macrophage Colony Stimulating Factor 1 Receptor; CSF 1 Receptor; Proto Oncogene c Fms; CD115; CSFIR; EC 2.7.10.1 | Pigmented Villonodular Synovitis; Bladder Cancer; Colorectal Cancer; Endometrial Cancer; Fallopian Tube Cancer; Gastric Cancer; Malignant Mesothelioma; Melanoma; Metastatic Breast Cancer; Metastatic Ovarian Cancer; Pancreatic Cancer; Soft Tissue Sarcoma; Tenosynovial Giant Cell Tumor |
| Emapalumab (N1-0501) | IFNG | hemophagocytic lymphohistiocytosis |

TABLE 11-continued

Antibodies, their targets and diseases, disorders or conditions related to the antibodies.

| Antibody Name | Target | Related Disease, Disorder or Condition |
|---|---|---|
| Emibetuzumab | Hepatocyte Growth Factor Receptor; Proto Oncogene c Met; Tyrosine Protein Kinase Met; HGF/SF Receptor; Scatter Factor Receptor; MET; EC 2.7.10.1 | Adenocarcinoma Of The Gastroesophageal Junction; Gastric Cancer; Metastatic Hepatocellular Carcinoma (HCC); Metastatic Renal Cell Carcinoma; Non-Small Cell Lung Cancer; Bone Metastasis; Lymphoma; Metastatic Hormone Refractory (Castration Resistant; androgen-Independent) Prostate Cancer; Metastatic Uveal Melanoma; Multiple Myeloma (Kehler Disease) |
| Emicizumab | Coagulation Factor IX; Christmas Factor; Plasma Thromboplastin Component; F9; EC 3.4.21.22; Coagulation Factor X; Stuart Prower Factor; Stuart Factor; F10; EC 3.4.21.6 | Hemophilia A |
| Enavatuzumab | Tumor Necrosis Factor Receptor Superfamily Member 12A; TWEAK Receptor; Fibroblast Growth Factor Inducible Immediate Early Response Protein 14; CD266; TNFRSF12A | Solid Tumor |
| Enfortumab, Enfortumab vedotin | Nectin 4; Ig Superfamily Receptor LNIR; Poliovirus Receptor Related Protein 4; Nectin Cell Adhesion Molecule 4; PVRL4; NECTIN4 | Metastatic Transitional (Urothelial) Tract Cancer; Non-Small Cell Lung Cancer; Metastatic Breast Cancer; Solid Tumor |
| Enlimomab, Enlimomab pegol | Intercellular Adhesion Molecule 1; Major Group Rhinovirus Receptor; CD54; ICAM1 | Stroke |
| Enoblituzumab | CD276 Antigen; B7 Homolog 3; 4Ig B7 H3; Costimulatory Molecule; CD276 | Bladder Cancer; Breast Cancer; Childhood Rhabdomyosarcoma; Colon Cancer; Ewing Sarcoma; Head and Neck Cancer; Head and Neck Cancer Squamous Cell Carcinoma; Malignant Mesothelioma; Metastatic Melanoma; Metastatic Transitional (Urothelial) Tract Cancer; Neuroblastoma; Non-Small Cell Lung Cancer; Osteosarcoma; Ovarian Cancer; Pancreatic Cancer; Primitive Neuroectodermal Tumor (PNET); Prostate Cancer; Renal Cell Carcinoma; Rhabdomyosarcoma; Soft Tissue Sarcoma; Squamous Non-Small Cell Lung Cancer; Thyroid Cancer; Wilms' Tumor (Nephroblastoma) |
| Enokizumab | Interleukin 9; Cytokine P40; T Cell Growth Factor P40; IL9 | Allergic Asthma |
| Enoticumab | Delta Like Protein 4; Delta Like Ligand 4; *Drosophila* Delta Homolog 4; DLL4 | Advanced Malignancy; Solid Tumor |
| Ensituximab | Mucin 5AC; Gastric Mucin; Lewis B Blood Group Antigen; Major Airway Glycoprotein; Tracheobronchial Mucin; MUC5AC | Metastatic Colorectal Cancer; Metastatic Pancreatic Cancer |
| Entolimod | Toll Like Receptor 5; Toll/Interleukin 1 Receptor Like Protein 3; TLR5 | Adenoid Squamous Cell Carcinoma (Pseudoglandular Squamous Cell Carcinoma); Head and Neck Cancer Squamous Cell Carcinoma; Metastatic Liver Cancer; Uveal Melanoma; Radiation Toxicity (Radiation Sickness; Acute Radiation Syndrome); Colorectal Cancer |
| Epratuzumab, Yttrium (Y90) epratuzumab tetraxetan | B Cell Receptor CD22; B Lymphocyte Cell Adhesion Molecule; Sialic Acid Binding Ig Like Lectin 2; T Cell Surface Antigen Lau 14; CD22 | Acute Lymphocytic Leukemia (ALL; Acute Lymphoblastic Leukemia); Non-Hodgkin Lymphoma; Diffuse Large B-Cell Lymphoma; Follicular Lymphoma; Waldenstrom Macroglobulinemia; Sicca Syndrome (Sjogren); Systemic Lupus Erythematosus |
| Eptacog beta | Coagulation Factor VII; Proconvertin; Serum Prothrombin Conversion Accelerator; SPCA; Eptacog Alfa; F7; EC 3.4.21.21 | Congenital Hemophilia A; Congenital Hemophilia B; Hemophilia |
| Eptinezumab | Calcitonin Gene Related Peptide; CGRP | Migraine |
| Erenumab | Calcitonin Gene Related Peptide Type I Receptor; Calcitonin Receptor Like Receptor; CALCRL | Migraine; Stable Angina; Vasomotor Symptoms of Menopause (Hot Flashes) |
| Ertumaxomab | Receptor Tyrosine Protein Kinase ERBB 2; Metastatic Lymph Node Gene 19 Protein; Proto Oncogene Neu; Proto Oncogene C ErbB 2; Tyrosine Kinase Type Cell Surface Receptor HER2; pI85erbB2; HER2; CD340; ERBB2; EC 2.7.10.1; T Cell Surface Glycoprotein CD3 Epsilon Chain; T Cell Surface Antigen T3/Leu 4 Epsilon Chain; CD3E | Solid Tumor |
| Etaracizumab | Integrin Alpha V; Vitronectin Receptor Subunit Alpha; CD51; ITGAV; Integrin Beta 3; Platelet Membrane Glycoprotein IIIa; CD61; ITGB3 | Colorectal Cancer; Metastatic Hormone Refractory (Castration Resistant; androgen-Independent) Prostate Cancer; Metastatic Melanoma; Psoriasis; Rheumatoid Arthritis |
| Etrolizumab, Etrolizuab | Integrin Beta 7; Gut Homing Receptor Beta Subunit; ITGB7; integrin α7 β7 | Hemophilia A; Hemophilia B; Crohn's Disease (Regional Enteritis); Ulcerative Colitis; Inflammatory Bowel Disease |
| Evinacumab | Angiopoietin Related Protein 3; Angiopoietin 5; Angiopoietin Like Protein 3; ANG 5; ANGPTL3 | Homozygous Familial Hypercholesterolemia (HoFH); Hyperlipidemia |
| Evolocumab | Proprotein Convertase Subtilisin/Kexin Type 9; Proprotein Convertase 9; Neural Apoptosis Regulated Convertase 1; Subtilisin/Kexin Like Protease PC9; PCSK9; EC 3.4.21. | Familial Hypercholesterolemia (Type II Hyperlipoproteinemia); Hypercholesterolemia Atherosclerosis Heterozygous familial hypercholesterolemia (heFH); Homozygous Familial Hypercholesterolemia (HoFH); Hypercholesterolemia |

TABLE 11-continued

Antibodies, their targets and diseases, disorders or conditions related to the antibodies.

| Antibody Name | Target | Related Disease, Disorder or Condition |
|---|---|---|
| Exbivirumab | Hepatitis B Virus Surface Antigen; HBsAg | Hepatitis B |
| Exenatide | Glucagon Like Peptide 1 Receptor; GLPIR | Obesity; Type 2 Diabetes |
| Faralimomab | Interferon Alpha/Beta Receptor 1; Cytokine Receptor Class II Member 1; Cytokine Receptor Family 2 Member 1; Type 1 Interferon Receptor 1; IFNAR1 | Rheumatoid Arthritis; Systemic Lupus Erythematosus |
| Farletuzumab | Folate Receptor Alpha; Adult Folate Binding Protein; Folate Receptor 1; KB Cells FBP; Ovarian Tumor Associated Antigen MDv18; FOLR1 | Lung Adenocarcinoma; Ovarian Cancer; Pituitary Tumor |
| Fasinumab | Beta Nerve Growth Factor; Beta NGF; NGF | Low Back Pain; Osteoarthritis Pain; Chronic Pancreatitis Pain; Sciatic Pain; Vertebral Fracture Pain |
| Ferritizumab | Ferritin | Non-Small Cell Lung Cancer; Pancreatic Cancer |
| Fezakinumab | Interleukin 22; Cytokine Zcyto18; IL 10 Related T Cell Derived Inducible Factor; IL22 | Psoriasis; Rheumatoid Arthritis |
| FG-3019, Pamrevlumab | Connective Tissue Growth Factor; CCN Family Member 2; Hypertrophic Chondrocyte Specific Protein 24; Insulin Like Growth Factor Binding Protein 8; IGFBP8; CTGF | Duchenne Muscular Dystrophy; Pancreatic Ductal Adenocarcinoma; Idiopathic Pulmonary Fibrosis; Liver Fibrosis; Focal Segmental Glomerulosclerosis (FSGS); Microalbuminuria; Proteinuria; Systemic Sclerosis (Scleroderma); Diabetic Nephropathy; Type 1 Diabetes (Juvenile Diabetes); Type 2 Diabetes |
| Fibatuzumab | EPHA3; ephrin receptor A3 | Glioblastoma Multiforme (GBM); Solid Tumor; Myelofibrosis; Myelodysplastic Syndrome; Multiple Myeloma (Kehler Disease); Acute Lymphocytic Leukemia (ALL; Acute Lymphoblastic Leukemia); Acute Myelocytic Leukemia (AML; Acute Myeloblastic Leukemia); Chronic Lymphocytic Leukemia (CLL); Chronic Myelocytic Leukemia (CML; Chronic Myeloid Leukemia); Myeloproliferative Disorders |
| Ficlatuzumab | Hepatocyte Growth Factor Receptor; Proto Oncogene c Met; Tyrosine Protein Kinase Met; HGF/SF Receptor; Scatter Factor Receptor; MET; EC 2.7.10.1 | Nasopharyngeal Cancer; Recurrent Head and Neck Cancer Squamous Cell Carcinoma; Refractory Acute Myeloid Leukemia; Relapsed Acute Myeloid Leukemia; Esophageal Cancer; Gastric Cancer; Head and Neck Cancer Squamous Cell Carcinoma; Hodgkin Lymphoma (B-Cell Hodgkin Lymphoma); Hypopharyngeal Cancer; Laryngeal Cancer; Metastatic Breast Cancer; Metastatic Colorectal Cancer; Metastatic Pancreatic Cancer; Multiple Myeloma (Kehler Disease); Non-Hodgkin Lymphoma; Oral Cavity (Mouth) Cancer; Oropharyngeal Cancer; Non-Small Cell Lung Cancer |
| Figitumumab | Insulin Like Growth Factor 1 Receptor; CD221; IGF1R; EC 2.7.10.1 | Adenocarcinoma; Breast Cancer; Colon Cancer; Multiple Myeloma (Kehler Disease); Rectal Cancer; Breast Cancer; Ewing Sarcoma; Gastrointestinal Tract Cancer; Hormone-Sensitive Prostate Cancer; Non-Small Cell Lung Cancer; Small-Cell Lung Cancer; Urinary Tract Cancer |
| Firivumab | Hemagglutinin | Unspecified Influenza Virus Infections |
| Flanvotumab | 5,6 Dihydroxyindole 2 Carboxylic Acid Oxidase; Glycoprotein 75; Melanoma Antigen gp75; Tyrosinase Related Protein 1; Catalase B; TYRP1; EC 1.14.18. | Melanoma |
| Fletikumab | Interleukin 20; Cytokine Zcyto10; IL20 | Psoriasis; Rheumatoid Arthritis |
| Fontolizumab | Interferon Gamma; Immune Interferon; IFNG | Colitis; Crohn's Disease (Regional Enteritis); Rheumatoid Arthritis |
| Foralumab | T Cell Surface Glycoprotein CD3 Epsilon Chain; T Cell Surface Antigen T3/Leu 4 Epsilon Chain; CD3E | Crohn's Disease (Regional Enteritis); Autoimmune Disorders; Kidney Transplant Rejection; Inflammatory Bowel Disease; Non-Alcoholic Steatohepatitis; Type 1 Diabetes (Juvenile Diabetes) |
| Foravirumab | Rabies Virus Glycoprotein | Rabies |
| Fremanezumab | Calcitonin Gene Related Peptide; CGRP | Cluster Headache Syndrome; Migraine; Vasomotor Symptoms of Menopause (Hot Flashes) |
| Fresolimumab | Transforming Growth Factor Beta 1; TGFB1; Transforming Growth Factor Beta 2; BSC1Cell Growth Inhibitor; Cetermin; Glioblastoma Derived T Cell Suppressor Factor; Polyergin; TGFB2; Transforming Growth Factor Beta 3; TGFB3 | Non-Small Cell Lung Cancer; Osteogenesis Imperfecta; Glioma; Melanoma; Renal Cell Carcinoma; Solid Tumor; Idiopathic Pulmonary Fibrosis; Focal Segmental Glomerulosclerosis (FSGS) |
| Frunevetmab | *Mus musculus* nerve growth factor; Felis catus-Rattus norvegicus monoclonal NV-02 heavy chain; disulfide with Felis catus-Rattus norvegicus monoclonal NV-02 light chain; dimer | Control of Osteoarthritis Pain in Cats |
| Fulranumab | Beta Nerve Growth Factor; Beta NGF; NGF | Pain; Chronic Visceral Pain; Diabetic Neuropathic Pain; Low Back Pain; Postherpetic Neuralgia; Interstitial Cystitis (Painful Bladder Syndrome); Cancer Pain; Osteoarthritis Pain |

TABLE 11-continued

Antibodies, their targets and diseases, disorders or conditions related to the antibodies.

| Antibody Name | Target | Related Disease, Disorder or Condition |
| --- | --- | --- |
| Futuximab | Epidermal Growth Factor Receptor; Proto Oncogene c ErbB1; Receptor Tyrosine Protein Kinase erbB1; HER1; ERBB1; EGFR; EC 2.7.10.1 | Glioblastoma Multiforme (GBM); Metastatic Colorectal Cancer; Recurrent Head and Neck Cancer Squamous Cell Carcinoma; Squamous Non-Small Cell Lung Cancer; Esophageal Cancer; Solid Tumor |
| Galcanezumab | Calcitonin Gene Related Peptide; CGRP | Cluster Headache Syndrome; Migraine; Osteoarthritis Pain |
| Galiximab, Goilixiab | T Lymphocyte Activation Antigen CD80; Activation B7-1 Antigen; CTLA 4 Counter Receptor B7.1; CD80 | Autoimmune Disorders; Inflammation; Psoriasis; Rheumatoid Arthritis; Follicular Lymphoma; B-cell Lymphoma |
| Ganitumab | Insulin Like Growth Factor 1 Receptor; CD221; IGFIR; EC 2.7.10.1 | Breast Cancer; Neuroendocrine Tumors; Ovarian Cancer; Ewing Sarcoma; Metastatic Breast Cancer; Metastatic Colorectal Cancer; Non-Hodgkin Lymphoma; Small-Cell Lung Cancer; Soft Tissue Sarcoma; Squamous Non-Small Cell Lung Cancer; Metastatic Adenocarcinoma of The Pancreas; Metastatic Pancreatic Cancer |
| Gantenerumab | Amyloid Beta Peptide; A beta P; Abeta; Beta Amyloid | Alzheimer's Disease |
| Gatipotuzumab | *Homo sapiens* MUC1; mucin 1; polymorphic epithelial mucin; PEM; episialin; CD227 tumor antigen TA-MUC1 conformational epitope O-glycosylated on the threonine of the immunodominant PDTRP motif of the tandem repeats | |
| Gavilimomab | Basigin; Collagenase Stimulatory Factor; Extracellular Matrix Metalloproteinase Inducer; Leukocyte Activation Antigen M6; OK Blood Group Antigen; Tumor Cell Derived Collagenase Stimulatory Factor; CD147; BSG | Graft Versus Host Disease (GVHD) |
| Gedivumab | Influenza A virus hemagglutinin HA | Influenza disease; |
| Gemetuzumab, Gemtuzumab ozogamicin, Gemtuzumab | Myeloid Cell Surface Antigen CD33; Sialic Acid Binding Ig Like Lectin 3; gp67; CD33 | Acute Myelocytic Leukemia (AML) |
| Gerilimzumab | Interleukin 6; B Cell Stimulatory Factor 2; BSF2; CTL Differentiation Factor; CDF; Hybridoma Growth Factor; Interferon Beta 2; IFNB2; IL6 | Autoimmune Disorders; Inflammation; Rheumatoid Arthritis |
| Gevokizumab | Interleukin 1 Beta; IL 1 Beta; Catabolin; IL1B | Acute Coronary Syndrome; Behcet Disease; Giant Cell Arteritis; Schnitzler Syndrome; Dermatomyositis; Polymyositis; Uveitis; Behcet Disease; Acne Vulgaris; Skin Inflammation; Autoimmune Disorders; Rheumatoid Arthritis; Diabetic Nephropathy; Type 2 Diabetes; Type 1 Diabetes (Juvenile Diabetes); Gouty Arthritis (Gout); Osteoarthritis; Systemic Idiopathic Juvenile Arthritis; Multiple Myeloma (Kehler Disease); Anterior Uveitis; Intermediate Uveitis; Posterior Uveitis; Uveitis; Scleritis |
| Gilvetmab | Canis familiaris PDCD1 | Antineoplastic; Immunotherapy (Veterinary) |
| Gimsilumab | Granulocyte Macrophage Colony Stimulating Factor; GMCSF; Colony Stimulating Factor; CSF; Molgramostin; Sargramostim; CSF2 | Rheumatoid Arthritis |
| Girentuximab, Iodine (124I) girentuximab | Carbonic Anhydrase 9; Carbonate Dehydratase IX; pMW1; Membrane Antigen MN; P54/58N; Renal Cell Carcinoma Associated Antigen G250; CA9; EC 4.2.1.1; CA-IX | Renal Cell Carcinoma |
| Glembatumumab vedotin | Transmembrane Glycoprotein NMB; Transmembrane Glycoprotein HGFIN; GPNMB | Lung Cancer; Osteosarcoma; Metastatic Uveal Melanoma; Metastatic Breast Cancer; Metastatic Melanoma; Squamous Non-Small Cell Lung Cancer |
| Glunomab | Glutamate Receptor Ionotropic NMDA 1; Glutamate [NMDA] Receptor Subunit Zeta 1; N Methyl D Aspartate Receptor Subunit NR1; GRIN1 | Multiple Sclerosis |
| Golimumab | Tumor Necrosis Factor; Cachectin; TNF Alpha; Tumor Necrosis Factor Ligand Superfamily Member 2; TNF a; TNF | Ulcerative Colitis; Ankylosing Spondylitis (Bekhterev's Disease); Axial Spondyloarthritis; Psoriatic Arthritis; Rheumatoid Arthritis; Ankylosing Spondylitis (Bekhterev's Disease); Psoriatic Arthritis; Systemic Idiopathic Juvenile Arthritis; Type 1 Diabetes (Juvenile Diabetes); Sarcoidosis; Systemic Idiopathic Juvenile Arthritis; Anterior Uveitis; Posterior Uveitis; Asthma |
| Guselkumab | Interleukin 23 Subunit Alpha; Interleukin 23 Subunit p19; IL23A | Plaque Psoriasis (Psoriasis Vulgaris); Psoriatic Arthritis; Rheumatoid Arthritis |
| HuMab IDF8 | IL8 | Inflammatory bowel disease and asthma |
| HuMab LC5002-002 | Interleukin 13 | Asthma; Atopic Dermatitis; Idiopathic Pulmonary Fibrosis; Pulmonary Fibrosis; Seasonal Allergic Rhinitis; Lymphedema; Ulcerative Colitis; Systemic Sclerosis (Scleroderma); Allergies |

TABLE 11-continued

Antibodies, their targets and diseases, disorders or conditions related to the antibodies.

| Antibody Name | Target | Related Disease, Disorder or Condition |
|---|---|---|
| HuMab LC5002-003 | Interleukin 13 | Asthma; Atopic Dermatitis; Idiopathic Pulmonary Fibrosis; Pulmonary Fibrosis; Seasonal Allergic Rhinitis; Lymphedema; Ulcerative Colitis; Systemic Sclerosis (Scleroderma); Allergies |
| HuMab LC5002-005 | Interleukin 13 | Asthma; Atopic Dermatitis; Idiopathic Pulmonary Fibrosis; Pulmonary Fibrosis; Seasonal Allergic Rhinitis; Lymphedema; Ulcerative Colitis; Systemic Sclerosis (Scleroderma); Allergies |
| HuMab LC5002-007 | Interleukin 13 | Asthma; Atopic Dermatitis; Idiopathic Pulmonary Fibrosis; Pulmonary Fibrosis; Seasonal Allergic Rhinitis; Lymphedema; Ulcerative Colitis; Systemic Sclerosis (Scleroderma); Allergies |
| HuMab LC5002-018 | Interleukin 13 | Asthma; Atopic Dermatitis; Idiopathic Pulmonary Fibrosis; Pulmonary Fibrosis; Seasonal Allergic Rhinitis; Lymphedema; Ulcerative Colitis; Systemic Sclerosis (Scleroderma); Allergies |
| HuMab-708 | CD20 | Diseases associated with CD20 (including tumor-related diseases) and immune diseases (including autoimmune diseases) |
| huMAb-anti-MSP10.1 | merozoite surface protein 10; MSP-10 | Malaria; Plasmodium associate Diseases |
| huMAb-anti-MSP10.2 | merozoite surface protein 10; MSP-10 | Malaria; Plasmodium associate Diseases |
| HuMab-L612 | Ganglioside GM3 | metastatic melanoma |
| Ibalizumab | T Cell Surface Glycoprotein CD4; T Cell Surface Antigen T4/Leu 3; CD4 | Human Immunodeficiency Virus (HIV) Infections (AIDS) |
| Ibritumomab, Ibritumomab tiuxetan | B Lymphocyte Antigen CD20; B Lymphocyte Surface Antigen B1; Bp35; Leukocyte Surface Antigen Leu 16; Membrane Spanning 4 Domains Subfamily A Member 1; CD20; MS4A1 | Acute Lymphocytic Leukemia (ALL); Acute Myelocytic Leukemia (AML); Chronic Lymphocytic Leukemia (CLL); Chronic Myelocytic Leukemia (CML); Multiple Myeloma (Kahler Disease); Myeloproliferative Disorders; Colorectal Cancer; Gastric Cancer; Melanoma; Prostate Cancer; Myelodysplastic Syndrome; Myelofibrosis; Glioblastoma Multiforme (GBM); Solid Tumor; non-Hodgkin's Lymphoma |
| Icrucumab | Vascular Endothelial Growth Factor Receptor 1; Fms Like Tyrosine Kinase 1; Tyrosine Protein Kinase Receptor FLT; Tyrosine Protein Kinase FRT; Vascular Permeability Factor Receptor; VEGFR1; FLT1; EC 2.7.10.1 | Metastatic Breast Cancer; Metastatic Colorectal Cancer; Transitional Cell Carcinoma (Urothelial Cell Carcinoma) |
| Idarucizumab | Dabigatran; Pradaxa ® | Bleeding and Clotting Disorders |
| Ifabotuzumab | CD22 | Acute Lymphocytic Leukemia (ALL; Acute Lymphoblastic Leukemia); Acute Myelocytic Leukemia (AML; Acute Myeloblastic Leukemia); Chronic Lymphocytic Leukemia (CLL); Chronic Myelocytic Leukemia (CML; Chronic Myeloid Leukemia); Multiple Myeloma (Kahler Disease); Myeloproliferative Disorders; Colorectal Cancer; Gastric Cancer; Melanoma; Prostate Cancer; Myelodysplastic Syndrome; Myelofibrosis; Glioblastoma Multiforme (GBM); Solid Tumor |
| IGF-IR HUMAB-1A | Soluble extracellular domain of IGF-IR. | Tumor; Cancer |
| IGF-IR HUMAB-23 | Soluble extracellular domain of IGF-IR. | Tumor; Cancer |
| IGF-IR HUMAB-8 | Soluble extracellular domain of IGF-IR. | Tumor; Cancer |
| ImAb1 | IDH1R132H | Glioma |
| Imalumab | Macrophage Migration Inhibitory Factor; Glycosylation Inhibiting Factor; L Dopachrome Isomerase; L Dopachrome Tautomerase; Phenylpyruvate Tautomerase; MIF; EC 5.3.2.1; EC 5.3.3.12 | Metastatic Colorectal Cancer; Solid Tumor; Septic Shock; Multiple Sclerosis; Colitis; Glomerulonephritis; Lupus Nephritis; Diabetes; Arthritis; Malignant Ascites |
| Imgatuzumab | Epidermal Growth Factor Receptor; Proto Oncogene c ErbB 1; Receptor Tyrosine Protein Kinase erbB 1; HER1; ERBB1; EGFR; EC 2.7.10.1 | Head and Neck Cancer Squamous Cell Carcinoma; Metastatic Colorectal Cancer; Non-Small Cell Lung Cancer; Solid Tumor |
| Inclacumab | P Selectin; CD62 Antigen Like Family Member P; Granule Membrane Protein 140: Leukocyte Endothelial Cell Adhesion Molecule 3; LECAM3; Platelet Activation Dependent Granule External Membrane Protein; CD62P; SELP Inhibitor | Peripheral Arterial Disease (PAD)/ Peripheral Vascular Disease (PVD); Acute Coronary Syndrome; Myocardial Infarction; Percutaneous Coronary Intervention |
| Indatuximab, Indatuximab ravtansine | Syndecan I; CD138; SDC1 | Lung Cancer; Prostate Cancer; Head and Neck Cancer; Pancreatic Cancer; Breast Cancer; Bladder Cancer; Refractory Multiple Myeloma; Relapsed Multiple Myeloma |
| Indusatumab, Indusatumab vedotin | Heat Stable Enterotoxin Receptor; Guanylyl Cyclase C; or Intestinal Guanylate Cyclase; GUCY2C; EC 4.6.1.2 | Metastatic Colorectal Cancer; Adenocarcinoma Of The Gastroesophageal Junction; Gastric Cancer; Adenocarcinoma Of The Gastroesophageal Junction; Gastric Cancer; Metastatic Adenocarcinoma of The Pancreas |

TABLE 11-continued

Antibodies, their targets and diseases, disorders or conditions related to the antibodies.

| Antibody Name | Target | Related Disease, Disorder or Condition |
|---|---|---|
| Inebilizumab | Central Nervous System | Progressive Relapsing Multiple Sclerosis (PRMS); Relapsing Remitting Multiple Sclerosis (RRMS); Secondary Progressive Multiple Sclerosis (SPMS); Neuromyelitis Optica (Devic's Syndrome); Follicular Lymphoma; Mantle Cell Lymphoma; Non-Hodgkin Lymphoma; Follicular Lymphoma; Refractory Multiple Myeloma; Relapsed Multiple Myeloma; Multiple Myeloma (Kahler Disease); Systemic Sclerosis (Scleroderma); Diffuse Large B-Cell Lymphoma; Refractory Chronic Lymphocytic Leukemia (CLL); Relapsed Chronic Lymphocytic Leukemia (CLL) |
| Infliximab | Tumor Necrosis Factor; Cachectin; TNF Alpha; Tumor Necrosis Factor Ligand Superfamily Member 2; TNF a; TNF; TNFa | Crohn's Disease (Regional Enteritis); Ulcerative Colitis Plaque Psoriasis (Psoriasis Vulgaris); Psoriasis; Rheumatoid Arthritis Ankylosing Spondylitis (Bekhterev's Disease); Psoriatic Arthritis Behcet Disease Crohn's Disease (Regional Enteritis); Ulcerative Colitis Mucocutaneous Lymph Node Syndrome (Kawasaki Disease); Plaque Psoriasis (Psoriasis Vulgaris); Psoriasis; Rheumatoid Arthritis Giant Cell Arteritis Juvenile Rheumatoid Arthritis; Sarcoidosis Cancer Anorexia-Cachexia Syndrome Hepatitis C; Autoimmune Disease |
| Inolimomab | Interleukin 2 Receptor Subunit Alpha; TAC Antigen; p55; CD25; IL2RA | Graft Versus Host Disease (GVHD) |
| Insulin peglispro | Insulin Receptor; IR; CD220; INSR; EC 2.7.10.1 | Type 1 Diabetes (Juvenile Diabetes); Type 2 Diabetes |
| Interferon beta-1b | Interferon Alpha/Beta Receptor 1; Cytokine Receptor Class II Member 1; Cytokine Receptor Family 2 Member 1; Type I Interferon Receptor 1; IFNAR1; Interferon Alpha/Beta Receptor 2; Interferon Alpha Binding Protein; Type I Interferon Receptor 2; IFNAR2 | Alopecia; Demyelinating Diseases; Multiple Sclerosis; Relapsing Remitting Multiple Sclerosis (RRMS); Secondary Progressive Multiple Sclerosis (SPMS) |
| Intetumumab | Integrin Alpha V; Vitronectin Receptor Subunit Alpha; CD51; ITGAV; Integrin Beta 1; Fibronectin Receptor Subunit Beta; Glycoprotein IIa; VLA 4 Subunit Beta; CD29; ITGB1; Integrin Beta 3; Platelet Membrane Glycoprotein IIIa; CD61; ITGB3; Integrin Beta 5; ITGB5; Integrin Beta 6; ITGB6 | Angiosarcoma; Hormone Refractory (Castration Resistant; androgen-Independent) Prostate Cancer; Metastatic Melanoma; Melanoma |
| Ipilimumab | Cytotoxic T Lymphocyte Protein 4; Cytotoxic T Lymphocyte Associated Antigen 4; CD152; CTLA4 | Metastatic Melanoma; Head and Neck Cancer Squamous Cell Carcinoma; Metastatic Renal Cell Carcinoma; Non-Small Cell Lung Cancer Adenocarcinoma Of The Gastroesophageal Junction; Adrenal Gland Cancer; Gastric Cancer; Metastatic Liver Cancer; Metastatic Lung Cancer; Ovarian Cancer; Skin Cancer Chronic Myelocytic Leukemia (CML; Chronic Myeloid Leukemia); Hodgkin Lymphoma (B-Cell Hodgkin Lymphoma); Non-Hodgkin Lymphoma; Refractory Multiple Myeloma; Relapsed Multiple Myeloma Adenocarcinoma; Breast Cancer; Metastatic Adenocarcinoma of The Pancreas; Transitional Cell Cancer (Urothelial Cell Cancer); Metastatic Hormone Refractory (Castration Resistant; androgen-Independent); Prostate Cancer |
| Iratumumab | Tumor Necrosis Factor Receptor Superfamily Member 8; CD30L Receptor; Ki 1 Antigen; Lymphocyte Activation Antigen CD30; CD30; TNFRSF8 | Anaplastic Large Cell Lymphoma (ALCL); Hodgkin Lymphoma (B-Cell Hodgkin Lymphoma) |
| Isatuximab | ADP Ribosyl Cyclase/Cyclic ADP Ribose Hydrolase 1; Cyclic ADP Ribose Hydrolase 1; T10; 2' Phospho ADP Ribosyl Cyclase/2' Phospho Cyclic ADP Ribose Transferase; ADP Ribosyl Cyclase 1; CD38; EC 3.2.2.6; EC 2.4.99.20 | Refractory Multiple Myeloma; Relapsed Multiple Myeloma; Multiple Myeloma (Kahler Disease); Acute Lymphocytic Leukemia (ALL; Acute Lymphoblastic Leukemia); Acute Myelocytic Leukemia (AML; Acute Myeloblastic Leukemia); B-Cell Non-Hodgkin Lymphoma; Chronic Lymphocytic Leukemia (CLL) |
| Itolizumab | T Cell Differentiation Antigen CD6; T12; TP120; CD6 | Plaque Psoriasis (Psoriasis Vulgaris); Arthritis; Relapsing Remitting Multiple Sclerosis (RRMS); Rheumatoid Arthritis; Vitiligo; Psoriatic Arthritis |
| Ixekizumab | Interleukin 17A; Cytotoxic T Lymphocyte Associated Antigen 8; CTLA8; IL17A | Ankylosing Spondylitis (Bekhterev's Disease); Rheumatoid Arthritis; Plaque Psoriasis (Psoriasis Vulgaris); Psoriatic Arthritis; Axial Spondyloarthritis |
| Labetuzumab, Labetuzumab govitecan | Carcinoembryonic Antigen Related Cell Adhesion Molecule 5; Carcinoembryonic Antigen; CEA; Meconium Antigen 100; CD66e; CEACAM5 | Ovarian Cancer; Small-Cell Lung Cancer; Metastatic Colorectal Cancer; Colorectal Cancer |
| Lacnotuzumab | Macrophage Colony Stimulating Factor 1 Receptor; CSF 1 Receptor; Proto Oncogene c Fms; CD115; CSF1R; EC 2.7.10.1 | Pigmented Villonodular Synovitis; Tenosynovial Giant Cell Tumor; Glioblastoma Multiforme (GBM); Head and Neck Cancer Squamous Cell Carcinoma; Melanoma; Non-Small Cell Lung Cancer; Ovarian Cancer; Pancreatic Cancer; Renal Cell Carcinoma; Colorectal Cancer; Rheumatoid Arthritis |
| Lampalizumab | Complement Factor D; C3 Convertase Activator; Adipsin; Properdin Factor D; CFD; EC 3.4.21.46 | Dry (Atrophic) Macular Degeneration |

TABLE 11-continued

Antibodies, their targets and diseases, disorders or conditions related to the antibodies.

| Antibody Name | Target | Related Disease, Disorder or Condition |
|---|---|---|
| Lanadelumab | Kallikrein; EC 3.4.21. | Diabetic Macular Edema; Hereditary Angioedema (HAE) (C1 Esterase Inhibitor [C1-INH] Deficiency) |
| Landogrozumab | Growth/Differentiation Factor 8; Myostatin; GDF8; MSTN | Cancer Anorexia-Cachexia Syndrome; Muscle Atrophy |
| Laprituximab, Laprituximab emtansine | EGFR; epidermal growth factor receptor | |
| Larcaviximab | Ebolavirus glycoprotein | Ebola virus infections |
| Lebrikizumab | Interleukin 13; IL13 | Idiopathic Pulmonary Fibrosis; Atopic Dermatitis; Chronic Obstructive Pulmonary Disease (COPD); Idiopathic Pulmonary Fibrosis; Asthma |
| Lendalizumab | Complement 5; Anaphylatoxine; C5a; C5 Pr678-751];. | |
| Lenercept | Tumor Necrosis Factor Receptor Superfamily Member 1A; Tumor Necrosis Factor Receptor 1; Tumor Necrosis Factor Receptor Type I; p55; p60; CD120a; TNFRSF1A | Septic Shock; Multiple Sclerosis; Rheumatoid Arthritis; Sepsis; |
| Lenzilumab | Granulocyte Macrophage Colony Stimulating Factor; GMCSF; Colony Stimulating Factor; CSF; Molgramostin; Sargramostim; CSF2 | Leukemias Multiple Sclerosis Psoriasis Bone Cancer; Juvenile Myelomonocytic Leukemia (JMML) Chronic Obstructive Pulmonary Disease (COPD) Rheumatoid Arthritis Asthma |
| Lerdelimumab | Transforming Growth Factor Beta 2; BSC1 Cell Growth Inhibitor; Cetermin; Glioblastoma Derived T Cell Suppressor Factor; Polyergin; TGFB2 | Glaucoma Drainage Surgery |
| Lesofavumab | Influenza B virus hemagglutinin HA | Infectious Disease |
| Letolizumab | CD40 Ligand; T Cell Antigen Gp39; TNF Related Activation Protein; Tumor Necrosis Factor Ligand Superfamily Member 5; CD154; CD40LG | Idiopathic Thrombocytopenic Purpura (Immune Thrombocytopenic Purpura) |
| Lexatumumab | Tumor Necrosis Factor Receptor Superfamily Member 10B; Death Receptor 5; TNF Related Apoptosis Inducing Ligand Receptor 2; TRAIL Receptor 2; DR5; CD262; TNFRSF10B | Solid Tumor |
| Libivirumab | Hepatitis B Virus Surface Antigen; HBsAg | Hepatitis B |
| Lifastuzumab, Lifastuzumab vedotin | Sodium Dependent Phosphate Transport Protein 2B; Sodium Phosphate Transport Protein 2B; NaPi3b; Sodium/Phosphate Cotransporter 2B; NaPi 2b; Solute Carrier Family 34 Member 2; SLC34A2; phosphate-sodium co-transporter | Non-Small Cell Lung Cancer; Ovarian Cancer |
| Ligelizumab | Immunoglobulin E; IgE | Allergic Asthma; Chronic Urticaria; Hives; Atopic Dermatitis; Bullous Pemphigoid |
| Lilotomab, Betalutin, Lutetium (l77Lu) Lilotomab satetraxetan | Leukocyte Antigen CD37; Tetraspanin 26; CD37 | Diffuse Large B-Cell Lymphoma; Follicular Lymphoma; Mantle Cell Lymphoma; Marginal Zone B-cell Lymphoma |
| Lintuzumab, Actimab-A | Myeloid Cell Surface Antigen CD33; Sialic Acid Binding Ig Like Lectin 3; gp67; CD33 | Refractory Acute Myeloid Leukemia; Acute Myelocytic Leukemia (AML; Acute Myeloblastic Leukemia); Relapsed Acute Myeloid Leukemia |
| Lirilumab | Killer Cell Immunoglobulin Like Receptor 2DL1; CD158 Antigen Like Family Member A; MHC Class I NK Cell Receptor; CD158a; KIR2DL1 Antagonist; Killer Cell Immunoglobulin Like Receptor 2DL2; CD158 Antigen Like Family Member B1; MHC Class I NK Cell Receptor; Natural Killer Associated Transcript 6; CD158b1; KIR2DL2 Antagonist; Killer Cell Immunoglobulin Like Receptor 2DL3; MHC Class I NK Cell Receptor; Killer Inhibitory Receptor cl 2-3; Natural Killer Associated Transcript 2; CD158b2; KIR2DL3 Antagonist | Chronic Lymphocytic Leukemia (CLL); Gastrointestinal Tract Cancer; Head and Neck Cancer Squamous Cell Carcinoma; Hepatocellular Carcinoma; Melanoma; Myelodysplastic Syndrome; Non-Small Cell Lung Cancer; Refractory Acute Myeloid Leukemia; Refractory Chronic Lymphocytic Leukemia (CLL); Relapsed Acute Myeloid Leukemia; Relapsed Chronic Lymphocytic Leukemia (CLL); Chronic Myelocytic Leukemia (CML; Chronic Myeloid Leukemia); Hodgkin Lymphoma (B-Cell Hodgkin Lymphoma); Metastatic Hormone Refractory (Castration Resistant; androgen-Independent) Prostate Cancer; Non-Hodgkin Lymphoma; Refractory Multiple Myeloma; Relapsed Multiple Myeloma |
| Lodelcizumab | Proprotein Convertase Subtilisin/Kexin Type 9; Proprotein Convertase 9; Neural Apoptosis Regulated Convertase 1; Subtilisin/Kexin Like Protease PC9; PCSK9; EC 3.4.21. | Bacterial Sepsis; Inflammation; Hypercholesterolemia |
| Lokivetmab | Interleukin 31 | canine atopic dermatitis |
| Lorvotuzumab, Lorvotuzumab mertansine | Neural Cell Adhesion Molecule 1; Antigen Recognized By Monoclonal Antibody 5.1H11; CD56; NCAMI | Ovarian Cancer; Non-Small Cell Lung Cancer; Skin Cancer; Neuroendocrine Tumors; Small-Cell Lung Cancer; Neuroendocrine Carcinoma; Refractory Multiple Myeloma; Relapsed Multiple Myeloma |
| Losatuxizumab | Epidermal Growth Factor Receptor; Proto Oncogene c ErbB 1; Receptor Tyrosine Protein Kinase erbB 1; HER1; ERBB1; EGFR; EC 2.7.10.1 | Head and Neck Cancer Squamous Cell Carcinoma; Metastatic Colorectal Cancer; Non-Small Cell Lung Cancer; Solid Tumor |

TABLE 11-continued

Antibodies, their targets and diseases, disorders or conditions related to the antibodies.

| Antibody Name | Target | Related Disease, Disorder or Condition |
| --- | --- | --- |
| Lpathomab | Lysophosphatidic Acid; LPA | Neuropathic Pain; Traumatic Brain Injury; Chronic Pain; Postherpetic Neuralgia; Spinal Cord Injury Kidney Fibrosis Diabetic Neuropathy Pulmonary Fibrosis Chemotherapy Induced Peripheral Neuropathy Wet (Neovascular/Exudative) Macular Degeneration |
| Lucatumumab | CD40 Ligand; T Cell Antigen Gp39; TNF Related Activation Protein; Tumor Necrosis Factor Ligand Superfamily Member 5; CD154; CD40LG; Tumor Necrosis Factor Receptor Superfamily Member 5; B Cell Surface Antigen CD40; Bp50; CDw40; CD40L Receptor; TNFRSF5; CD40 | Follicular Lymphoma; Hematological Tumor; Multiple Myeloma (Kehler Disease); Non-Hodgkin Lymphoma; Chronic Lymphocytic Leukemia (CLL); Hodgkin Lymphoma (B-Cell Hodgkin Lymphoma) |
| Lulizumab | T Cell Specific Surface Glycoprotein CD28; TP44; CD28 | Sicca Syndrome (Sjogren); Systemic Lupus Erythematosus |
| Lulizumab pegol | T Cell Specific Surface Glycoprotein CD28; TP44; CD28 | Sicca Syndrome (Sjogren); Systemic Lupus Erythematosus |
| Lumiliximab | Low Affinity Immunoglobulin Epsilon Fc Receptor; BLAST 2; C Type Lectin Domain Family 4 Member J; Fc Epsilon RII; Immunoglobulin E Binding Factor; Lymphocyte IgE Receptor; CD23; FCER2 | Atopic Dermatitis Chronic Lymphocytic Leukemia (CLL) Allergic Asthma Allergic Rhinitis |
| Lumretuzumab | Receptor Tyrosine Protein Kinase ERBB 3; Proto Imogene Like Protein c ErbB 3; Tyrosine Kinase Type Cell Surface Receptor HER3; HER3; ERBB3; EC 2.7.10.1 | Metastatic Breast Cancer; Non-Small Cell Lung Cancer; Squamous Non-Small Cell Lung Cancer;; Colorectal Cancer; Head and Neck Cancer Squamous Cell Carcinoma; Non-Small Cell Lung Cancer |
| Lupartumab | HUMAN GPI-ANCHORED CELL SURFACE-ASSOCIATED PROTEIN C4.4A | Neoplastics |
| Lutikizumab | IL1A; interleukin 1 alpha and interleukin 1 beta; IL1B | Osteoarthritis (OA) |
| Mapatumumab | Tumor Necrosis Factor Receptor Superfamily Member 10A; Death Receptor 4; TNF Related Apoptosis Inducing Ligand Receptor 1; TRAIL Receptor 1; DR4; CD261; TNFRSF10A | Hepatocellular Carcinoma; Cervical Cancer; Non-Hodgkin Lymphoma; Non-Small Cell Lung Cancer; Refractory Multiple Myeloma; Relapsed Multiple Myeloma |
| Margetuximab | Receptor Tyrosine Protein Kinase ERBB 2; Metastatic Lymph Node Gene 19 Protein; Proto Oncogene Neu; Proto Oncogene C ErbB 2; Tyrosine Kinase Type Cell Surface Receptor HER2; p185erbB2; HER2; CD340; ERBB2; EC 2.7.10.1 | Metastatic Breast Cancer; Breast Cancer; Gastric Cancer; Gastroesophageal (GE) Junction Carcinomas; Colorectal Cancer; Esophageal Cancer; Head and Neck Cancer; Hepatocellular Carcinoma; Cervical Cancer; Non-Hodgkin Lymphoma; Non-Small Cell Lung Cancer; Refractory Multiple Myeloma; Relapsed Multiple Myeloma; Solid Tumor |
| Marzeptacog alfa | Coagulation Factor VII; Proconvertin; Serum Prothrombin Conversion Accelerator; SPCA; Eptacog Alfa; F7; EC 3.4.21.21 | Hemophilia A; Hemophilia B |
| Matuzumab | Epidermal Growth Factor Receptor; Proto Oncogene c ErbB 1; Receptor Tyrosine Protein Kinase erbB 1; HER1; ERBB1; EGFR; EC 2.7.10.1 | Lung Cancer; Ovarian Cancer; Non-Small Cell Lung Cancer; Non-Small Cell Lung Cancer; Esophageal Cancer; Gastric Cancer; Metastatic Colorectal Cancer |
| Mavrilimumab | Granulocyte Colony Stimulating Factor Receptor; CD114; GCSFR; CSF3R | Rheumatoid Arthritis |
| MDX-1303, Valortim | Anthrax Protective Antigen; pa | Anthrax |
| Mepolizumab | Interleukin 5; Eosinophil Differentiation Factor; B Cell Differentiation Factor 1; T Cell Replacing Factor; IL5 | Hypereosinophilic Syndrome; Nasal Polyps; Atopic Dermatitis; Asthma; Chronic Obstructive Pulmonary Disease (COPD); Churg-Strauss Syndrome; Hypereosinophilic Syndrome |
| Metelimumab | Transforming Growth Factor Beta 1; TGFB1 | Systemic Sclerosis (Scleroderma) |
| Milatuzumab | HLA Class II Histocompatibility Antigen Gamma Chain; HLA DR Antigens Associated Invariant Chain; 1a Antigen Associated Invariant Chain; p33; CD74 | B-Cell Non-Hodgkin Lymphoma; Systemic Lupus Erythematosus; Graft Versus Host Disease (GVHD); Chronic Lymphocytic Leukemia (CLL); Refractory Multiple Myeloma; Relapsed Multiple Myeloma |
| Mirvetuximab soravtansine | Folate Receptor Alpha; Adult Folate Binding Protein; Folate Receptor 1; KB Cells FBP; Ovarian Tumor Associated Antigen M0v18; FOLRI" | Metastatic Breast Cancer; Fallopian Tube Cancer; Epithelial Ovarian Cancer; Peritoneal Cancer; Renal Cell Carcinoma; Non-Small Cell Lung Cancer; Endometrial Cancer; Adenocarcinoma |
| Modotuximab | Epidermal Growth Factor Receptor; Proto Oncogene c ErbB 1; Receptor Tyrosine Protein Kinase erbB 1; HER1; ERBB1; EGFR; EC 2.7.10.1 | Esophageal Cancer; Solid Tumor; Glioblastoma Multiforme (GBM); Metastatic Colorectal Cancer; Recurrent Head and Neck Cancer Squamous Cell Carcinoma; Squamous Non-Small Cell Lung Cancer |
| Mogamulizumab | C-C Chemokine Receptor Type 4; K5-5; CD194; CCR4 | Allergic Rhinitis; Asthma; T-Cell Leukemia; T-Cell Lymphomas; Breast Cancer; Gastric Cancer; Non-Small Cell Lung Cancer; Solid Tumor; Cutaneous T-Cell Lymphoma; Peripheral T-Cell Lymphomas (PTCL); T-Cell Leukemia; T-Cell Lymphomas |

TABLE 11-continued

Antibodies, their targets and diseases, disorders or conditions related to the antibodies.

| Antibody Name | Target | Related Disease, Disorder or Condition |
|---|---|---|
| Monalizumab | NKG2 A/NKG2 B Type II Integral Membrane Protein; NK Cell Receptor A; NKG2 A/B Activating NK Receptor; CD159a; KLRC1 | Cervical Cancer; Chronic Lymphocytic Leukemia (CLL); Endometrial Cancer; Fallopian Tube Cancer; Ovarian Cancer; Peritoneal Cancer; Recurrent Head and Neck Cancer Squamous Cell Carcinoma; Refractory Chronic Lymphocytic Leukemia (CLL); Relapsed Chronic Lymphocytic Leukemia (CLL); Rheumatoid Arthritis; Oral Cavity (Mouth) Cancer; Squamous Cell Carcinoma |
| Motavizumab | Respiratory Syncytial Virus Fusion Protein; RSV F Protein | Respiratory Syncytial Virus (RSV) Infections |
| Moxetumomab, Moxetumomab pasudotox | B Cell Receptor CD22; B Lymphocyte Cell Adhesion Molecule; Sialic Acid Binding Ig Like Lectin 2; T Cell Surface Antigen Lau 14; CD22 | Hairy Cell Leukemia; Acute Lymphocytic Leukemia (ALL; Acute Lymphoblastic Leukemia); Follicular Lymphoma; Relapsed Chronic Lymphocytic Leukemia (CLL); Refractory Chronic Lymphocytic Leukemia (CLL); Diffuse Large B-Cell Lymphoma; B-Cell Non-Hodgkin Lymphoma; Mantle Cell Lymphoma |
| Muromonab-CD3 | T Cell Surface Glycoprotein CD3 Epsilon Chain; T Cell Surface Antigen T3/Leu 4 Epsilon Chain; CD3E | Heart Transplant Rejection; Kidney Transplant Rejection; Liver Transplant Rejection |
| Namilumab | Granulocyte Macrophage Colony Stimulating Factor; GMCSF; Colony Stimulating Factor; CSF; Molgramostin; Sargramostim; CSF2 | Rheumatoid Arthritis; Plaque Psoriasis (Psoriasis Vulgaris) |
| Naptumomab estafenatox | Trophoblast Glycoprotein; M6P1; 5T4 Oncofetal Antigen; 5T4 Oncofetal Trophoblast Glycoprotein; Wnt Activated Inhibitory Factor 1; TPBG | Renal Cell Carcinoma; Non-Small Cell Lung Cancer; Pancreatic Cancer; Advanced Malignancy |
| Narnatumab | Macrophage Stimulating Protein Receptor; CDw136; Protein Tyrosine Kinase 8; p185 Ron; CD136; MST1R; EC 2.7.10.1 | Advanced Malignancy; Solid Tumor |
| Natalizumab | Integrin Alpha 4; CD49 Antigen Like Family Member D; VLA4 Subunit Alpha; CD49d; ITGA4 | Acute Ischemic Stroke; Multiple Sclerosis; Rheumatoid Arthritis; Paraneoplastic Syndrome; Graft Versus Host Disease (GVHD); Crohn's Disease (Regional Enteritis); Relapsing Remitting Multiple Sclerosis (RRMS) |
| Navicixizumab | Delta Like Protein 4; Delta Like Ligand 4; *Drosophila* Delta Homolog 4; DLL4; Vascular Endothelial Growth Factor; VEGF | Ovarian Cancer; Uterine Cancer; Fallopian Tube Cancer; Solid Tumor; Metastatic Colorectal Cancer; Peritoneal Cancer |
| Navivumab | Influenza A virus hemagglutinin HA | Infectious Disease |
| Ndimab-varB | Nerve growth factor | Chronic Pancreatitis Pain; Sciatic Pain; Vertebral Fracture Pain; Cancer Pain; Chronic Pain; Osteoarthritis Pain; Low Back Pain |
| Necitumumab | Epidermal Growth Factor Receptor; Proto Oncogene c ErbB 1; Receptor Tyrosine Protein Kinase erbB 1; HER1; ERBB1; EGFR; EC 2.7.10.1 | Metastatic Colorectal Cancer; Non-Small Cell Lung Cancer; Squamous Non-Small Cell Lung Cancer |
| Neliximab | V Type Proton Atpase 116 Kda Subunit A Isoform 3; Osteoclastic Proton Pump 116 kDa Subunit; T Cell Immune Regulator 1; T Cell Immune Response cDNA7 Protein; Vacuolar Proton Translocating ATPase 116 kDa Subunit A Isoform 3; TCIRG1; EC 3.6.3.6 | Heart Transplant Rejection; Kidney Transplant Rejection; Inflammation; Arthritis |
| Nemolizumab | Interleukin 31 Receptor Subunit Alpha; Cytokine Receptor Like 3; Gp130 Like Monocyte Receptor; GLM R; ZcytoR17; IL31RA | Pruritus; Atopic Dermatitis |
| Nesvacumab | Angiopoietin 2; Ang 2; ANGPT2; Placenta Growth Factor; Vascular Endothelial Growth Factor Related Protein; PGF; Vascular Endothelial Growth Factor A; Vascular Permeability Factor; VEGFA; Vascular Endothelial Growth Factor B; VEGF Related Factor; VEGFB | Diabetic Macular Edema; Wet (Neovascular/Exudative) Macular Degeneration |
| Neuradiab | Tenascin; Cytotactin; GMEM; GP 150-225; Glioma Associated Extracellular Matrix Antigen; Hexabrachion; JI; Myotendinous Antigen; Neuronectin; Tenascin C; TNC | Non-Hodgkin Lymphoma; Glioblastoma Multiforme (GBM); Brain Cancer |
| Nimotuzumab | Epidermal Growth Factor Receptor; Proto Oncogene c ErbB 1; Receptor Tyrosine Protein Kinase erbB 1; HER1; ERBB1; EGFR; EC 2.7.10.1 | Gastric Cancer; Glioblastoma Multiforme (GBM); Pediatric Diffuse Intrinsic Pontine Glioma; Adenocarcinoma Of The Gastroesophageal Junction; Gastric Cancer; Metastatic Adenocarcinoma of The Pancreas; Non-Small Cell Lung Cancer; Nasopharyngeal Cancer; Oropharyngeal Cancer; Cervical Cancer; Metastatic Breast Cancer; Hypopharyngeal Cancer; Squamous Non-Small Cell Lung Carcinoma |

TABLE 11-continued

Antibodies, their targets and diseases, disorders or conditions related to the antibodies.

| Antibody Name | Target | Related Disease, Disorder or Condition |
| --- | --- | --- |
| Nivolumab | Programmed Cell Death Protein 1; PDI; CD279; PDCDI | Squamous Non-Small Cell Lung Cancer Metastatic Melanoma; Metastatic Renal Cell Carcinoma; Squamous Non-Small Cell Lung Cancer Metastatic Melanoma; Metastatic Renal Cell Carcinoma; Non-Small Cell Lung Cancer Hodgkin Lymphoma (B-Cell Hodgkin Lymphoma); Metastatic Melanoma; Metastatic Renal Cell Carcinoma; Recurrent Head and Neck Cancer Squamous Cell Carcinoma; Squamous Non-Small Cell Lung Cancer; Transitional Cell Cancer (Urothelial Cell Cancer) Hodgkin Lymphoma (B-Cell Hodgkin Lymphoma); Metastatic Melanoma; Renal Cell Carcinoma; Squamous Non-Small Cell Lung Cancer Hodgkin Lymphoma (B-Cell Hodgkin Lymphoma); Squamous Non-Small Cell Lung Cancer Hodgkin Lymphoma (B-Cell Hodgkin Lymphoma); Metastatic Melanoma; Metastatic Renal Cell Carcinoma; Squamous Non-Small Cell Lung Cancer Gastric Cancer Non-Small Cell Lung Cancer; Recurrent Head and Neck Cancer Squamous Cell Carcinoma; Renal Cell Carcinoma Transitional Cell Cancer (Urothelial Cell Cancer) Malignant Pleural Mesothelioma; Small-Cell Lung Cancer Esophageal Cancer Gastric Cancer; Gastroesophageal (GE) Junction Carcinomas Glioblastoma Multiforme (GBM) Head and Neck Cancer Squamous Cell Carcinoma; Transitional Cell Carcinoma (Urothelial Cell Carcinoma) Head and Neck Carcinoma Hepatocellular Carcinoma; Non-Small Cell Lung Cancer; Renal Cell Carcinoma; Small-Cell Lung Cancer; Transitional Cell Cancer (Urothelial Cell Cancer) Malignant Pleural Mesothelioma; Ovarian Cancer Esophageal Cancer; Gastric Cancer; Gastroesophageal (GE) Junction Carcinomas; Hepatocellular Carcinoma; Metastatic Renal Cell Carcinoma; Non-Small Cell Lung Cancer; Recurrent Glioblastoma Multiforme (GBM); Refractory Multiple Myeloma; Relapsed Multiple Myeloma Acute Myelocytic Leukemia (AML; Acute Myeloblastic Leukemia); B-Cell Non-Hodgkin Lymphoma; Bladder Cancer; Chronic Lymphocytic Leukemia (CLL); Pancreatic Ductal Adenocarcinoma; Refractory Chronic Lymphocytic Leukemia (CLL); Relapsed Chronic Lymphocytic Leukemia (CLL) Metastatic Breast Cancer; Ovarian Cancer; Primary CNS Lymphoma; Testicular Cancer Human Papillomavirus Infections Adenocarcinoma; Anal Cancer; Cutaneous T-Cell Lymphoma; Gastric Cancer; Gastroesophageal (GE) Junction Carcinomas; Merkel Cell Carcinoma; Metastatic Colorectal Cancer; Papillary Tumor; Peripheral T-Cell Lymphomas (PTCL); Signet Ring Cell Squamous Cell Carcinoma Cervical Cancer; Nasopharyngeal Cancer; Skin Cancer; Vaginal Cancer; Vulvar Cancer Endometrial Cancer; Fallopian Tube Cancer; Peritoneal Cancer; Primary ENS Lymphoma; Soft Tissue Sarcoma; Testicular Cancer; Uterine Cancer Ovarian Cancer Bladder Cancer Acute Myelocytic Leukemia (AML; Acute Myeloblastic Leukemia); Gastric Cancer Cervical Cancer; Colon Cancer; Diffuse Large B-Cell Lymphoma; Follicular Lymphoma; Nasopharyngeal Cancer; Pancreatic Cancer; Skin Cancer; Vaginal Cancer; Vulvar Cancer Sepsis Bile Duct Cancer (Cholangiocarcinoma); Solid Tumor Metastatic Hormone Refractory (Castration Resistant; androgen-Independent) Prostate Cancer; Non-Small Cell Lung Cancer Hepatitis C Chronic Myelocytic Leukemia (CML; Chronic Myeloid Leukemia) Oral Cavity (Mouth) Cancer Leptomeningeal Disease (Neoplastic Meningitis; Leptomeningeal Carcinomatosis) Metastatic Melanoma Gastric Cancer; Non-Small Cell Lung Cancer; Renal Cell Carcinoma; Small-Cell Lung Cancer Gastroesophageal (GE) Junction Carcinomas Head and Neck Cancer Malignant Pleural Mesothelioma Metastatic Renal Cell Carcinoma Recurrent Glioblastoma Multiforme (GBM) Bladder Cancer; Breast Cancer; Ewing Sarcoma; Hepatocellular Carcinoma; Hodgkin Lymphoma (B-Cell Hodgkin Lymphoma); Malignant Pleural Mesothelioma; Metastatic Colorectal Cancer; Metastatic Hormone Refractory (Castration Resistant; androgen-Independent) Prostate Cancer; Metastatic Pancreatic Cancer; Metastatic Transitional (Urothelial) Tract Cancer; Metastatic Uveal Melanoma; Neuroblastoma; Non-Hodgkin Lymphoma; |

TABLE 11-continued

Antibodies, their targets and diseases, disorders or conditions related to the antibodies.

| Antibody Name | Target | Related Disease, Disorder or Condition |
|---|---|---|
| | | Non-Small Cell Lung Cancer; Osteosarcoma; Primitive Neuroectodermal Tumor (PNET); Rhabdomyosarcoma Melanoma Merkel Cell Carcinoma; Metastatic Hrmone Refractory (Castration Resistant; androgen-Independent) Prostate Cancer; Non-Small Cell Lung Cancer Epithelial Ovarian Cancer; Fallopian Tube Cancer; Peritoneal Cancer |
| Obiltoxaximab | Anthrax Protective Antigen; pa | Anthrax |
| Obinutuzumab | B Lymphocyte Antigen CD20; B Lymphocyte Surface Antigen B1; Bp35; Leukocyte Surface Antigen Leu 16; Membrane Spanning 4 Domains Subfamily A Member 1; CD20; MS4A1 | Graft Versus Host Disease (GVHD); Waldenstrom Macroglobulinemia; End-Stage Kidney Disease (End-Stage Renal Disease; ESRD); Diffuse Large B-Cell Lymphoma; Follicular Lymphoma; Splenic Marginal Zone B-Cell Lymphoma Lupus Nephritis; Non-Hodgkin Lymphoma; Chronic Lymphocytic Leukemia (CLL); Follicular Lymphoma |
| Ocaratuzumab | B Lymphocyte Antigen CD20: B Lymphocyte Surface Antigen B1; Bp35; Leukocyte Surface Antigen Leu 16; Membrane Spanning 4 Domains Subfamily A Member 1; CD20; MS4A1 | Follicular Lymphoma; Lymphoma; Rheumatoid Arthritis; Systemic Lupus Erythematosus; Chronic Lymphocytic Leukemia (CLL) |
| Ocrelizumab | B Lymphocyte Antigen CD20; B Lymphocyte Surface Antigen B1; Bp35; Leukocyte Surface Antigen Leu 16; Membrane Spanning 4 Domains Subfamily A Member 1; CD20; MS4A1 | Follicular Lymphoma; Rheumatoid Arthritis; Lupus Nephritis; Systemic Lupus Erythematosus; Primary Progressive Multiple Sclerosis (PPMS); Relapsing Multiple Sclerosis (RMS); |
| Odulimomab | Integrin Alpha L; CD11 Antigen Like Family Member A; Leukocyte Adhesion Glycoprotein LFA 1 Alpha Chain; CD11a; ITGAL | Multiple Sclerosis; Graft Versus Host Disease (GVHD); Kidney Transplant Rejection |
| Ofatumumab | CD20; B Lymphocyte Surface Antigen B1; Bp35; Leukocyte Surface Antigen Leu 16; Membrane Spanning 4 Domains Subfamily A Member 1; CD20; MS4A1 | Relapsing Remitting Multiple Sclerosis (RRMS); Secondary Progressive Multiple Sclerosis (SPMS) B-Cell Non-Hodgkin Lymphoma; Neuromyelitis Optica (Devic's Syndrome); Rheumatoid Arthritis; Diffuse Large B-Cell Lymphoma; Diffuse Large B-Cell Lymphoma; Waldenstrom Macroglobulinemia; Pemphigus Vulgaris; Rheumatoid Arthritis; Refractory Chronic Lymphocytic Leukemia (CLL); Chronic Lymphocytic Leukemia (CLL); Refractory Chronic Lymphocytic Leukemia (CLL); Relapsed Chronic Lymphocytic Leukemia (CLL)" |
| Olaratumab | Platelet Derived Growth Factor Receptor; PDGFR; EC 2.7.10.1; Platelet Derived Growth Factor Receptor Alpha; Alpha Type Platelet Derived Growth Factor Receptor; CD140 Antigen Like Family Member A; Platelet Derived Growth Factor Receptor 2; CD140a; PDGFRA; EC 2.7.10.1 | Epithelial Ovarian Cancer; Fallopian Tube Cancer; Gastrointestinal Stromal Tumor (GIST); Metastatic Hormone Refractory (Castration Resistant; androgen-Independent) Prostate Cancer; Peritoneal Cancer; Recurrent Glioblastoma Multiforme (GBM); Metastatic Pancreatic Cancer; Non-Small Cell Lung Cancer; Soft Tissue Sarcoma |
| Oleclumab | 5' Nucleotidase; Ecto 5' Nucleotidase; CD73; NT5E; EC 3.1.3.5 | Colorectal Cancer; Pancreatic Cancer |
| Olokizumab | Interleukin 6; B Cell Stimulatory Factor 2; BSF2; CTL Differentiation Factor; CDF; Hybridoma Growth Factor; Interferon Beta 2; IFNB2; IL6 | Rheumatoid Arthritis; Crohn's Disease (Regional Enteritis) |
| Omalizumab | Immunoglobulin E; IgE | Kidney Disease; Rhino-Conjunctivitis; Nasal Polyposis; Rhinosinusitis; Asthma; Allergic Asthma; Chronic Urticaria; Hives |
| Onartuzumab | Hepatocyte Growth Factor Receptor; Proto Oncogene c Met; Tyrosine Protein Kinase Met; HGF/SF Receptor; Scatter Factor Receptor; MET; EC 2.7.10.1 | Gastric Cancer; Hepatocellular Carcinoma; Metastatic Breast Cancer; Metastatic Colorectal Cancer; Non-Small Cell Lung Cancer; Recurrent Glioblastoma Multiforme (GBM); Non-Small Cell Lung Cancer; Metastatic Melanoma; Recurrent Glioblastoma Multiforme (GBM) |
| Ontuxizumab | Endosialin; Tumor Endothelial Marker 1; CD164 Sialomucin Like 1; CD248 | Metastatic Melanoma; Solid Tumor; Metastatic Colorectal Cancer; Rhabdomyosarcoma; Soft Tissue Sarcoma; Lymphoma |
| Opicinumab | Leucine Rich Repeat and Immunoglobulin Like Domain Containing Nogo Receptor Interacting Protein 1; Leucine Rich Repeat and Immunoglobulin Domain Containing Protein 1; Leucine Rich Repeat Neuronal Protein 1; Leucine Rich Repeat Neuronal Protein 6A; LINGOI | Optic Neuritis; Relapsing Remitting Multiple Sclerosis (RRMS); Secondary Progressive Multiple Sclerosis (SPMS) |
| Oportuzumab monatox | Epithelial Cell Adhesion Molecule; Adenocarcinoma Associated Antigen; Cell Surface Glycoprotein Trop 1; Epithelial Cell Surface Antigen; Epithelial Glycoprotein 314; KS 1/4 Antigen; KSA; Tumor Associated Calcium Signal Transducer 1; CD326; EPCAM | Head and Neck Cancer Squamous Cell Carcinoma; Ovarian Cancer; Liver Cancer; Non Muscle Invasive Bladder Cancer (NMIBC) (Superficial Bladder Cancer) |
| Oregovomab | Mucin 16; Ovarian Cancer Related Tumor Marker CA125; Ovarian Carcinoma Antigen CA125; MUC16 | Epithelial Ovarian Cancer; Fallopian Tube Cancer; Ovarian Cancer; Pancreatic Ductal Adenocarcinoma; Peritoneal Cancer |
| Oreptacog, Oreptacog alfa | rFVIIa | Hamophilie |

TABLE 11-continued

Antibodies, their targets and diseases, disorders or conditions related to the antibodies.

| Antibody Name | Target | Related Disease, Disorder or Condition |
|---|---|---|
| Orticumab | Oxidized low-density lipoprotein | Atherosclerosis |
| Otelixizumab | T Cell Surface Glycoprotein CD3 Epsilon Chain; T Cell Surface Antigen T3/Leu 4 Epsilon Chain; CD3E | Graves' Ophthalmopathy; Type 1 Diabetes (Juvenile Diabetes); Myasthenia Gravis; Psoriasis; Rheumatoid Arthritis |
| Otlertuzumab | Leukocyte Antigen CD37; Tetraspanin 26; CD37 | B-Cell Non-Hodgkin Lymphoma; Follicular Lymphoma; Lymphoblastic Lymphoma; Non-Hodgkin Lymphoma; Relapsed Chronic Lymphocytic Leukemia (CLL); Chronic Lymphocytic Leukemia (CLL) |
| Oxelumab | Tumor Necrosis Factor Ligand Superfamily Member 4; Glycoprotein Gp34; OX40 Ligand; TAX Transcriptionally Activated Glycoprotein 1; CD252; TNFSF4 | Asthma |
| Ozanezumab | Reticulon 4; Human NogoA; Neurite Outgrowth Inhibitor; Foocen; Neuroendocrine Specific Protein; Neuroendocrine Specific Protein C Homolog; RTN x; Reticulon 5; RTN4 | Amyotrophic Lateral Sclerosis; Relapsing Remitting Multiple Sclerosis (RRMS) |
| Ozoralizumab | Tumor Necrosis Factor; Cachectin; TNF Alpha; Tumor Necrosis Factor Ligand Superfamily Member 2; TNF a; TNF | Rheumatoid Arthritis |
| Pagibaximab | Lipoteichoic Acid; LTA | Bacterial Sepsis; Staphylococcal Infections |
| Palivizumab | Respiratory Syncytial Virus Fusion Protein; RSV F Protein | Respiratory Syncytial Virus (RSV) Infections |
| Pamrevlumab | Connective Tissue Growth Factor; CCN Family Member 2; Hypertrophic Chondrocyte Specific Protein 24; Insulin Like Growth Factor Binding Protein B; IGFBPB; CTGF | Duchenne Muscular Dystrophy; Pancreatic Ductal Adenocarcinoma; Idiopathic Pulmonary Fibrosis; Liver Fibrosis; Focal Segmental Glomerulosclerosis (FSGS); Microalbuminuria; Proteinuria; Systemic Sclerosis (Scleroderma); Diabetic Nephropathy; Type 1 Diabetes (Juvenile Diabetes); Type 2 Diabetes |
| Panitumumab | Epidermal Growth Factor Receptor; Proto Oncogene c ErbB 1; Receptor Tyrosine Protein Kinase erbB 1; HER1; ERBB1; EGFR; EC 2.7.10.1 | Esophageal Cancer; Adenocarcinoma Of The Gastroesophageal Junction; Gastric Cancer; Metastatic Breast Cancer; Recurrent Head and Neck Cancer Squamous Cell Carcinoma; Anal Cancer; Non-Small Cell Lung Cancer; Glioblastoma Multiforme (GBM); Gliosarcoma; Malignant Glioma; Muscle Invasive Bladder Cancer (MIBC); Non-Small Cell Lung Cancer; Renal Cell Carcinoma; Head and Neck Cancer Squamous Cell Carcinoma; Metastatic Colorectal Cancer |
| Pankomab, Pankoab | Mucin 1; Breast Carcinoma Associated Antigen DF3; Episialin; H23AG; Krebs Von Den Lungen 6; PEMT; Peanut Reactive Urinary Mucin; Polymorphic Epithelial Mucin; Tumor Associated Epithelial Membrane Antigen; Tumor Associated Mucin; CD227; MUC1; tumor specific glycosylation of MUC1 | Fallopian Tube Cancer; Epithelial Ovarian Cancer; Peritoneal Cancer; Breast Cancer; Non-Small Cell Lung Cancer; Colorectal Cancer; Ovarian Cancer |
| Panobacumab | Lipopolysaccharide; Endotoxin | Ventilator Associated Pneumonia (VAP); Hospital Acquired Pneumonia (HAP); *Pseudomonas aeruginosa* Pneumonia |
| Parsatuzumab | Epidermal Growth Factor Like Protein 7; Multiple Epidermal Growth Factor Like Domains Protein 7; NOTCH4 Like Protein; Vascular Endothelial Statin; Zneu1; EGFL7 | Solid Tumor; Metastatic Colorectal Cancer; Non-Small Cell Lung Cancer; Solid Tumor |
| Pascolizumab | Interleukin 4; B Cell Stimulatory Factor 1; Binetrakin; Lymphocyte Stimulatory Factor 1; Pitrakinra; IL4 | Asthma |
| Pasotuxizumab | Glutamate Carboxypeptidase 2; Folate Hydrolase 1; Prostate Specific Membrane Antigen; PSMA; Pteroylpoly Gamma Glutamate Carboxypeptidase; Cell Growth Inhibiting Gene 27 Protein; FOLH1; EC 3.4.17.21; T Cell Surface Glycoprotein CD3 Epsilon Chain; T Cell Surface Antigen T3/Leu 4 Epsilon Chain; CD3E | Hormone Refractory (Castration Resistant; androgen-Independent) Prostate Cancer |
| Pateclizumab | Lymphotoxin Alpha; TNF Beta; Tumor Necrosis Factor Ligand Superfamily Member 1; LTA | Rheumatoid Arthritis |
| Patritumab | Receptor Tyrosine Protein Kinase ERBB 3; Proto Oncogene Like Protein c ErbB 3; Tyrosine Kinase Type Cell Surface Receptor HER3; HER3; ERBB3; EC 2.7.10.1 | Non-Small Cell Lung Cancer; Breast Cancer; Bladder Cancer; Cervical Cancer; Colon Cancer; Endometrial Cancer; Esophageal Cancer; Gastric Cancer; Liver Cancer; Ovarian Cancer; Pancreatic Cancer; Prostate Cancer; Metastatic Breast Cancer; Recurrent Head and Neck Cancer Squamous Cell Carcinoma |

TABLE 11-continued

Antibodies, their targets and diseases, disorders or conditions related to the antibodies.

| Antibody Name | Target | Related Disease, Disorder or Condition |
|---|---|---|
| Pembrolizumab | Programmed Cell Death Protein 1; PD1; CD279; PDCD1 | Metastatic Melanoma; Non-Small Cell Lung Cancer Metastatic Melanoma; Hodgkin Lymphoma (B-Cell Hodgkin Lymphoma); Metastatic Melanoma; Non-Small Cell Lung Cancer; Recurrent Head and Neck Cancer Squamous Cell Carcinoma; Metastatic Melanoma; Non-Small Cell Lung Cancer; Recurrent Head and Neck Cancer Squamous Cell Carcinoma; Colorectal Cancer; Metastatic Transitional (Urothelial) Tract Cancer; Non-Small Cell Lung Cancer; Hodgkin Lymphoma (B-Cell Hodgkin Lymphoma); Adenocarcinoma Of The Gastroesophageal Junction; Gastric Cancer; Breast Cancer; Metastatic Breast Cancer; Metastatic Renal Cell Carcinoma; Multiple Myeloma (Kahler Disease); Refractory Multiple Myeloma; Non-Small Cell Lung Cancer Adenocarcinoma Of The Gastroesophageal Junction; Esophageal Cancer; Gastric Cancer; Hepatocellular Carcinoma; Hypopharyngeal Cancer; Laryngeal Cancer; Metastatic Transitional (Urothelial) Tract Cancer; Oral Cavity (Mouth) Cancer; Oropharyngeal Cancer; Refractory Multiple Myeloma; Ureter Cancer; Urethral Cancer Bladder Cancer; Recurrent Head and Neck Cancer Squamous Cell Carcinoma Adenocarcinoma Of The Gastroesophageal Junction; Esophageal Cancer; Mantle Cell Lymphoma; Merkel Cell Carcinoma; Metastatic Biliary Tract Cancer; Small-Cell Lung Cancer; Squamous Cell Carcinoma Anal Cancer; Basal Cell Carcinoma (Basal Cell Epithelioma); Cervical Cancer; Chondrosarcoma; Dedifferentiated Liposarcoma; Diffuse Large B-Cell Lymphoma; Endometrial Cancer; Epithelial Ovarian Cancer; Ewing Sarcoma; Fallopian Tube Cancer; Follicular Lymphoma; Germinomatous (Seminomatous) Germ Cell Tumors; Gliosarcoma; Leiomyosarcoma; Lymphoma; Malignant Pleural Mesothelioma; Metastatic Colorectal Cancer; Metastatic Prostate Cancer; Metastatic Renal Cell Carcinoma; Nasopharyngeal Cancer; Neuroblastoma; Neuroendocrine Tumors; Non Muscle Invasive Bladder Cancer (NMIBC) (Superficial Bladder Cancer); Non-Hodgkin Lymphoma; Nongerminomatous (Nonseminomatous) Germ Cell Tumors; Osteosarcoma; Pancreatic Cancer; Peripheral Nerve Sheath Tumor (Neurofibrosarcoma); Peritoneal Cancer; Primary Mediastinal B-Cell Lymphoma; Recurrent Glioblastoma Multiforme (GBM); Salivary Gland Cancer; Small-Cell Lung Cancer; Soft Tissue Sarcoma; Synovial Sarcoma; T-Cell Lymphomas; Thymic Carcinoma; Thyroid Cancer Adenoid Cystic Carcinoma (ACC); Chronic Idiopathic Myelofibrosis; Chronic Lymphocytic Leukemia (CLL); Diffuse Large B-Cell Lymphoma; Post-Essential Thrombocythemia Myelofibrosis (Post-ET MF); Post-Polycythemia Vera Myelofibrosis (PPV-MF); Small-Cell Lung Cancer; Soft Tissue Sarcoma Metastatic Melanoma Chronic Lymphocytic Leukemia (CLL); Lymphoma; Mycosis Fungoides; Myelodysplastic Syndrome; Non-Hodgkin Lymphoma; Sezary Syndrome Melanoma; Metastatic Breast Cancer; Neuroendocrine Gastroenteropancreatic Tumors (GEP-NET) |
| Perakizumab | Interleukin 17; IL17 | Psoriatic Arthritis; Autoimmune Disorders; Inflammation; Rheumatoid Arthritis |
| Pertuzumab, Pertuzuab | Receptor Tyrosine Protein Kinase ERBB 2; Metastatic Lymph Node Gene 19 Protein; Proto Oncogene Neu; Proto Oncogene C ErbB 2; Tyrosine Kinase Type Cell Surface Receptor HER2; pI85erbB2; HER2; CD340; ERBB2; EC 2.7.10.1; HER2/neu | Non-Small Cell Lung Cancer; Pancreatic Cancer; Hormone Refractory (Castration Resistant; androgen-Independent) Prostate Cancer; Neuroendocrine Cancer; Adenocarcinoma Of The Gastroesophageal Junction; Breast Cancer; Epithelial Ovarian Cancer; Fallopian Tube Cancer; Gastric Cancer; Metastatic Breast Cancer; Peritoneal Cancer; Breast Cancer; Metastatic Breast Cancer |
| Pexelizumab, Pexelizumab h5g1.1 | Complement C5; C3 and PZP Like Alpha 2 Macroglobulin Domain Containing Protein 4; C5 | Coronary Disease; Myocardial Infarction; Reduction of Side Effects of Cardiac Surgery |
| PF-05082566, Utomilumab | Tumor Necrosis Factor Receptor Superfamily Member 9; 4-IBB Ligand Receptor; T Cell Antigen 4-IBB Homolog; T Cell Antigen ILA; CD137; TNFRSF9 | Non-Small Cell Lung Cancer; Colorectal Cancer; Metastatic Breast Cancer; Small-Cell Lung Cancer; Head and Neck Cancer Squamous Cell Carcinoma; Metastatic Melanoma; Ovarian Cancer; Renal Cell Carcinoma; Follicular Lymphoma; Cervical Cancer; Pancreatic Cancer; Gastric Cancer; Bladder Cancer; Diffuse Large B-Cell Lymphoma; Sarcomas; Anaplastic Thyroid Cancer; Metastatic Hepatocellular Carcinoma (HCC); Thymoma (Thymic Epithelial Tumor) |
| Pidilizumab | Programmed Cell Death 1; PD-1; PDCD1; | Pontine Glioma; Refractory Multiple Myeloma; Relapsed Multiple Myeloma; Hepatitis C; Hepatocellular Carcinoma; Metastatic Colorectal Cancer; Pancreatic Cancer |

TABLE 11-continued

Antibodies, their targets and diseases, disorders or conditions related to the antibodies.

| Antibody Name | Target | Related Disease, Disorder or Condition |
|---|---|---|
| Pinatuzumab, Pinatuzumab vedotin | B Cell Receptor CD22; B Lymphocyte Cell Adhesion Molecule; Sialic Acid Binding Ig Like Lectin 2; T Cell Surface Antigen Lou 14; CD22 | Follicular Lymphoma; Chronic Lymphocytic Leukemia (CLL); Diffuse Large B-Coll Lymphoma |
| Placulumab | Tumor Necrosis Factor; Cachectin; TNF Alpha; Tumor Necrosis Factor Ligand Superfamily Member 2; TNF a; TNF | Sciatica; Plague Psoriasis (Psoriasis Vulgaris); Rheumatoid Arthritis |
| Plozalizumab | C-C Chemokine Receptor Type 2; Monocyte Chemoattractant Protein 1 Receptor; CD192; CCR2 | Rheumatoid Arthritis; Bone Metastasis; Diabetic Nephropathy; Relapsing Remitting Multiple Sclerosis (RRMS); Atherosclerosis; Melanoma; Solid Tumor |
| Pogalizumab | Tumor Necrosis Factor Receptor Superfamily Member 4; ACT35 Antigen; TAX Transcriptionally Activated Glycoprotein 1 Receptor; DX40L Receptor; CD134; TNFRSF4 | Solid Tumor; Metastatic Transitional (Urothelial) Tract Cancer |
| Polatuzumab, Polatuzumab vedotin, Polatuzuab | B Cell Antigen Receptor Complex Associated Protein Beta Chain; B Cell Specific Glycoprotein B29; Ig Beta; Immunoglobulin Associated B29 Protein; CD79B | Follicular Lymphoma; Diffuse Large B-Cell Lymphoma; B-Cell Non-Hodgkin Lymphoma; Chronic Lymphocytic Leukemia (CLL); Mantle Cell Lymphoma |
| Ponezumab | Amyloid Beta Peptide; A beta P; Abeta; Beta Amyloid | Alzheimer's Disease; Neurodegenerative Diseases |
| Porgaviximab | Ebolavirus glycoprotein | Ebola virus infections |
| Prezalumab | ICOS Ligand; B7 Homolog 2; B7 Like Protein G150; B7 Related Protein 1; CD275; ICOSLG | Subacute Cutaneous Lupus Erythematosus (SCLE); Psoriasis; Systemic Lupus Erythematosus; Sicca Syndrome (Sjogren) |
| Pritoxaximab | Shiga Toxin Type 1; stx1; Shiga Toxin Type 2; stx2 | *Escherichia coli* Infections; Typical Hemolytic Uremic Syndrome (Shiga-Toxin Associated Hemolytic Uremic Syndrome); Typical Hemolytic Uremic Syndrome (Shiga-Toxin Associated Hemolytic Uremic Syndrome) |
| Pritumumab | Vimentin; Epididymis Luminal Protein 113; VIM | Glioma; Pancreatic Cancer |
| Duilizumab | Immunoglobulin E; IgE | Allergic Asthma; Allergic Rhinitis; Chronic Urticaria; Hives |
| Racotumomab | N Glycolylneuraminyl Lactosylceramide; NeuGcGM3 | Breast Cancer; Melanoma; Small-Cell Lung Cancer; Ewing Sarcoma; Glioma; Retinoblastoma; Wilms' Tumor (Nephroblastoma); Neuroblastoma; Non-Small Cell Lung Cancer |
| Radretumab | Fibronectin; Cold Insoluble Globulin; FN1 | Hodgkin Lymphoma (B-Cell Hodgkin Lymphoma); Lung Cancer; Prostate Cancer; Metastatic Brain Tumor; Non-Small Cell Lung Cancer; Colorectal Cancer |
| Rafivirumab | Rabies Virus Glycoprotein | Rabies |
| Ralpancizumab | Neural Apoptosis-regulated Proteinase 1 | dyslipidemia; Hypercholesterolemia; Hyperlipidemia |
| Ramucirumab | Vascular Endothelial Growth Factor Receptor 2; Fetal Liver Kinase 1; Kinase Insert Domain Receptor; Protein Tyrosine Kinase Receptor flk 1; VEGFR2; CD309; KDR; EC 2.7.10.1 | Adenocarcinoma Of The Gastroesophageal Junction; Gastric Cancer; Metastatic Colorectal Cancer; Non-Small Cell Lung Cancer; Gastric Cancer; Metastatic Colorectal Cancer; Non-Small Cell Lung Cancer; Epithelial Ovarian Cancer; Fallopian Tube Cancer; Gallbladder Cancer; Metastatic Biliary Tract Cancer; Metastatic Breast Cancer; Metastatic Renal Cell Carcinoma; Peritoneal Tumor; Mantle Cell Lymphoma; Neuroendocrine Tumors; Hepatocellular Carcinoma; Metastatic Hormone Refractory (Castration Resistant; androgen-Independent) Prostate Cancer; Metastatic Melanoma; Recurrent Glioblastoma Multiforme (GBM); Metastatic Breast Cancer |
| Ranevetmab | Canine Nerve Growth Factor; NGF | Pain; Osteoarthritis |
| Ranibizumab, Ranibizivab | Vascular Endothelial Growth Factor Receptor 2; Fetal Liver Kinase 1; Kinase Insert Domain Receptor; Protein Tyrosine Kinase Receptor flk 1; VEGFR2; CD309; KDR; EC 2.7.10.1; VEGF-A | Retinal Vein Occlusion; Age Related Macular Degeneration; Diabetic Macular Edema; Diabetic Macular Edema; Diabetic Retinopathy; Non-Proliferative Diabetic Retinopathy (NPDR); Proliferative Diabetic Retinopathy (PDR); Choroidal Neovascularization; Macular Edema; Wet (Neovascular/Exudative) Macular Degeneration; Macular Edema; Wet (Neovascular/Exudative) Macular Degeneration; Retinopathy Of Prematurity; Epistaxis; Corneal Neovascularization; Cystoid Macular Edema; Macular Edema; Polypoidal Choroidal Vasculopathy; Pterygium; Retinal Vein Occlusion; Uveitis |
| Raxibacumab | Anthrax Protective Antigen; pa | Anthrax |
| Refanezumab | Myelin Associated Glycoprotein; Siglec 4a; Sialic Acid Binding Ig Like Lectin 4A; MAG | Ischemic Stroke |
| Regavirumab | Human Cytomegalovirus Envelope Glycoprotein B; gB | Cytomegalovirus (HHV-5) Infections |
| REGN2810 | Programmed Cell Death Protein 1; PD1; CD279; PDCD1 | Melanoma; Squamous Cell Carcinoma; Non-Small Cell Lung Cancer; Acute Lymphocytic Leukemia (ALL; Acute Lymphoblastic Leukemia); Hodgkin Lymphoma (B-Cell Hodgkin Lymphoma); Solid Tumor; B-Cell Non-Hodgkin Lymphoma; Basal Cell Carcinoma (Basal Cell Epithelioma) |
| Remtolumab | Interleukin 17A; Cytotoxic T Lymphocyte Associated Antigen B; CTLA8; IL17A; Tumor Necrosis Factor; Cachectin; TNF Alpha; Tumor Necrosis Factor Ligand Superfamily Member 2; TNF a; TNF | Rheumatoid Arthritis; Psoriatic Arthritis; Systemic-Onset Juvenile Idiopathic Arthritis (Still Disease) |

TABLE 11-continued

Antibodies, their targets and diseases, disorders or conditions related to the antibodies.

| Antibody Name | Target | Related Disease, Disorder or Condition |
| --- | --- | --- |
| Reslizumab | Interleukin 5; Eosinophil Differentiation Factor; B Cell Differentiation Factor 1; T Cell Replacing Factor; IL5 | Asthma; Churg-Strauss Syndrome; Hypereosinophilic Syndrome; Eosinophilic Esophagitis |
| rhuMAb-VEGF | Vascular Endothelial Growth Factor A; Vascular Permeability Factor; VEGFA | Breast Cancer; Lung Cancer; Ovarian Cancer; Glioblastoma Multiforme (GBM); Glioma; Renal Cell Carcinoma; Non-Small Cell Lung Cancer; Fallopian Tube Cancer; Epithelial Ovarian Cancer; Colorectal Cancer; Cervical Cancer; Metastatic Breast Cancer; Malignant Glioma; Metastatic Colorectal Cancer; Metastatic Ovarian Cancer; Metastatic Renal Cell Carcinoma; Peritoneal Cancer |
| Rilotumumab | Hepatocyte Growth Factor; Hepatopoietin A; Scatter Factor; HGF | Adenocarcinoma Of The Gastroesophageal Junction; Gastric Cancer; Gliosarcoma; Metastatic Colorectal Cancer; Metastatic Hormone Refractory (Castration Resistant; androgen-Independent) Prostate Cancer; Metastatic Renal Cell Carcinoma; Non-Small Cell Lung Cancer; Recurrent Glioblastoma Multiforme (GBM); Recurrent Malignant Glioma; Small-Cell Lung Cancer |
| Rinucumab | Placenta Growth Factor; Vascular Endothelial Growth Factor Related Protein; PGF; Platelet Derived Growth Factor Receptor Beta; Beta Type Platelet Derived Growth Factor Receptor; CD140 Antigen Like Family Member B; Platelet Derived Growth Factor Receptor 1; CD140b; PDGFRB; EC 2.7.10.1; Vascular Endothelial Growth Factor A; Vascular Permeability Factor; VEGFA; Vascular Endothelial Growth Factor B; VEGF Related Factor; VEGFB | Wet (Neovascular/Exudative) Macular Degeneration |
| Risankizumab | Interleukin 23; IL23 | Asthma; Ulcerative Colitis; Ankylosing Spondylitis (Bekhterev's Disease); Psoriatic Arthritis; Plaque Psoriasis (Psoriasis Vulgaris; Crohn's Disease (Regional Enteritis) |
| Rituximab | B Lymphocyte Antigen CD20; B Lymphocyte Surface Antigen B1; Bp35; Leukocyte Surface Antigen Lau 16; Membrane Spanning 4 Domains Subfamily A Member 1; CD20; MS4A1 | B-Cell Non-Hodgkin Lymphoma; Chronic Lymphocytic Leukemia (CLL); Diffuse Large B-Cell Lymphoma; Follicular Lymphoma; Non-Hodgkin Lymphoma; Microscopic Polyangiitis (MPA); Granulomatosis with Polyangiitis (Wegener Polyangiitis); Rheumatoid Arthritis; Vasculitis; Nephrotic Syndrome; Pemphigus Vulgaris; Neuromyelitis Optice (Devic's Syndrome); Glomerulonephritis; Idiopathic Thrombocytopenic Purpura (Immune Thrombocytopenic Purpura); Kidney Transplant Rejection; Liver Transplant Rejection; Thrombotic Thrombocytopenic Purpura; Hemophilia A; Lupus Nephritis; Myasthenia Gravis; Sicca Syndrome (Sjogren); Systemic Lupus Erythematosus; Autoimmune Disease |
| Rivabazumab, Rivabazumab pegol | *Pseudomonas aeruginosa* type III secrection system; ttss pcrv protein | *Pseudomonas aeruginosa* infection |
| Robatumumab | Insulin Like Growth Factor 1; Mechano Growth Factor; Somatomedin C; IGF1 | Colorectal Cancer; Ewing Sarcoma; Osteosarcoma; Solid Tumor |
| Roledumab | Blood Group Rh(D Polypeptide; RHXIII; Rh Polypeptide 2; Rhesus D Antigen; CD240D; RHD | Erythroblastosis Fetalis (Hemolytic Disease In Newborns) |
| Romosozumab | Sclerostin; SOST | Post Menopausal Osteoporosis; Osteopenia; Bone Fracture; Osteoporosis |
| Rontalizumab, Rontalizuab | Interferon Alpha/Beta Receptor I; Cytokine Receptor Class II Member I; Cytokine Receptor Family 2 Member I; Type I Interferon Receptor I; IFNAR1; Interferon Alpha/Beta Receptor 2; Interferon Alpha Binding Protein; Type I Interferon Receptor 2; IFNAR2; IFN-α | Systemic Lupus Erythematosus |
| Rosmantuzumab | R Spondin 3; Roof Plate Specific Spondin 3; Protein With TSP Type I Repeat; Thrombospondin Type I Domain Containing Protein 2; RSPO3 | Solid Tumor; Metastatic Colorectal Cancer; Lung Cancer; Ovarian Cancer; Pancreatic Cancer |
| Rovalpituzumab, Rovalpituzumab tesirine | Delta Like Protein 3; Drosophila Delta Homolog 3; DLL3 | Graft Versus Host Disease (GVHD); Small-Cell Lung Cancer; Prostate Cancer; Glioblastoma Multiforme (GBM); Melanoma; Pancreatic Cancer; Gastric Cancer; Small-Cell Lung Cancer; Medullary Thyroid Cancer; Neuroendocrine Carcinoma; Small-Cell Lung Cancer |
| Rovelizumab | Integrin Beta 2; Cell Surface Adhesion Glycoproteins LFA-1/CR3/p150; 95 Subunit Beta; Complement Receptor C3 Subunit Beta; CD18; ITGB2 | Multiple Sclerosis; Hemorrhagic Shock; Ischemic Stroke; Myocardial Infarction; Restenosis; Cerebral Vasospasm; Kidney Transplant Rejection; Brain (Head) Trauma |
| Rozanolixizumab | FCGRT; FCRN Receptor | Myasthenia Gravis; Idiopathic Thrombocytopenic Purpura (Immune Thrombocytopenic Purpura) |

TABLE 11-continued

Antibodies, their targets and diseases, disorders or conditions related to the antibodies.

| Antibody Name | Target | Related Disease, Disorder or Condition |
|---|---|---|
| Ruplizumab | CD40 Ligand; T Cell Antigen Gp39; TNF Related Activation Protein; Tumor Necrosis Factor Ligand Superfamily Member 5; CD154; CD40LG | Glomerulonephritis; Kidney Transplant Rejection; Lupus Nephritis; Transplant Rejection |
| Sacituzumab, Sacituzumab govitecan | Tumor Associated Calcium Signal Transducer 2; Cell Surface Glycoprotein Trop 2; Membrane Component Chromosome I Surface Marker I; Pancreatic Carcinoma Marker Protein GA733-I; TACSTD2 | Neuromyelitis Optica (Devic's Syndrome); Breast Cancer; Lung Cancer; Ovarian Cancer; Glioblastoma Multiforme (GBM); Kidney Cancer (Renal Cell Cancer); Non-Small Cell Lung Cancer; Esophageal Cancer; Epithelial Tumor; Colorectal Cancer; Cervical Cancer; Gastric Cancer; Bladder Cancer; Metastatic Breast Cancer; Small-Cell Lung Cancer; Endometrial Cancer; Colon Cancer; Follicular Thyroid Cancer; Head and Neck Cancer Squamous Cell Carcinoma; Hepatocellular Carcinoma; Hormone Refractory (Castration Resistant; androgen-Independent) Prostate Cancer; Pancreatic Ductal Adenocarcinoma; Transitional Cell Cancer (Urothelial Cell Cancer) |
| Samalizumab | OX 2 Membrane Glycoprotein; MOX1; MOX2; MRC; CD200 | Acute Myelocytic Leukemia (AML; Acute Myeloblastic Leukemia); Refractory Acute Myeloid Leukemia; Relapsed Acute Myeloid Leukemia; Solid Tumor; B-Cell Chronic Lymphocytic Leukemia; Multiple Myeloma (Kahler Disease) |
| Sapelizumab | Interleukin 6 Receptor; IL6R | Rheumatoid Arthritis; Neuromyelitis Optica (Devic's Syndrome) |
| Sarilumab | Interleukin 6 Receptor; IL6R | Oligoarticular Idiopathic Juvenile Arthritis; Polyarticular Juvenile Idiopathic Arthritis (PJIA); Systemic-Onset Juvenile Idiopathic Arthritis (Still Disease); Ankylosing Spondylitis (Bekhterev's Disease); Intermediate Uveitis; Posterior Uveitis; Uveitis; Rheumatoid Arthritis |
| Satumomab, Satumomab pendetide | Insulin Receptor; IR; CD220; INSR; EC 2.7.10.1; TAG-72 | Type 1 Diabetes (Juvenile Diabetes); Type 2 Diabetes; Cancer (Diagnosis) |
| Secukinumab | Interleukin 17; IL17; Interleukin 17A; Cytotoxic T Lymphocyte Associated Antigen B; CTLA8; IL17A | Axial Spondyloarthritis; Psoriasis; Ankylosing Spondylitis (Bekhterev's Disease); Psoriatic Arthritis; Plaque Psoriasis (Psoriasis Vulgaris); Congenital Ichthyosis; Netherton Syndrome (Trichorrhexis Invaginata; Bamboo Hair); Systemic-Onset Juvenile Idiopathic Arthritis (Still Disease); Alopecia; Atopic Dermatitis; Contact Dermatitis; Crohn's Disease (Regional Enteritis); Neutrophilia; Type I Diabetes (Juvenile Diabetes); Keratoconjunctivitis sicca (Dry Eye); Relapsing Multiple Sclerosis (RMS); Relapsing Remitting Multiple Sclerosis (RRMS); Uveitis; Rheumatoid Arthritis; Asthma |
| Selicrelumab | CD40; tumor necrosis factor receptor superfamily member 5; TNFRSF5 | Solid Cancer |
| Senlizumab | Tumor Necrosis Factor; Cachectin; TNF Alpha; Tumor Necrosis Factor Ligand Superfamily Member 2; TNF a; TNF | Septic Shock; Crohn's Disease (Regional Enteritis) |
| Seribantumab | Receptor Tyrosine Protein Kinase ERBB 3; Proto Oncogene Like Protein c ErbB 3; Tyrosine Kinase Type Cell Surface Receptor HER3; HER3; ERBB3; EC 2.7.10.1 | Bile Duct Cancer (Cholangiocarcinoma); Breast Cancer; Endometrial Cancer; Epithelial Ovarian Cancer; Fallopian Tube Cancer; Metastatic Breast Cancer; Ovarian Cancer; Peritoneal Cancer; Solid Tumor; Colorectal Cancer; Head and Neck Cancer Squamous Cell Carcinoma; Non-Small Cell Lung Cancer |
| Setoxaximab | Shiga Toxin Type 2; stx2 | *Escherichia coli* Infections; Typical Hemolytic Bromic Syndrome (Shiga-Toxin Associated Hemolytic Uremic Syndrome) |
| Sevirumab | Human Cytomegalovirus Glycoprotein H; gH | Cytomegalovirus (CMV) Retinitis; Cytomegalovirus (HHV-5) Infections |
| Sibrotuzumab | Prolyl Endopeptidase FAP; 170 kDa Melanoma Membrane Bound Gelatinase; Dipeptidyl Peptidase FAP; Integral Membrane Serine Protease; Fibroblast Activation Protein Alpha; Gelatine Degradation Protease FAP; Seprase; FAP; EC 3.4.21.26; EC 3.4.14.5 | Metastatic Colorectal Cancer; Non-Small Cell Lung Cancer |
| Sifalimumab | Interferon Alpha; IFNA | Systemic Lupus Erythematosus; Dermatomyositis; Polymyositis; Plaque Psoriasis (Psoriasis Vulgaris) |
| Siltuximab | Interleukin 6; B Cell Stimulatory Factor 2; BSF2; CTL Differentiation Factor; CDF; Hybridoma Growth Factor; Interferon Beta 2; IFNB2; IL6 | B-Cell Non-Hodgkin Lymphoma; Metastatic Hormone Refractory (Castration Resistant; androgen-Independent) Prostate Cancer; Metastatic Renal Cell Carcinoma; Myelodysplastic Syndrome; Refractory Multiple Myeloma; Relapsed Multiple Myeloma; Multiple Myeloma (Kahler Disease); Giant Lymph Node Hyperplasia (Castleman's Disease) |
| Simtuzumab | Lysyl Oxidase Homolog 2; Lysyl Oxidase Like Protein 2; Lysyl Oxidase Related Protein 2; Lysyl Oxidase Related Protein WS9-14; LOXL2; EC 1.4.3.13 | Idiopathic Pulmonary Fibrosis; Adenocarcinoma; Metastatic Adenocarcinoma of The Pancreas; Metastatic Colorectal Cancer; Myelofibrosis; Post-Polycythemia Vera Myelofibrosis (PPV-MF); Thrombocythemia Myelofibrosis; Liver Cirrhosis; Liver Fibrosis; Non-Alcoholic Steatohepatitis; Primary Sclerosing Cholangitis |

TABLE 11-continued

Antibodies, their targets and diseases, disorders or conditions related to the antibodies.

| Antibody Name | Target | Related Disease, Disorder or Condition |
|---|---|---|
| Siplizumab | T Cell Surface Antigen CD2; Erythrocyte Receptor; LFA2; LFA3 Receptor; Rosette Receptor; T Cell Surface Antigen T11/Leu 5; CD2 | Leukemias; Natural Killer Cell Lymphomas; Kidney Disease; Graft Versus Host Disease (GVHD); Kidney Transplant Rejection; Plaque Psoriasis (Psoriasis Vulgaris); Cutaneous T-Cell Lymphoma; Peripheral T-Cell Lymphomas (PTCL); T-Cell Lymphomas |
| Sirukumab | Interleukin 6; B Cell Stimulatory Factor 2; BSF2; CTL Differentiation Factor; CDF; Hybridoma Growth Factor; Interferon Beta 2; IFNB2; IL6 | Rheumatoid Arthritis; Giant Cell Arteritis; Major Depressive Disorder; Polymyalgia Rheumatica; Asthma; Cutaneous Lupus Erythematosus; Systemic Lupus Erythematosus; Lupus Nephritis |
| Sofituzumab vedotin | Mucin 16; Ovarian Cancer Related Tumor Marker CA125; Ovarian Carcinoma Antigen CA125; MUC16 | Ovarian Cancer; Fallopian Tube Cancer; Epithelial Ovarian Cancer; Pancreatic Cancer; Peritoneal Cancer |
| Solanezumab | Amyloid Beta Peptide; A beta P; Abeta; Beta Amyloid | Alzheimer's Disease; Dementia Associated With Alzheimer's Disease |
| Solitomab | Epithelial Cell Adhesion Molecule; Adenocarcinoma Associated Antigen; Cell Surface Glycoprotein Trop 1; Epithelial Cell Surface Antigen; Epithelial Glycoprotein 314; KS ¼ Antigen; KSA; Tumor Associated Calcium Signal Transducer 1; CD326; EPCAM; T Cell Surface Glycoprotein CD3 Epsilon Chain; T Cell Surface Antigen T3/Leu 4 Epsilon Chain; CD3E | Adenocarcinoma Of The Gastroesophageal Junction; Breast Cancer; Colorectal Cancer; Gastric Cancer; Hormone Refractory (Castration Resistant; androgen-Independent) Prostate Cancer; Lung Adenocarcinoma; Ovarian Cancer; Small-Cell Lung Cancer; Solid Tumor |
| Sonepcizumab | Sphingosine 1-Phosphate Receptor 1; Endothelial Differentiation G Protein Coupled Receptor 1; Sphingosine 1 Phosphate Receptor Edg 1; CD363; SIPRI | Choroidal Neovascularization; Retinal Pigment Epithelial (RPE) Detachment; Wet (Neovascular/Exudative) Macular Degeneration; Renal Cell Carcinoma; Solid Tumor; Diabetic Retinopathy; Multiple Sclerosis; Colitis |
| Sontuzumab | Mucin 1; Breast Carcinoma Associated Antigen DF3; Episialin; H23AG; Krebs Von Den Lungen 6; PEMT; Peanut Reactive Urinary Mucin; Polymorphic Epithelial Mucin; Tumor Associated Epithelial Membrane Antigen; Tumor Associated Mucin; CD227; MUC1 | Advanced Malignancy; Breast Cancer |
| Stamulumab | Growth/Differentiation Factor 8; Myostatin; GDF8; MSTN | Muscular Dystrophy |
| Suptavumab | Respiratory Syncytial Virus Fusion Protein; RSV F Protein | Respiratory Syncytial Virus (RSV) Infections |
| Suvizumab | Human Immunodeficiency Virus Type 1; HIV-1 envelope glycoprotein gp120 third variable loop V3 | Human Immunodeficiency Virus (HIV) Infections (AIDS) |
| Suvratoxumab | *Staphylococcus aureus* Alpha Hemolysin; Alpha Toxin; hly | *Staphylococcus aureus* Infections; Ventilator Associated Pneumonia (VAP) |
| Tabalumab | Tumor Necrosis Factor Ligand Superfamily Member 13B; B Lymphocyte Stimulator; Dendritic Cell Derived TNF Like Molecule; TNF and APOL Related Leukocyte Expressed Ligand 1; CD257; TNFSF13B | Relapsing Remitting Multiple Sclerosis (RRMS); End-Stage Kidney Disease (End-Stage Renal Disease; ESRD); Rheumatoid Arthritis; Systemic Lupus Erythematosus; Multiple Myeloma (Kahler Disease) Refractory Multiple Myeloma; Relapsed Multiple Myeloma |
| Tacatuzumab, Tacatuzumab tetraxetan | Alpha Fetoprotein Receptor; AFPR | Liver Cancer |
| Tadocizumab | Integrin Alpha 2b; GPalpha IIb; Platelet Membrane Glycoprotein IIb; CD41; ITGA2B Antagonist | Coronary Thrombosis; Cerebral Infarction (Brain Infarction) |
| Talizumab | Immunoglobulin E; IgE | Peanut Allergy; allergy |
| Tamtuvetmab | Canis familiaris T cell | Infectious Disease; Oncology |
| Tanezumab | Beta Nerve Growth Factor; Beta NGF; NGF | Chronic Pancreatitis Pain; Chronic Visceral Pain; Diabetic Neuropathic Pain; Neuropathic Pain; Cancer Pain; Chronic Pain; Low Back Pain; Osteoarthritis Pain; Interstitial Cystitis (Painful Bladder Syndrome) |
| Tarextumab | Neurogenic Locus Notch Homolog Protein 2; NOTCH2; Neurogenic Locus Notch Homolog Protein 3; NOTCH3 | Small-Cell Lung Cancer; Solid Tumor; Metastatic Pancreatic Cancer |
| Tavolixizumab | Tumor Necrosis Factor Receptor Superfamily Member 4; ACT35 Antigen; TAX Transcriptionally Activated Glycoprotein I Receptor; OX40L Receptor; CD134; TNFRSF4 | Solid Tumor; Head and Neck Cancer Squamous Cell Carcinoma |
| Tefibazumab | Clumping Factor A; Fibrinogen Receptor A; Fibrinogen Binding Protein A; clfA | *Staphylococcus aureus* Infections |
| Telisotuzumab, Telisotuzuab vedotin | Hepatocyte Growth Factor Receptor; Proto Oncogene c Met; Tyrosine Protein Kinase Met; HGF/SF Receptor; Scatter Factor Receptor; MET; EC 2.7.10.1 | Solid Tumor |

TABLE 11-continued

Antibodies, their targets and diseases, disorders or conditions related to the antibodies.

| Antibody Name | Target | Related Disease, Disorder or Condition |
|---|---|---|
| Tenatumomab | Tenascin; Cytotactin; GMEM; GP 150-225; Glioma Associated Extracellular Matrix Antigen; Hexabrachion; JI; Myotendinous Antigen; Neuronectin; Tenascin C; TNC | Breast Cancer; Lung Cancer; Ovarian Cancer; Colorectal Cancer; B-Cell Non-Hodgkin Lymphoma; T-Cell Lymphomas |
| Teneliximab | Tumor Necrosis Factor Receptor Superfamily Member 5; B Cell Surface Antigen CD40; Bp50; CDw40; CD40L Receptor; TNFRSF5; CD40 | Kidney Transplant Rejection; Transplant Rejection |
| Teplizumab | T Cell Surface Glycoprotein CD3 Epsilon Chain; T Cell Surface Antigen T3/Leu 4 Epsilon Chain; CD3E | Psoriasis |
| Teprotumumab | Insulin Like Growth Factor 1 Receptor; CD221; IGF1R; EC 2.7.10.1 | Graves' Ophthalmopathy; Diabetic Macular Edema; Solid Tumor; Breast Cancer; Ewing Sarcoma; Non-Small Cell Lung Cancer; Osteosarcoma; Rhabdomyosarcoma; Sarcomas; Synovial Sarcoma; |
| Tesidolumab | Complement C5; C3 and PZP Like Alpha 2 Macroglobulin Domain Containing Protein 4; C5 | Thrombotic Microangiopathy Paroxysmal Nocturnal Hemoglobinuria Dry (Atrophic) Macular Degeneration; Intermediate Uveitis; Posterior Uveitis; Uveitis End-Stage Kidney Disease (End-Stage Renal Disease; ESRD) Wet (Neovascular/Exudative) Macular Degeneration |
| Tezepelumab | Thymic Stromal Lymphopoietin; TSLP | Atopic Dermatitis; Cat Allergy; Allergic Asthma |
| ThioMAb-chMA79b | CD79 | |
| ThioMAb-huMA79b.v17 | CD79 | |
| ThioMAb-huMA79b.v18 | CD79 | |
| ThioMAb-huMA79b.v28 | CD79 | |
| Tigatuzumab, Igatuzuab | Tumor Necrosis Factor Receptor Superfamily Member 5; B Cell Surface Antigen CD40; Bp50; CDw40; CD40L Receptor; TNFRSF5; CD40; TRAIL-R2 | Adenocarcinoma; Brenner Tumor; Carcinomas; Lymphoma; Metastatic Breast Cancer; Metastatic Colorectal Cancer; Metastatic Ovarian Cancer; Metastatic Pancreatic Cancer; Non-Small Cell Lung Cancer; Transitional Cell Carcinoma (Urothelial Cell Carcinoma); Hepatocellular Carcinoma |
| Tildrakizumab | Interleukin 23 Subunit Alpha; Interleukin 23 Subunit p19; IL23A | Ankylosing Spondylitis (Bekhterev's Disease); Axial Spondyloarthritis; Psoriatic Arthritis; Plaque Psoriasis (Psoriasis Vulgaris) |
| Timigutuzumab | ERBB2; epidermal growth factor receptor 2; receptor tyrosine-protein kinase | Breast Cancer; Adenocarcinoma Of The Gastroesophageal Junction; Gastric Cancer; Metastatic Breast Cancer |
| Timolumab | Membrane Primary Amine Oxidase; Copper Amine Oxidase; Semicarbazide-Sensitive Amine Oxidase; Vascular Adhesion Protein 1; HPAO; AOC3; EC 1.4.3.21 | Primary Sclerosing Cholangitis; Neurology; Plaque Psoriasis (Psoriasis Vulgaris); Rheumatoid Arthritis; Chronic Obstructive Pulmonary Disease (COPD); Inflammatory Bowel Disease; Psoriasis; Rheumatoid Arthritis |
| Tisotumab vedotin | Tissue Factor; TF | Ovarian Cancer; Non-Small Cell Lung Cancer; Esophageal Cancer; Cervical Cancer; Bladder Cancer; Endometrial Cancer; Head and Neck Cancer Squamous Cell Carcinoma; Hormone Refractory (Castration Resistant; androgen-Independent) Prostate Cancer; Pancreatic Cancer; Cancer |
| Tocilizumab | Interleukin 6 Receptor; IL6R | Systemic Sclerosis (Scleroderma); Amyotrophic Lateral Sclerosis; Dermatomyositis; Polymyositis; Pulmonary Arterial Hypertension; Schnitzler Syndrome; B-Cell Chronic Lymphocytic Leukemia; Polymyalgia Rheumatica; Giant Lymph Node Hyperplasia (Castleman's Disease); Ankylosing Spondylitis (Bekhterev's Disease); Metastatic Pancreatic Cancer; Giant Cell Arteritis; Polyarticular Juvenile Idiopathic Arthritis (PJIA); Systemic Idiopathic Juvenile Arthritis; Giant Lymph Node Hyperplasia (Castleman's Disease); Rheumatoid Arthritis; Rheumatoid Arthritis; Takayasu Arteritis; Vasculitis" |
| Tomuzotuximab | Epidermal Growth Factor Receptor; Proto Oncogene c ErbB 1; Receptor Tyrosine Protein Kinase erbB 1; HER1; ERBB1; EGFR; EC 2.7.10.1 | Head and Neck Cancer Squamous Cell Carcinoma; Metastatic Colorectal Cancer; Non-Small Cell Lung Cancer; Solid Tumor |
| Toralizumab | CD40 Ligand; T Cell Antigen Gp39; TNF Related Activation Protein; Tumor Necrosis Factor Ligand Superfamily Member 5; CD154; CD40LG | Multiple Sclerosis; Crohn's Disease (Regional Enteritis); Idiopathic Thrombocytopenic Purpura (Immune Thrombocytopenic Purpura); Autoimmune Disorders; Psoriasis; Systemic Lupus Erythematosus |
| Tosatoxumab | *Staphylococcus aureus* Alpha Hemolysin; Alpha Toxin; hly | Community Acquired Pneumonia; Hospital Acquired Pneumonia (HAP); Sepsis; Ventilator Associated Pneumonia (VAP) |
| Tositumomab | B Lymphocyte Antigen CD20; B Lymphocyte Surface Antigen B1; Bp35; Leukocyte Surface Antigen Leu 16; Membrane Spanning 4 Domains Subfamily A Member 1; CD20; MS4A1 | B-Cell Non-Hodgkin Lymphoma; Follicular Lymphoma |

TABLE 11-continued

Antibodies, their targets and diseases, disorders or conditions related to the antibodies.

| Antibody Name | Target | Related Disease, Disorder or Condition |
|---|---|---|
| Tovetumab | Platelet Derived Growth Factor Receptor Alpha; Alpha Type Platelet Derived Growth Factor Receptor; CD140 Antigen Like Family Member A; Platelet Derived Growth Factor Receptor 2; CD140a; PDGFRA; EC 2.7.10.1 Antagonist | Solid Tumor; Hepatocellular Carcinoma; Advanced Malignancy; Glioblastoma Multiforme (GBM); Non-Small Cell Lung Cancer; |
| Tralokinumab | Interleukin 13; IL13 | Ulcerative Colitis; Idiopathic Pulmonary Fibrosis; Atopic Dermatitis; Asthma |
| Trastuzumab, Trastuzumab duocarmazine, Trastuzumab emtansine, rhuMab HER2, rhuMab HER2(9C1), Herceptin, | Receptor Tyrosine Protein Kinase ERBB 2; Metastatic Lymph Node Gene 19 Protein; Proto Oncogene Neu; Proto Oncogene C ErbB 2; Tyrosine Kinase Type Cell Surface Receptor HER2; p185erbB2; HER2; CD340; ERBB2; HER2/neu; EC 2.7.10.1 | Gastric Cancer; Metastatic Breast Cancer; Metastatic Transitional (Urothelial) Tract Cancer; Pancreatic Cancer; Adenocarcinoma Of The Gastroesophageal Junction; Breast Cancer; Gastric Cancer; Cancer |
| TRC-105, TRC105 | Endoglin; CD105; ENG | Breast Cancer; Non-Small Cell Lung Cancer; Fallopian Tube Cancer; Epithelial Ovarian Cancer; Colorectal Cancer; Bladder Cancer; Metastatic Breast Cancer; Angiosarcoma; Choriocarcinoma (Gestational Trophoblastic Neoplasia); Hepatocellular Carcinoma; Hormone Refractory (Castration Resistant; androgen-Independent) Prostate Cancer; Metastatic Renal Cell Carcinoma; Myocardial Fibrosis; Peritoneal Cancer; Recurrent Glioblastoma Multiforme (GBM); Transitional Cell Carcinoma (Urothelial Cell Carcinoma); Wet (Neovascular/Exudative) Macular Degeneration |
| Tregalizumab | T Cell Surface Glycoprotein CD4; T Cell Surface Antigen T4/Leu 3; CD4 Activator | Multiple Sclerosis; Plaque Psoriasis (Psoriasis Vulgaris); Rheumatoid Arthritis |
| Tremelimumab, Ticiliuab, Ticilimumab | Cytotoxic T Lymphocyte Protein 4; Cytotoxic T Lymphocyte Associated Antigen 4; CD152; CTLA4; CTLA-4 | Non-Small Cell Lung Cancer; Adenocarcinoma Of The Gastroesophageal Junction; Epithelial Ovarian Cancer; Fallopian Tube Cancer; Gastric Cancer; Hepatocellular Carcinoma; Metastatic Breast Cancer; Peritoneal Cancer; Human Immunodeficiency Virus (HIV) Infections (AIDS); Bladder Cancer; Colorectal Cancer; Gastrointestinal Tract Cancer; Prostate Cancer; Renal Cell Carcinoma; Malignant Pleural Mesothelioma; Metastatic Melanoma; Metastatic Pancreatic Cancer |
| Trevogrumab | Growth/Differentiation Factor 8; Myostatin; GDF8; MSTN | Sarcopenia |
| Tucotuzumab, Tucotuzumab celmoleukin | Epithelial Cell Adhesion Molecule; Adenocarcinoma Associated Antigen; Cell Surface Glycoprotein Trop 1; Epithelial Cell Surface Antigen; Epithelial Glycoprotein 314; KS 1/4 Antigen; KSA; Tumor Associated Calcium Signal Transducer 1; CD326; EPCAM; EpCAM | Ovarian Cancer; Prostate Cancer; Renal Cell Carcinoma; Non-Small Cell Lung Cancer; Colorectal Cancer; Small-Cell Lung Cancer; Cancer |
| Tuvirumab | Hepatitis B Virus Surface Antigen; HBsAg | Hepatitis B |
| Ublituximab | B Lymphocyte Antigen CD20; B Lymphocyte Surface Antigen B1; Bp35; Leukocyte Surface Antigen Leu 16; Membrane Spanning 4 Domains Subfamily A Member 1; CD20; MS4A1 | Chronic Lymphocytic Leukemia (CLL); Relapsed Chronic Lymphocytic Leukemia (CLL); B-Cell Non-Hodgkin Lymphoma; Mantle Cell Lymphoma; Neuromyelitis Optica (Doves Syndrome); Refractory Chronic Lymphocytic Leukemia (CLL); Relapsed Chronic Lymphocytic Leukemia (CLL) |
| Ulocuplumab | C—X—C Chemokine Receptor Type 4; FB22; Fusin; HM89; LCR1; Leukocyte Derived Seven Transmembrane Domain Receptor; Lipopolysaccharide Associated Protein 3; Stromal Cell Derived Factor 1 Receptor; NPYRL; CD184; CXCR4 | Acute Myelocytic Leukemia (AML; Acute Myeloblestic Leukemia); Refractory Multiple Myeloma; Relapsed Multiple Myeloma; Diffuse Large B-Cell Lymphoma; Follicular Lymphoma; Metastatic Pancreatic Cancer; Refractory Acute Myeloid Leukemia; Refractory Chronic Lymphocytic Leukemia (CLL); Relapsed Acute Myeloid Leukemia; Relapsed Chronic Lymphocytic Leukemia (CLL); Small-Cell Lung Cancer |
| Urelumab | Tumor Necrosis Factor Receptor Superfamily Member 9; 4-IBB Ligand Receptor; T Cell Antigen 4-IBB Humolog; T Cell Antigen ILA; CD137; TNFRSF9 | Diffuse Large B-Cell Lymphoma; Head and Neck Cancer Squamous Cell Carcinoma; Metastatic Melanoma; Non-Small Cell Lung Cancer; Follicular Lymphoma; Gliosarcoma; Metastatic Colorectal Cancer; Recurrent Glioblastoma Multiforme (GBM); Chronic Lymphocytic Leukemia (CLL); Lymphoma; Refractory Chronic Lymphocytic Leukemia (CLL); Relapsed Chronic Lymphocytic Leukemia (CLL) |

TABLE 11-continued

Antibodies, their targets and diseases, disorders or conditions related to the antibodies.

| Antibody Name | Target | Related Disease, Disorder or Condition |
|---|---|---|
| Urtoxazumab | Shiga Toxin Type 2; stx2 | *Escherichia coli* Infections |
| Ustekinumab | Interleukin 12 Subunit Beta; Cytotoxic Lymphocyte Maturation Factor 40 kDa Subunit; CLMF p40; IL12 Subunit p40 NK Cell Stimulatory Factor Chain 2; IL12B | Ulcerative Colitis; Axial Spondyloarthritis; Systemic Lupus Erythematosus; Type I Diabetes (Juvenile Diabetes); Crohn's Disease (Regional Enteritis); Relapsing Remitting Multiple Sclerosis (RRMS); Hidradenitis Suppurativa; Plaque Psoriasis (Psoriasis Vulgaris); Psoriasis; Rheumatoid Arthritis; Primary Biliary Cirrhosis; Atopic Dermatitis; Sarcoidosis; Psoriatic Arthritis; Plaque Psoriasis (Psoriasis Vulgaris); Crohn's Disease (Regional Enteritis)" |
| utomilumab | Tumor Necrosis Factor Receptor Superfamily Member 9; 4-IBB Ligand Receptor; T Cell Antigen 4-IBB Humping; T Cell Antigen ILA; CD137; TNFRSF9 | Anaplastic Thyroid Cancer; Bladder Cancer; Cervical Cancer; Diffuse Large B-Cell Lymphoma; Follicular Lymphoma; Gastric Cancer; Metastatic Hepatocellular Carcinoma (HCC); Ovarian Cancer; Pancreatic Cancer; Renal Cell Carcinoma; Sarcomas; Thymoma (Thymic Epithelial Tumor); Colorectal Cancer; Head and Neck Cancer Squamous Cell Carcinoma; Metastatic Breast Cancer; Metastatic Melanoma; Non-Small Cell Lung Cancer; Small-Cell Lung Cancer |
| Vadastuximab, Vadastuximab talirine | Myeloid Cell Surface Antigen CD33; Sialic Acid Binding Ig Like Lectin 3; gp67; CD33 | Acute Myelocytic Leukemia (AML; Acute Myeloblastic Leukemia); Myelodysplastic Syndrome; Refractory Acute Myeloid Leukemia; Relapsed Acute Myeloid Leukemia |
| Vandortuzumab, Vandortuzumab vedotin | Metalloreductase STEAP1; Six Transmembrane Epithelial Antigen Of The Prostate 1; STEAP1; EC 1.16.1. | Metastatic Hormone Refractory (Castration Resistant; androgen-Independent) Prostate Cancer |
| Vantictumab | Frizzled 7; hFz7; FzE3; FZD7 | Metastatic Breast Cancer; Non-Small Cell Lung Cancer; Pancreatic Ductal Adenocarcinoma |
| Vanucizumab | Angiopoietin 2; Ang 2; ANGPT2; Vascular Endothelial Growth Factor A; Vascular Permeability Factor; VEGFA | Metastatic Colorectal Cancer; Epithelial Ovarian Cancer; Fallopian Tube Cancer; Peritoneal Cancer; Solid Tumor |
| Vapaliximab | Membrane Primary Amine Oxidase; Copper Amine Oxidase; Semicarbazide-Sensitive Amine Oxidase; Vascular Adhesion Protein 1; HPAD; ADC3; EC 1.4.3.21 | Inflammation |
| Varisacumab, Apagin | Vascular Endothelial Growth Factor A; Vascular Permeability Factor; VEGFA | Metastatic Cancer; Oncology |
| Varlilumab | CD27 Antigen; CD27L Receptor; T Cell Activation Antigen CD27; Tumor Necrosis Factor Receptor Superfamily Member 7; T14; TNFRSF7; CD27 | Bladder Cancer; Breast Cancer; Colorectal Cancer; Fallopian Tube Cancer; Glioblastoma Multiforme (GBM); Head and Neck Cancer Squamous Cell Carcinoma; Metastatic Melanoma; Non-Small Cell Lung Cancer; Ovarian Cancer; Renal Cell Carcinoma; Colorectal Cancer; Hormone Refractory (Castration Resistant; androgen-Independent) Prostate Cancer; Leukemias; Lymphoma; Metastatic Melanoma; Non-Small Cell Lung Cancer; Ovarian Cancer; Renal Cell Carcinoma |
| Vatelizumab | Integrin Alpha 2; CD49 Antigen Like Family Member B; Collagen Receptor; Platelet Membrane Glycoprotein 1a; VLA 2 Subunit Alpha; CD49b; ITGA2 | Crohn's Disease (Regional Enteritis); Ulcerative Colitis; Relapsing Remitting Multiple Sclerosis (RRMS) |
| Vedolizumab | Integrin Alpha 4; CD49 Antigen Like Family Member D; VLA4 Subunit Alpha; CD49d; ITGA4; Integrin Beta 7; Gut Homing Receptor Beta Subunit; ITGB7 | Primary Sclerosing Cholangitis; Celiac Disease; Graft Versus Host Disease (GVHD); Human Immunodeficiency Virus (HIV) Infections (AIDS); Melanoma; Crohn's Disease (Regional Enteritis); Ulcerative Colitis" |
| Veltuzumab | B Lymphocyte Antigen CD20; B Lymphocyte Surface Antigen B1; Bp35; Leukocyte Surface Antigen Leu 16; Membrane Spanning 4 Domains Subfamily A Member 1; CD20; MS4A1 | Idiopathic Thrombocytopenic Purpura (Immune Thrombocytopenic Purpura); Non-Hodgkin Lymphoma; Pemphigus Vulgaris; Acute Lymphocytic Leukemia (ALL; Acute Lymphoblastic Leukemia); Chronic Lymphocytic Leukemia (CLL); Follicular Lymphoma; Systemic Lupus Erythematosus; Rheumatoid Arthritis |
| Vepalimomab | Membrane Primary Amine Oxidase; Copper Amine Oxidase; Semicarbazide-Sensitive Amine Oxidase; Vascular Adhesion Protein 1; HPAD; ADC3; EC 1.4.3.21 | Contact Dermatitis; Ulcerative Colitis; Psoriasis |
| Vesencumab | Neuropilin 1; Vascular Endothelial Cell Growth Factor 165 Receptor; CD304; NRP1 | Solid Tumor |
| Visilizumab | T Cell Surface Glycoprotein CD3 Epsilon Chain; T Cell Surface Antigen T3/Leu 4 Epsilon Chain; CD3E | Graft Versus Host Disease (GVHD); Crohn's Disease (Regional Enteritis); Ulcerative Colitis |
| Vobarilizumab | Interleukin 6 Receptor; IL6R | Rheumatoid Arthritis; Systemic Lupus Erythematosus |
| Volociximab | Integrin Alpha 5; CD49 Antigen Like Family Member E; Fibronectin Receptor Subunit Alpha; Integrin Alpha F; VLA 5; CD49e; ITGA5; Integrin Beta 1; Fibronectin Receptor Subunit Beta; Glycoprotein Iia; VLA 4 Subunit Beta; CD29; ITGB1 | Age Related Macular Degeneration; Metastatic Melanoma; Metastatic Pancreatic Cancer; Non-Small Cell Lung Cancer; Ovarian Cancer; Peritoneal Tumor; Renal Cell Carcinoma |
| Vorsetuzumab, Vorsetuzumab mafodotin | CD70 Antigen; CD27 Ligand; Tumor Necrosis Factor Ligand Superfamily Member 7; CD70 | Autoimmune Disorders; Cancer |

TABLE 11-continued

Antibodies, their targets and diseases, disorders or conditions related to the antibodies.

| Antibody Name | Target | Related Disease, Disorder or Condition |
|---|---|---|
| Vunakizumab | Interleukin 17A; Cytotoxic T Lymphocyte Associated Antigen B; CTLA8; IL17A | Psoriasis |
| Xentuzumab | Insulin Like Growth Factor I; Mechano Growth Factor; Somatomedin C; IGF1; Insulin Like Growth Factor II; Somatomedin A; T3M II Derived Growth Factor; IGF2 | Non-Small Cell Lung Cancer; Metastatic Breast Cancer; Solid Tumor; Metastatic Hormone Refractory (Castration Resistant, androgen-Independent) Prostate Cancer |
| Zalutumumab | Epidermal Growth Factor Receptor; Proto Oncogene c ErbB 1; Receptor Tyrosine Protein Kinase erbB 1; HER1; ERBB1; EGFR; EC 2.7.10.1 | Non-Small Cell Lung Cancer; Squamous Cell Carcinoma; Colorectal Cancer; Head and Neck Cancer; Metastatic Cancer |
| Zanolimumab | T Cell Surface Glycoprotein CD4; T Cell Surface Antigen T4/Leu 3; CD4 | Psoriasis; Rheumatoid Arthritis; Cutaneous T-Cell Lymphoma; Sezary Syndrome; Mycosis Fungoides; T-Cell Lymphomas |
| Zatuximab | Epidermal Growth Factor Receptor; Proto Oncogene c ErbB 1; Receptor Tyrosine Protein Kinase erbB 1; HER1; ERBB1; EGFR; EC 2.7.10.1 | Glioblastoma Multiforme (GBM); Metastatic Colorectal Cancer; Recurrent Head and Neck Cancer Squamous Cell Carcinoma; Squamous Non-Small Cell Lung Cancer; Esophageal Cancer; Solid Tumor |

Preferably, the RNA according to the present invention, the combination of RNA's according to the present invention, the composition according to the present invention, the vaccine according to the present invention, or the pharmaceutically active component of the kit according to the present invention is administered by injection, preferably by needle-less injection, more preferably by jet injection.

It is also preferred that the treatment of the diseases/disorders as described above (therapy or prophylaxis) by using the RNA according to the present invention, the combination of RNA's according to the present invention, the composition according to the present invention, the vaccine according to the present invention, or the kit according to the present invention comprises the administration of a further pharmaceutical compound. Such a further pharmaceutical compound is preferably a chemotherapeutic agent or a kinase inhibitor, in particular in the context of treatment of cancer. Moreover, in particular in the context of cancer treatment, the treatment or prophylaxis as described herein may preferably further comprise radiation therapy.

It is also preferred that the treatment of the diseases/disorders as described above (therapy or prophylaxis) by using the RNA according to the present invention, the combination of RNA's according to the present invention, the composition according to the present invention, the vaccine according to the present invention, or the kit according to the present invention further comprises the administration of at least one modulator of an inhibitory and/or a stimulatory checkpoint molecule, such as an inhibitor of an inhibitory checkpoint molecule, preferably an inhibitor of CTLA-4 or of the PD-1 pathway.

The present invention also provides methods of treating or preventing the diseases and/or disorders as described above by administering to a subject in need thereof a (pharmaceutically) effective amount of the RNA, the combination of RNA's, the pharmaceutical composition or the vaccine according to the invention. Such a method typically comprises an optional first step of preparing the RNA, the combination of RNA's, the composition or the vaccine of the present invention, and a second step, comprising administering (a pharmaceutically effective amount of) said composition or vaccine to a patient/subject in need thereof. A subject in need thereof will preferably be a mammal. In the context of the present invention, the mammal is preferably selected from the group comprising, without being limited thereto, e.g. goat, cattle, swine, dog, cat, donkey, monkey, ape, a rodent such as a mouse, hamster, rabbit and, particularly, human, wherein the mammal typically suffers from the diseases and/or disorders as described above. Preferably, the disease/disorder is a cancer, a cardiovascular disease, an infectious disease, an autoimmune disease, a virus disease or a monogenetic disease.

In such a method according to the present invention also a combination of RNA's as described herein may be used, whereby the at least two RNA's of such a combination may be administered separately or in the same composition as described above. For example, in separate administration the at least two distinct RNA's may be administered at about the same time or consecutively via the same or different routes of administration as described above.

The subject receiving the RNA, the combination of RNA's, the pharmaceutical composition or the vaccine according to the invention may, for example, be a patient with cancer, preferably as defined herein, or a related condition, receiving chemotherapy (e.g. first-line or second-line chemotherapy), radiotherapy, chemoradiation (combination of chemotherapy and radiotherapy), tyrosine kinase inhibitors (e.g. EGFR tyrosine kinase inhibitors), antibody therapy and/or inhibitory and/or stimulatory checkpoint molecules (e.g. CTLA4 inhibitors, PD1 pathway inhibitors), or a patient, who has achieved partial response or stable disease after having received one or more of the treatments specified above. Support of the treatment or prophylaxis of cancer may be also envisaged in any of the other embodiments defined herein. Accordingly, any use of the RNA, the (pharmaceutical) composition or the vaccine according to the invention in co-therapy with any other approach, preferably one or more of the above therapeutic approaches, in particular in combination with surgery, radiation therapy, chemotherapy, chemoradiation, and/or treatment with kinase inhibitors, modulators of inhibitory and/or stimulatory checkpoint molecules or antibodies is within the scope of the present invention. In particular, modulators of inhibitory and/or stimulatory checkpoint molecules used for combination with the RNA, the vaccine or the (pharmaceutical) composition according to the invention may be encoded by a nucleic acid, preferably an RNA and most preferably by an mRNA.

For administration, preferably any of the administration routes may be used as defined herein. In particular, an administration route is used, which is suitable for treating or preventing any of the disorders and/or diseases as described herein. Administration of the composition and/or the vaccine according to the invention may then occur prior, concurrent and/or subsequent to administering another composition and/or vaccine as defined herein, which may—in addition—contain another RNA or combination of RNAs encoding different fragments of the same antibody or different antibodies, wherein each antibody encoded by the RNA according to the invention is preferably suitable for the treatment or prophylaxis of any of the disorders and/or diseases as described herein. In this context, a treatment as defined herein may also comprise the modulation of a disease associated to the of the disorders and/or diseases as described herein.

According to a preferred embodiment of this aspect of the invention, the (pharmaceutical) composition or the vaccine according to the invention is administered by injection. Any suitable injection technique known in the art may be employed. Preferably, the inventive composition is administered by injection, preferably by needle-less injection, for example by jet-injection.

In one embodiment, the inventive composition comprises at least two, three, four, five, six, seven, eight, nine, ten, eleven, twelve or more RNAs as defined herein, each of which is preferably injected separately, preferably by needle-less injection. Alternatively, the inventive composition comprises at least two, three, four, five, six, seven, eight, nine, ten, eleven, twelve or more RNAs, wherein the at least two, three, four, five, six, seven, eight, nine, ten, eleven, twelve or more RNAs are administered, preferably by injection as defined herein, as a mixture.

The (passive) immunization protocol for the immunization of a subject typically comprises a series of single doses or dosages of the (pharmaceutical) composition or the vaccine according to the invention. A single dosage, as used herein, refers to the initial/first dose, a second dose or any further doses, respectively. In this context, each single dosage preferably comprises the administration of RNA encoding the same antibody or the same combination of antibodies as defined herein, wherein the interval between the administration of two single dosages can vary from at least one day, preferably 2, 3, 4, 5, 6 or 7 days, to at least one week, preferably 2, 3, 4, 5, 6, 7 or 8 weeks. The intervals between single dosages may be constant or vary over the course of the immunization protocol, e.g. the intervals may be shorter in the beginning and longer towards the end of the protocol. Depending on the total number of single dosages and the interval between single dosages, the immunization protocol may extend over a period of time, which preferably lasts at least one week, more preferably several weeks (e.g. 2, 3, 4, 5, 6, 7, 8, 9, 10, 11 or 12 weeks), even more preferably several months (e.g. 3, 4, 5, 6, 7, 8, 9, 10, 11, 12, 18 or 24 months). Each single dosage preferably encompasses the administration of an RNA encoding an antibody, preferably of a combination of at least two, three, four, five, six, seven, eight, nine, ten, eleven, twelve or more antibodies as defined herein and may involve at least one, preferably 1, 2, 3, 4, 5, 6, 7, 8, 9, 10, 11 or 12 injections. In some cases, the composition or the vaccine according to the invention is administered as a single dosage typically in one injection. In the case, where the vaccine according to the invention comprises separate RNA formulations encoding distinct antibody fragments or distinct antibodies as defined herein, the minimum number of injections carried out during the administration of a single dosage may correspond to the number of separate components of the vaccine. In certain embodiments, the administration of a single dosage may encompass more than one injection for each component of the vaccine (e.g. a specific RNA formulation comprising an RNA encoding, for instance, one antibody as defined herein). For example, parts of the total volume of an individual component of the vaccine may be injected into different body parts, thus involving more than one injection. In a more specific example, a single dosage of a vaccine comprising four separate RNA formulations, each of which is administered in two different body parts, comprises eight injections. Typically, a single dosage comprises all injections required to administer all components of the vaccine, wherein a single component may be involve more than one injection as outlined above. In the case, where the administration of a single dosage of the vaccine according to the invention encompasses more than one injection, the injection are carried out essentially simultaneously or concurrently, i.e. typically in a time-staggered fashion within the time-frame that is required for the practitioner to carry out the single injection steps, one after the other. The administration of a single dosage therefore preferably extends over a time period of several minutes, e.g. 2, 3, 4, 5, 10, 15, 30 or 60 minutes.

Administration of the RNA as defined herein, the (pharmaceutical) composition or the vaccine according to the invention may be carried out in a time staggered treatment. A time staggered treatment may be e.g. administration of the RNA, the composition or the vaccine prior, concurrent and/or subsequent to a conventional therapy of any of the disorders and/or diseases as described herein, e.g. by administration of the RNA, the composition or the vaccine prior, concurrent and/or subsequent to a therapy or an administration of a therapeutic suitable for the treatment or prophylaxis of any of the disorders and/or diseases as described herein. Such time staggered treatment may be carried out using e.g. a kit, preferably a kit of parts as defined herein.

Time staggered treatment may additionally or alternatively also comprise an administration of the RNA as defined herein, the (pharmaceutical) composition or the vaccine according to the invention in a form, wherein the RNA encoding an antibody as defined herein or a fragment or variant thereof, preferably forming part of the composition or the vaccine, is administered parallel, prior or subsequent to another RNA encoding an antibody as defined above, preferably forming part of the same inventive composition or vaccine. Preferably, the administration (of all RNAs) occurs within an hour, more preferably within 30 minutes, even more preferably within 15, 10, 5, 4, 3, or 2 minutes or even within 1 minute. Such time staggered treatment may be carried out using e.g. a kit, preferably a kit of parts as defined herein.

In a preferred embodiment, the pharmaceutical composition or the vaccine of the present invention is administered repeatedly, wherein each administration preferably comprises individual administration of the at least one mRNA of the inventive composition or vaccine. At each time point of administration, the at least one mRNA may be administered more than once (e.g. 2 or 3 times). In a particularly preferred embodiment of the invention, at least two, three, four, five, six or more RNAs (each encoding a distinct one of the antibodies as defined herein) are administered at each time point, wherein each RNA is administered twice by injection, distributed over the four limbs.

BRIEF DESCRIPTION OF THE FIGURES

FIG. 2 shows the gene cluster for the light and the heavy chains of an antibody:
(A): Gene cluster for the light chain κ.
(B): Gene cluster for the light chain λ.
(C): and (D): Gene cluster for the heavy chain.
In this context, the variable region of a heavy chain is composed of three different gene segments. In addition to the V and J segments, additional D segments are also found here. The $V_H$, $D_H$ and $J_H$ segments can likewise be combined with one another virtually as desired to form the variable region of the heavy chain.

FIG. 4 shows an overview of the structure of various antibody fragments. The constituents of the antibody fragments are shown on a dark grey background.

FIG. 8 shows the wild-type DNA sequence of the heavy chain of the antibody rituximab (=Rituxan, MabThera) (wild-type: GC content: 56.5%, length: 1,344) (SEQ ID NO: 61161).

FIG. 9 shows a GC-optimized DNA sequence of the heavy chain of the antibody rituximab (=Rituxan, MabThera) (GC content: 65.9%, length: 1,344) (SEQ ID NO: 61162).

FIG. 10 shows the wild-type DNA sequence of the light chain of the antibody rituximab (=Rituxan, MabThera) (wild-type: GC content: 58.5%, length: 633) (SEQ ID NO: 61163).

FIG. 11 shows a GC-optimized DNA sequence of the light chain of the antibody rituximab (=Rituxan, MabThera) (GC content: 67.2%, length: 633) (SEQ ID NO: 61164).

FIG. 12 shows the total construct of a GC-optimized DNA sequence of the antibody rituximab (=Rituxan, MabThera) with the light and heavy chains (SEQ ID NO: 61165). The total construct contains the following sequences and cleavage sites (see also alternative cleavage sites of FIG. 25, SEQ ID NO: 61209):

---

Figure 1:
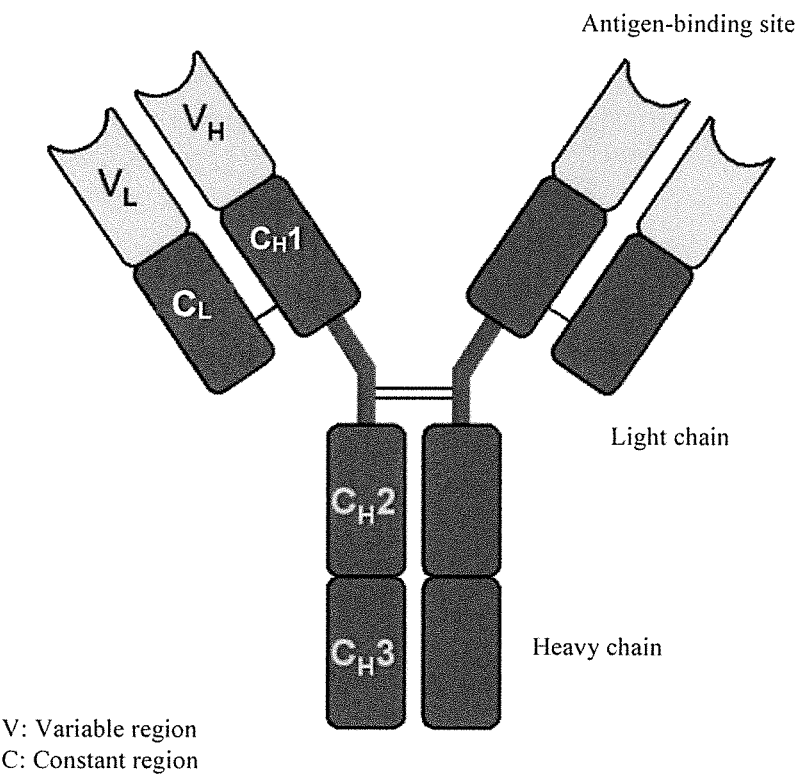
FIG. 1 illustrates the structure of an IgG antibody. IgG antibodies are built up from in each case two identical light and two heavy protein chains which are bonded to one another via disulfide bridges. The light chain comprises the N-terminal variable domain $V_L$ and the C-terminal constant domain $C_L$. The heavy chain of an IgG antibody can be divided into an N-terminal variable domain $V_H$ and three constant domains $C_H1$, $C_H2$ and $C_H3$.
Figure 3:
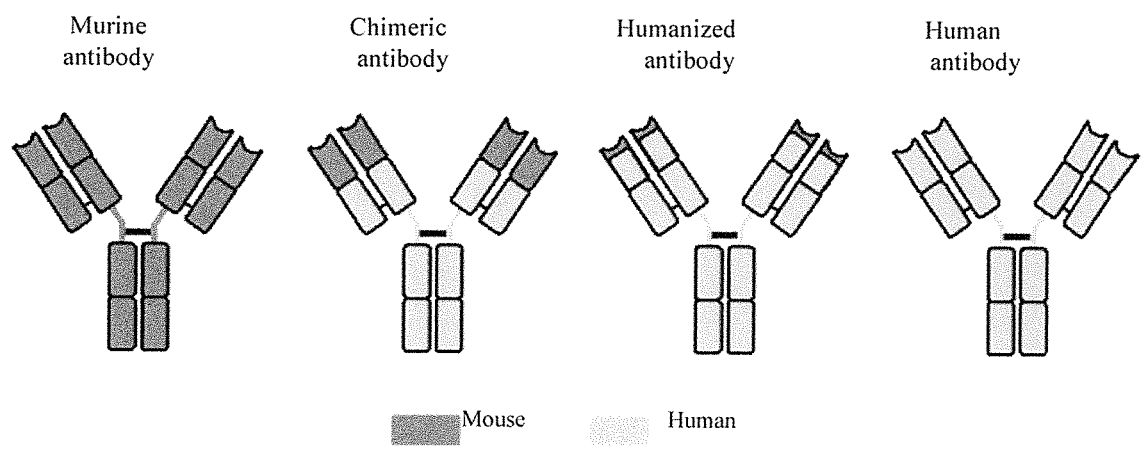
FIG. 3 illustrates in the form of a diagram the differences in the light and heavy chains of murine (i.e. obtained in the mouse host organism), chimeric, humanized and human antibodies.
Figure 5:
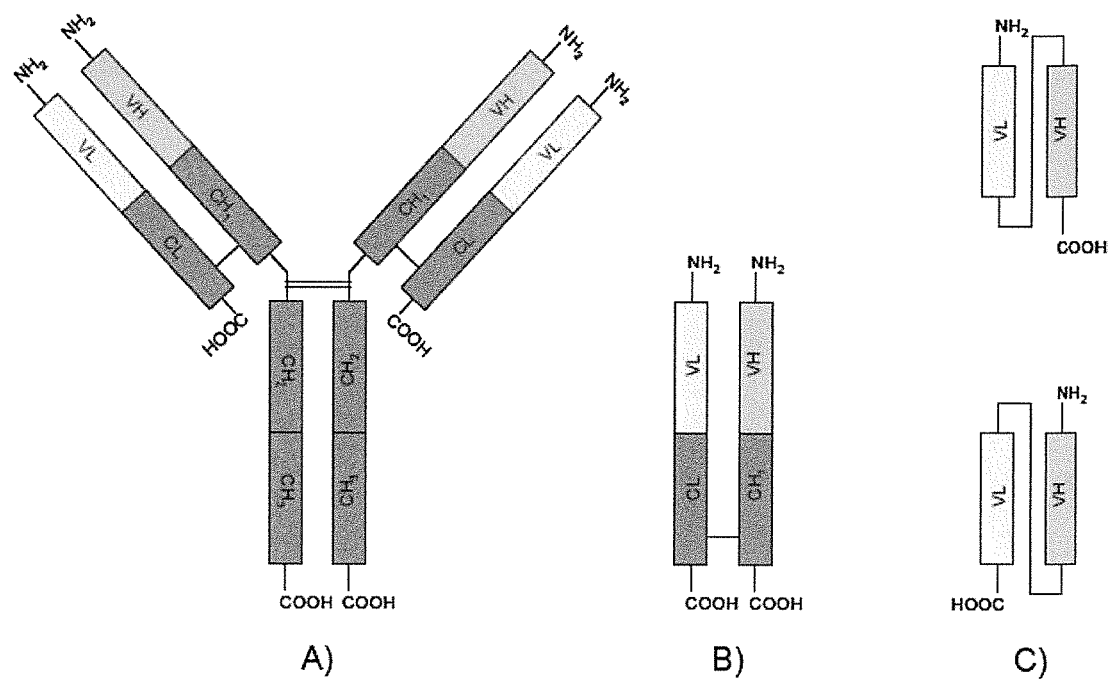
FIG. 5 shows various variants of antibodies and antibody fragments in FIGS. 5A, 5B and 5C:
(A) shows a diagram of an IgG antibody of two light and two heavy chains.
(B) shows an Fab fragments from the variable and a constant domain in each case of a light and a heavy chain. The two chains are bonded to one another via a disulfide bridge.
(C) shows an scFv fragment from the variable domain of the light and the heavy chain, which are bonded to one another via an artificial polypeptide linker.

ACC linker for an optimum Kozak sequence

AAGCTT HindIII

TGA stop codon

ACTAGT SpeI

AGATCT BglII

ATGCAT NsiI

CATCATCATCATCATCAT His tag
Signal peptide, HLA-A*0201: GC-rich
*ATGGCCGTGATGGCGCCGCGGACCCTGGTCCTCCTGCTGAGCGG CGCCCTCGCCCTGACGCAGACCTGGGCCGGG.*

---

The coding region of the heavy chain sequence starts with the signal peptide as given above (italic). This region is G/C enriched as well. The subsequent sequence starting with CAG represents the actual antibody coding sequence (see FIG. 9) for the heavy chain, which ends with AAG and is followed by the above described His tag sequence. Finally, the open reading frame for the heavy chain ends with the stop codon TGA (∼∼∼∼). The coding region for the light chain sequence starts 3' upstream with the signal peptide's ATG as given above followed by the light chain's coding region for the light chain starting with CAG running to the stop codon TGA (∼∼∼∼) (see FIG. 11). Both coding regions for the light and the heavy chain are separated by an IRES element (•••••••) The inventive RNA coded by the construct given in FIG. 12 may or may not contain a (His) tag sequence and may contain a signal peptide sequence different from the above peptide sequence or may even have no signal peptide sequence. Accordingly, the inventive RNA molecule contains preferably the coding region (with or without a signal peptide sequence at its beginning) of the heavy and/or the light chain (e.g. as shown in FIG. 12), preferably in combination with at least one ribosomal entry site.

FIG. 13 shows the wild-type DNA sequence of the heavy chain of the antibody cetuximab (=Erbitux) (wild-type: GC content: 56.8%, length: 1,359) (SEQ ID NO: 61166).

FIG. 14 shows a GC-optimized DNA sequence of the heavy chain of the antibody cetuximab (=Erbitux) (GC content: 65.9%, length: 1,359) (SEQ ID NO: 61167).

FIG. 15 shows the wild-type DNA sequence of the light chain of the antibody cetuximab (=Erbitux) (wild-type: GC content: 58.2%, length: 642) (SEQ ID NO: 61168).

FIG. 16 shows a GC-optimized DNA sequence of the light chain of the antibody cetuximab (=Erbitux) (GC content: 65.7%, length: 642) (SEQ ID NO: 61169).

FIG. 17 shows the total construct of a GC-optimized DNA sequence of the antibody cetuximab (=Erbitux) with the light and heavy chains (SEQ ID NO: 61170). The total construct contains the following sequences and cleavage sites (see also alternative cleavage sites of FIG. 26, SEQ ID No 61210):

---

ACC linker for an optimum Kozak sequence

AAGCTT HindIII

TGA stop codon

ACTAGT SpeI

AGATCT BglII

ATGCAT NsiI

CATCATCATCATCATCAT His tag
Signal peptide, HLA-A*0201: GC-rich
ATGGCCGTGATGGCGCCGCGGACCCTGGTCCTCCTGCTGAGCGG
CGCCCTCGCCCTGACGCAGACCTGGGCCGGG.

The coding region of the heavy chain sequence starts with the signal peptide as given above (italic). This region is G/C enriched as well. The subsequent sequence starting with CAG represents the actual antibody coding sequence (see FIG. 14) for the heavy chain, which ends with AAG and is followed by the above described His tag sequence. Finally, the open reading frame for the heavy chain ends with the stop codon TGA ( ~~~~ ). The coding region for the light chain sequence starts 3' upstream with the signal peptide's ATG as given above followed by the light chain's coding region for the light chain starting with GAC running to the stop codon TGA ( ~~~~ ) (see FIG. 16). Both coding regions for the light and the heavy chain are separated by an IRES element ( ······· ). The inventive RNA coded by the construct given in FIG. 17 may or may not contain a (His) tag sequence and may contain a signal peptide sequence different from the above peptide sequence or may even have no signal peptide sequence. Accordingly, the inventive RNA molecule contains preferably the coding region (with or without a signal peptide sequence at its beginning) of the heavy and/or the light chain (e.g. as shown in FIG. 17), preferably in combination with at least one ribosomal entry site.

FIG. 18 shows the wild-type DNA sequence of the heavy chain of the antibody trastuzumab (=Herceptin) (wild-type: GC content: 57.8%, length: 1,356) (SEQ ID NO: 61171).

FIG. 19 shows a GC-optimized DNA sequence of the heavy chain of the antibody trastuzumab (=Herceptin) (GC content: 67.0%, length: 1,356) (SEQ ID NO: 61172).

FIG. 20 shows the wild-type DNA sequence of the light chain of the antibody trastuzumab (=Herceptin) (wild-type: GC content: 56.9%, length: 645) (SEQ ID NO: 61173).

FIG. 21 shows a GC-optimized DNA sequence of the light chain of the antibody trastuzumab (=Herceptin) (GC content: 66.4%, length: 645) (SEQ ID NO: 61174).

FIG. 22 shows a total construct of the GC-optimized DNA sequence of the antibody trastuzumab (=Herceptin) with the light and heavy chains (SEQ ID NO: 61175). The total construct contains the following sequences and cleavage sites (see also alternative cleavage sites of FIG. 27, SEQ ID NO: 61211):

ACC linker for an optimum Kozak sequence

AAGCTT HindIII

TGA stop codon

ACTAGT SpeI

AGATCT BglII

ATGCAT NsiI

CATCATCATCATCATCAT His tag
Signal peptide, HLA-A*0201: GC-rich
ATGGCCGTGATGGCGCCGCGGACCCTGGTCCTCCTGCTGAGCGG
CGCCCTCGCCCTGACGCAGACCTGGGCCGGG.

The coding region of the heavy chain sequence starts with the signal peptide as given above (italic). This region is G/C enriched as well. The subsequent sequence starting with GAG represents the actual antibody coding sequence (see FIG. 19) for the heavy chain, which ends with AAG and is followed by the above described His tag sequence. Finally, the open reading frame for the heavy chain ends with the stop codon TGA ( ~~~~ ). The coding region for the light chain sequence starts 3' upstream with the signal peptide's ATG as given above followed by the light chain's coding region for the light chain starting with GAC running to the stop codon TGA ( ~~~~ ) (see FIG. 21). Both coding regions for the light and the heavy chain are separated by an IRES element ( ······· ). The inventive RNA coded by the construct given in FIG. 22 may or may not contain a (His) tag sequence and may contain a signal peptide sequence different from the above peptide sequence or may even have no signal peptide sequence. Accordingly, the inventive RNA molecule contains preferably the coding region (with or without a signal peptide sequence at its beginning) of the heavy and/or the light chain (e.g. as shown in FIG. 22), preferably in combination with at least one ribosomal entry site.

Figure 23:
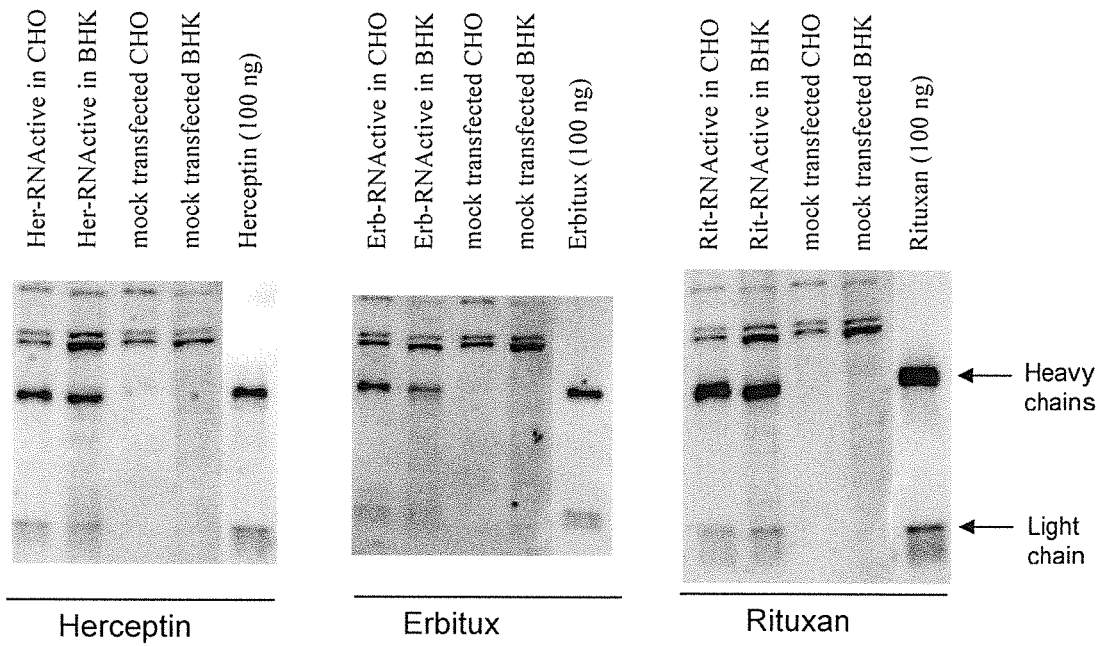

FIG. 23 shows for Example 1 RNA-mediated antibody expression in cell culture. CHO or BHK cells were transfected with 20 µg of antibody-encoding mRNA according to the invention which was produced (RNA, G/C enriched, see above) or mock-transfected. 24 hours after transfection protein synthesis was analysed by Western blotting of cell lysates. Cells harboured about 0.5 µg of protein as assessed by Western Blot analysis. Each lane represents 10% of total lysate. Humanised antibodies served as control and for a rough estimate of protein levels. The detection antibody recognises both heavy and light chains; moreover, it shows some unspecific staining with cell lysates (three distinct bands migrating much slower than those of the antibodies). A comparison with control antibodies clearly demonstrates that heavy and light chains were produced in equal amounts.

Figure 24:
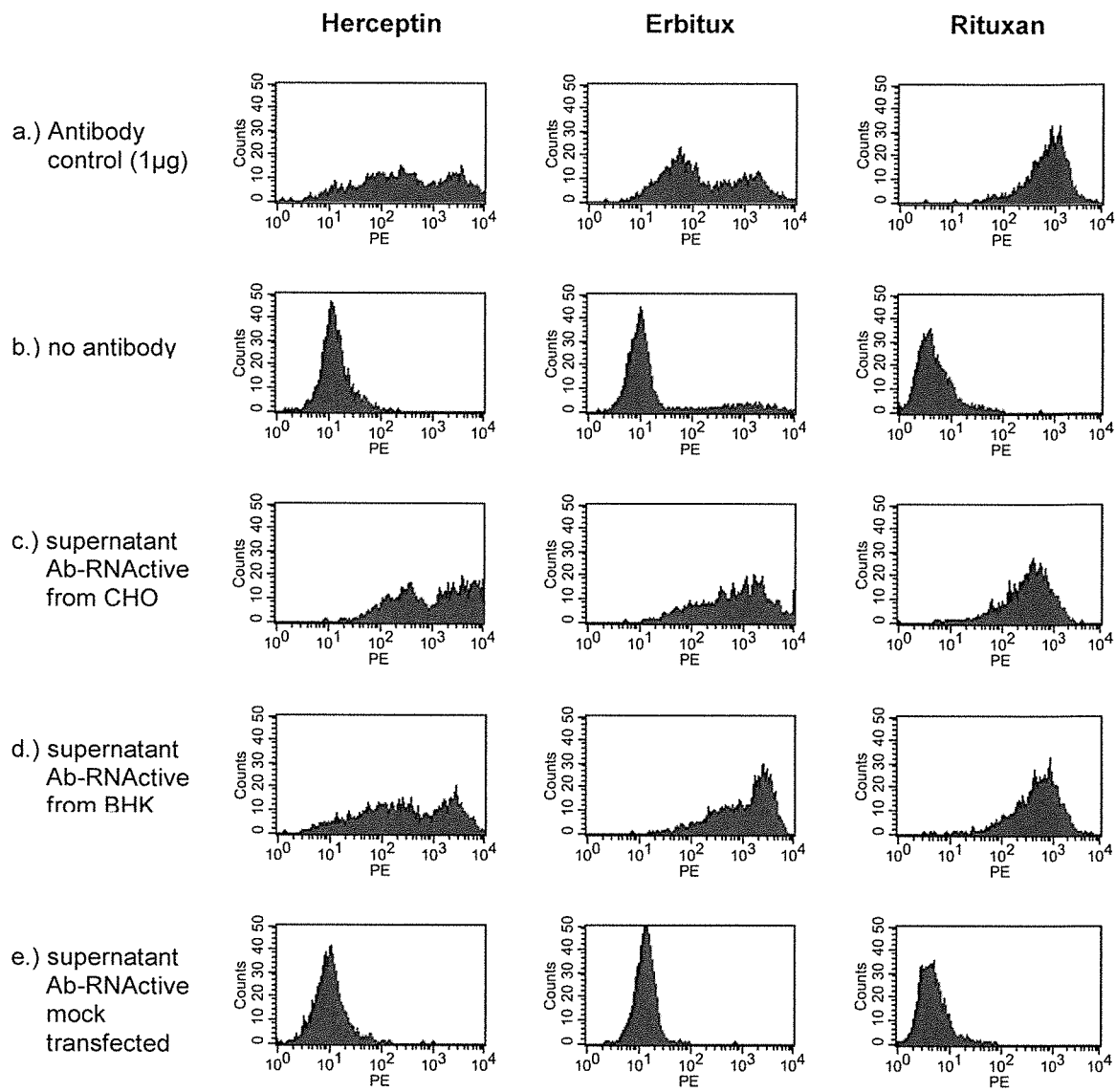

FIG. 24 shows for Example 1 that RNA-mediated antibody expression gives rise to a functional protein (antibody). Functional antibody formation was addressed by FACS staining of antigen-expressing target cells. In order to examine the production of functional antibodies, cell culture supernatants of RNA-transfected (20 µg of Ab-RNA as defined above in Example 1) cells were collected after 48 to 96 hours. About 8% of total supernatant was used to stain target cells expressing the respective antigen. Humanised antibodies served as control and for a rough estimate of protein levels. Primary antibody used for cell staining: a) humanised antibody; b) none; c,d) supernatant from RNA-transfected cells expressing the respective antibody; e) supernatant from mock-transfected CHO cells. Calculations on the basis of the analysis shown in FIG. 24 reveal that cells secreted more than 12-15 μg of functional antibody within 48-96 hours. Accordingly, the present invention proves that RNA encoding antibodies may enter into cell, may be expressed within the cell and considerable amounts of RNA encoded antibodies are then secreted by the cell into the surrounding medium/extracellular space. Cell transfection in vivo or in vitro by the inventive RNA may therefore be used to provide antibodies acting e.g. therapeutically in the extracellular space.

FIG. 25 shows an alternative sequence of the construct of FIG. 12 (antibody rituximab), wherein the restriction sites have been modified as compared to SEQ ID NO: 61165 of FIG. 12 (SEQ ID NO: 61209). For closer information with regard to the description of various sequence elements it is referred to FIG. 12.

FIG. 26 shows an alternative sequence of the construct of FIG. 17 (antibody cetuximab), wherein the restriction sites have been modified as compared to SEQ ID NO: 61170 of FIG. 17 (SEQ ID NO: 61210). For closer information with regard to the description of various sequence elements it is referred to FIG. 17.

FIG. 27 shows an alternative sequence of the construct of FIG. 22 (antibody trastuzumab), wherein the restriction sites have been modified as compared to SEQ ID NO: 61175 of FIG. 22 (SEQ ID NO: 61211). For closer information with regard to the description of various sequence elements it is referred to FIG. 22.

Figure 28:
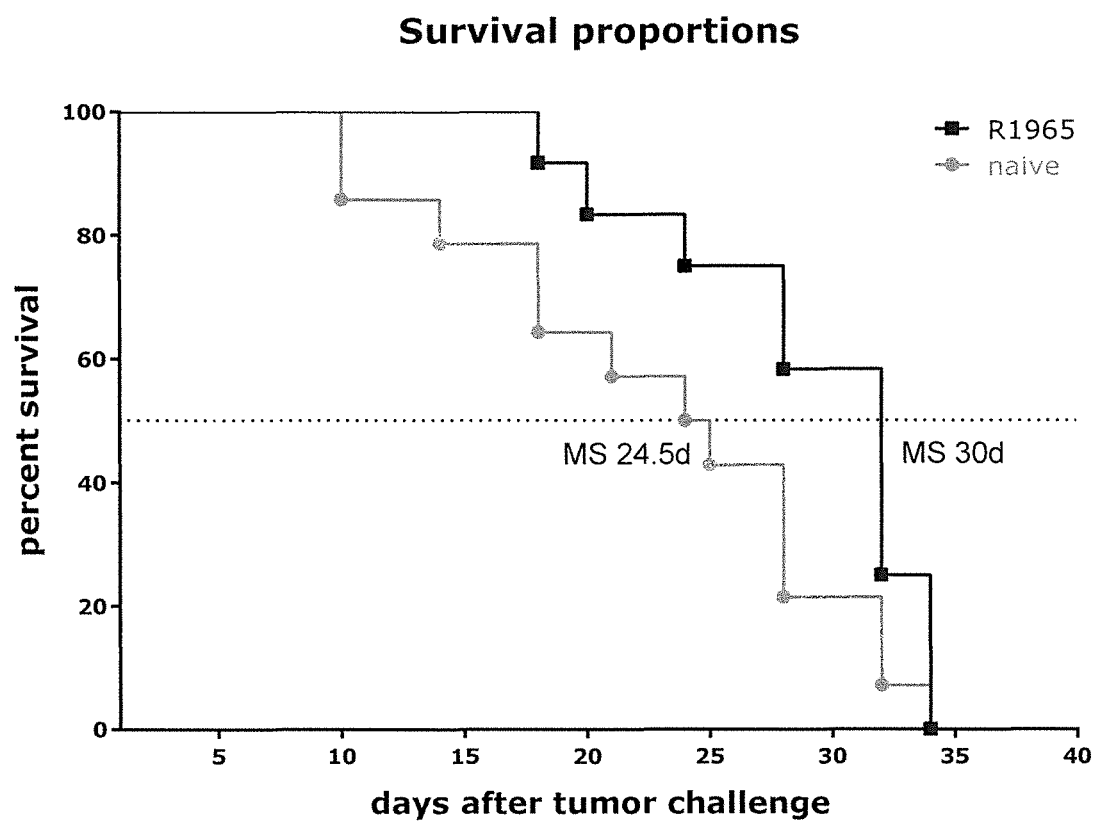

FIG. 28 shows for Example 2 the median survival time of mice injected with mRNA encoding the antibody trastuzumab (Herceptin) as compared to the median survival time of naïve control mice in an in vivo tumor model. Briefly, BALB/c nu/nu mice (n=14 per group) were subcutaneously implanted with slow-release estrogen pellets (0.72 mg 17β-estradiol). Mice were inoculated subcutaneously with $10\times10^6$ BT-474 tumour cells (100 μl of a cell/matrigel suspension) per mouse on day 0. Treatment was started on day 11 when tumors became injectable. Mice were treated twice weekly for up to 3.5 weeks with a single dose of 50 μg of mRNA (R1965) in a 50 μl injection volume (Ringer Lactate buffer).

Figure 29:
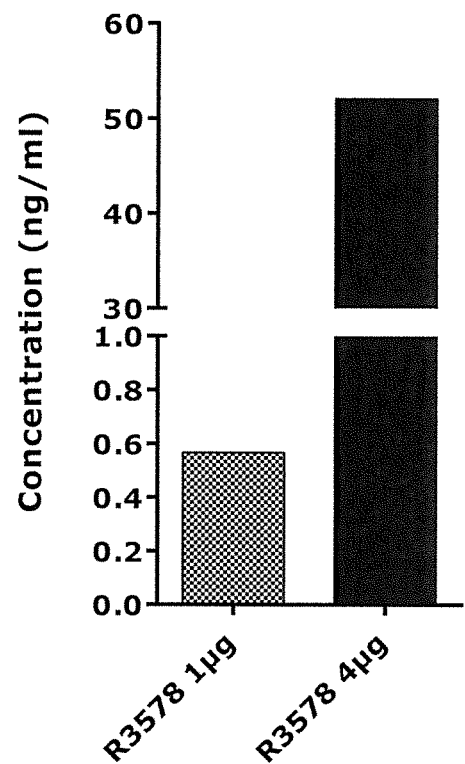

FIG. 29 shows for Example 3 the concentration of cetuximab in the supernatant of R3578-transfected cells (in vitro antibody expression study). Briefly, HEK293T cells were transfected with 1 μg or 4 μg of mRNA (R3578) using the Lipofectamine2000 reagent. 24 hours after the transfection, the supernatant was collected and used for staining of A431 cells (EGFR-expressing cell line) and analysed by flow cytometry (FACS). The concentration of Cetuximab in the supernatant of the transfected cells was calculated using a standard curve generated with the commercially available Cetuximab protein.

FIG. 30 shows for Example 3 the median survival time of mice injected with mRNA encoding the antibody cetuximab (Erbitux) as compared to the median survival time of naïve control mice in an in vivo tumor model. Briefly, BALB/c nu/nu mice were inoculated subcutaneously in the right flank (near the dorsal region) with a cell suspension of about $5\times10^6$ SW48 cells (human colon cancer cell line; 100 μl of a cell/matrigel suspension). When the tumor reached a volume of 400-500 $mm^3$, the tumor tissue blocks were harvested for transplantation. SW48 tumor blocks (about 1.5 mm×1.5 mm×1.5 mm in size) were subcutaneously transplanted in the right flank (near the dorsal region) of 125 animals; eventually 40 tumor-bearing mice were enrolled in the study and were assigned to one of the following four groups (n=10 per group): untreated, Ringer Lactate ("RiLa"), 50 μg mRNA encoding cetuximab ("R3578 (50 μg)") and 100 μg mRNA encoding cetuximab ("R3578 (100 μg)"). Except for the untreated group, all mice received the respective "treatment" (RiLa or 50 or 100 μg mRNA) every 3 days for a total of seven injections (21 days).

Figure 31:
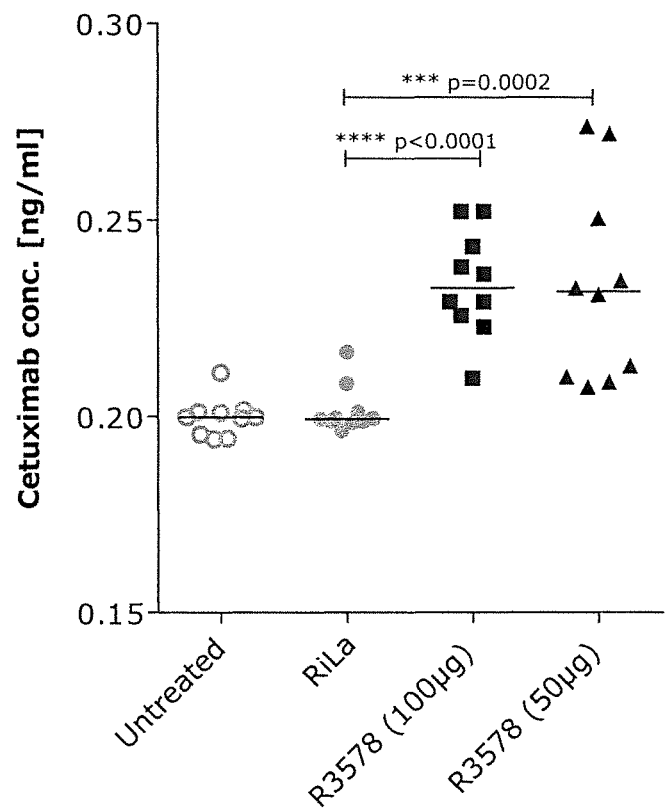

FIG. 31 shows for Example 3 the concentration of cetuximab antibody in the sera of treated mice. Briefly, the sera from mice injected with 100 μg and 50 μg of R3578 were collected 24 hours after the third application and tested by flow cytometry (FACS) for the presence of functional antibodies as described above. The sera from untreated animals and mice injected with RiLa served as controls.

Figure 32:
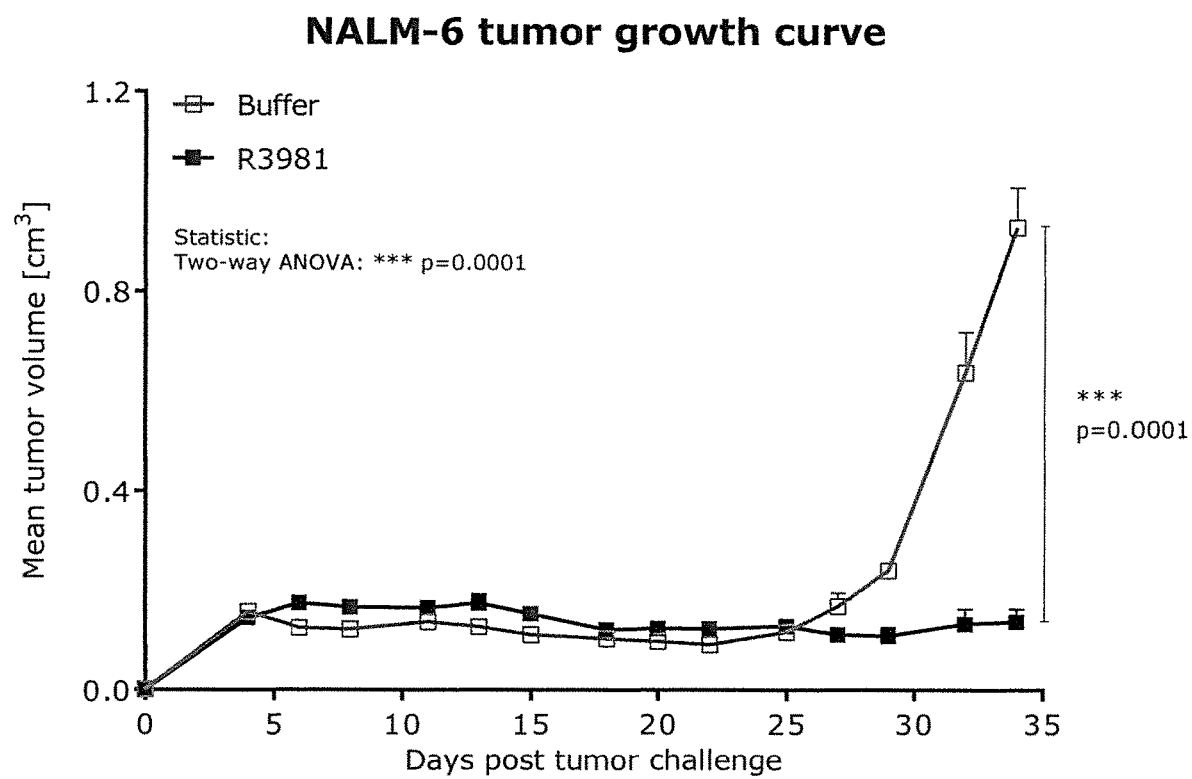

FIG. 32 shows for Example 4 the reduction of the mean tumor volume after treatment with mRNA encoding Blinatumomab (R3981) versus untreated (RiLa control buffer experiment). Mean tumor volume after treatment with R3981 or buffer is depicted. NOG mice were subcutaneously challenged with a mixture of NALM-6 cells and human PBMCs followed by treatment with R3981 or buffer as a control (5x on consecutive days). Tumor growth was measured using caliper and tumor growth curves are depicted. Contrary to the control group, only one of six mice in the cohort treated with the mRNA encoding Blinatumomab developed a measurable tumor. As a result, a statistically significant inhibition of tumor growth was observed compared to the control group.

Figure 33:
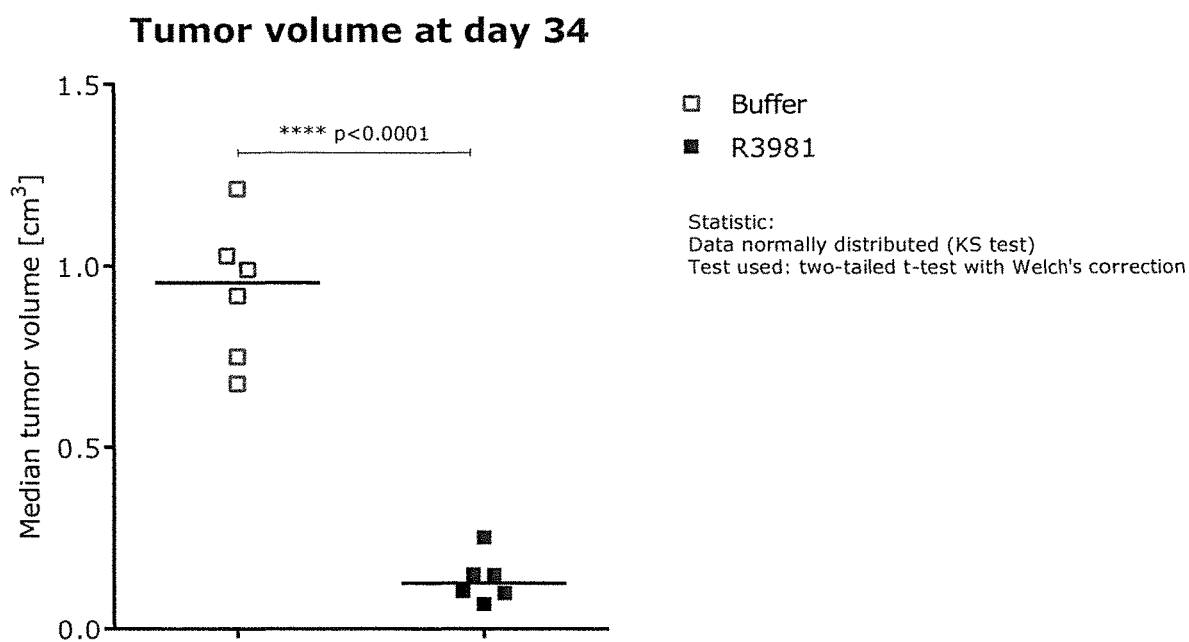

FIG. 33 shows for Example 4 the tumor volume of R3981- and buffer-treated mice on day 34. Day 34 was chosen for this analysis as the last day when all animals in all groups were still alive and therefore the mean tumor volumes could be compared. The treatment with the mRNA encoding Blinatumomab (R3981) significantly inhibited tumor growth compared to the buffer control. The dots represent the tumor volume of individual mice and the horizontal line represents the median.

Figure 34:
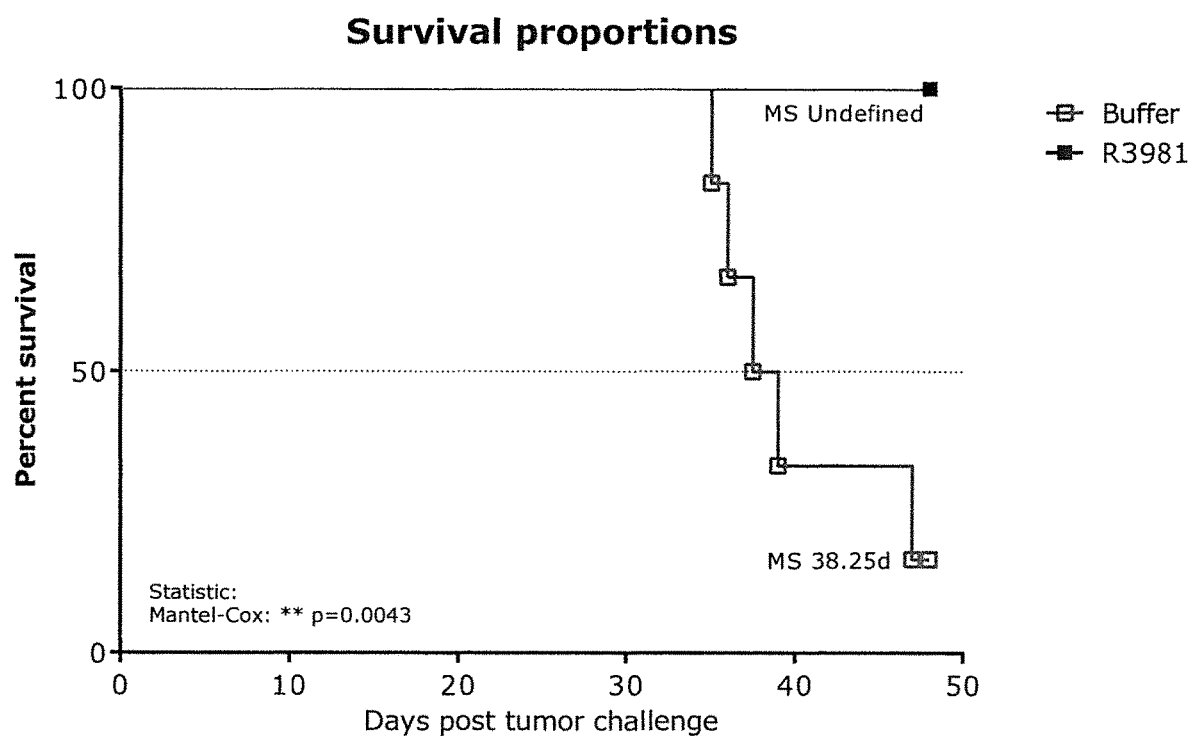

FIG. 34 shows for Example 4 the median survival time of mice injected with mRNA encoding the antibody blinatumomab ("R3981") as compared to the median survival time of buffer control mice in an in vivo tumor model. Briefly, survival proportions after tumor challenge with NALM-6 cells were investigated. Survival in groups treated with R3981 or buffer are shown. MS: median survival time.

Figure 35:
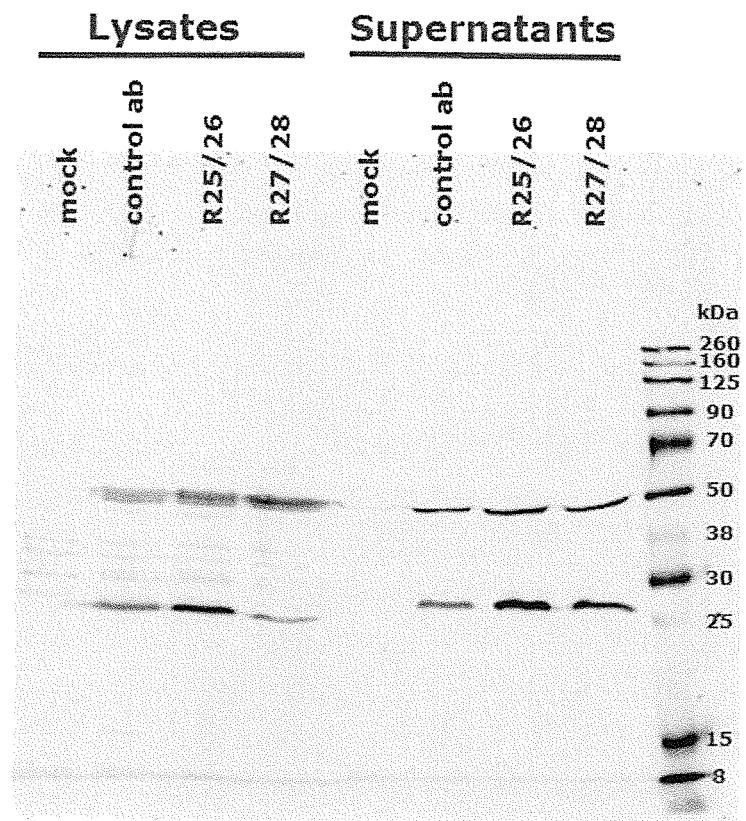
Figure 38:
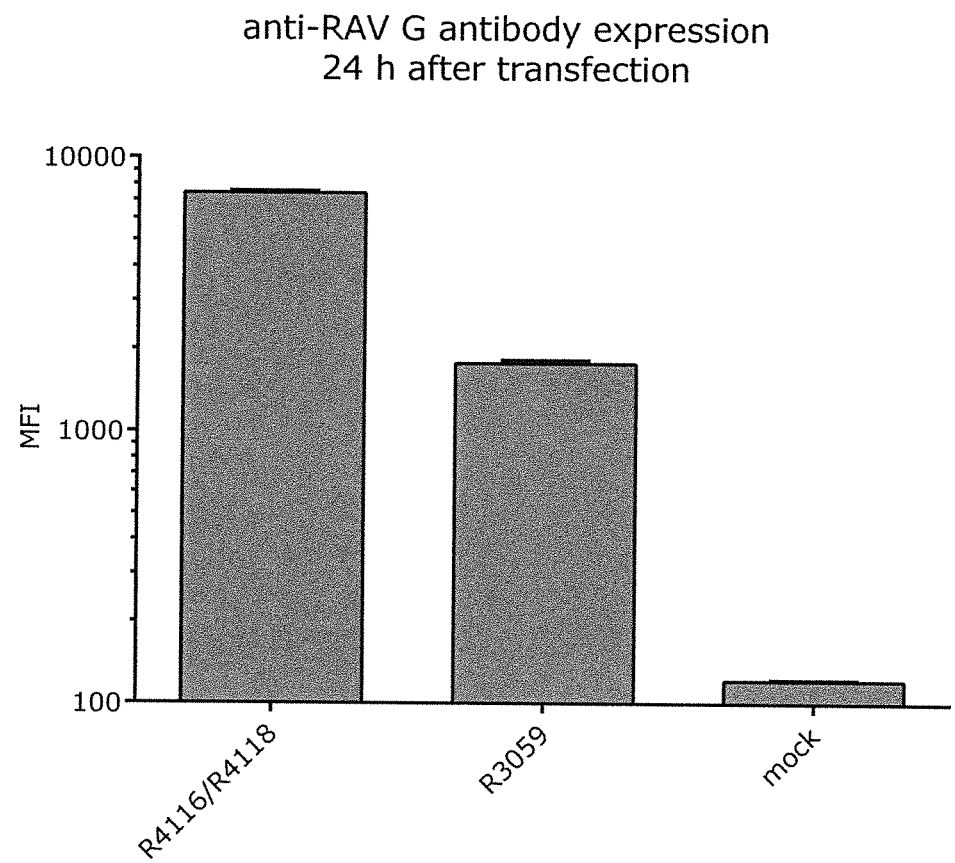

FIG. 35 shows for Example 5 expression of anti-BoNTx antibodies by mRNA transfected cells evaluated by Western blot analysis. Aliquots of cell lysates and supernatants were separated by SDS-PAGE, blotted onto a membrane, and stained with an anti-human detection antibody recognizing heavy as well as light chain. Samples from cells transfected with mRNA encoding an unrelated antibody were used as positive control. Mock-transfected cells served as negative control.

FIG. 36 shows for Example 6 the expression of anti-HA antibodies by mRNA transfected cells evaluated by Western blot analysis. Aliquots of cell lysates and supernatants were separated by SDS-PAGE, blotted onto a membrane, and stained with an anti-human detection antibody recognizing heavy as well as light chain. 100 ng of a recombinant antibody were used as positive control and for rough quantification of mRNA-mediated antibody expression. Mock-transfected cells served as negative control.

FIG. 37 shows for Example 6 the production of functional anti-HA antibodies by mRNA transfected cells evaluated by flow cytometry. 24 h after transfection of BHK cells with mRNA-encoded anti-HAn antibody supernatant was collected and used for staining of HA-expressing HeLa cells. The supernatant of mock-transfected cells served as negative control.

FIG. 38 shows for Example 7 the production of functional anti-RAV G antibodies by mRNA transfected cells evaluated by flow cytometry. 24 h after transfection of BHK cells with mRNA-encoded anti-RAV G antibody supernatant was collected and used for staining of RAV G-expressing HeLa cells. The supernatant of mock-transfected cells served as negative control.

FIG. 39 shows the complete mRNA sequence "R1965" coding for the antibody Trastuzumab (Herceptin) (cf. Example 1).

FIG. 40 shows the complete mRNA sequence "R3578" coding for the antibody Cetuximab (Erbitux) (cf. Example 1).

FIG. 41 shows the complete mRNA sequence "R3981" coding for the antibody Blinatumomab (cf. Example 1).

Figure 42:
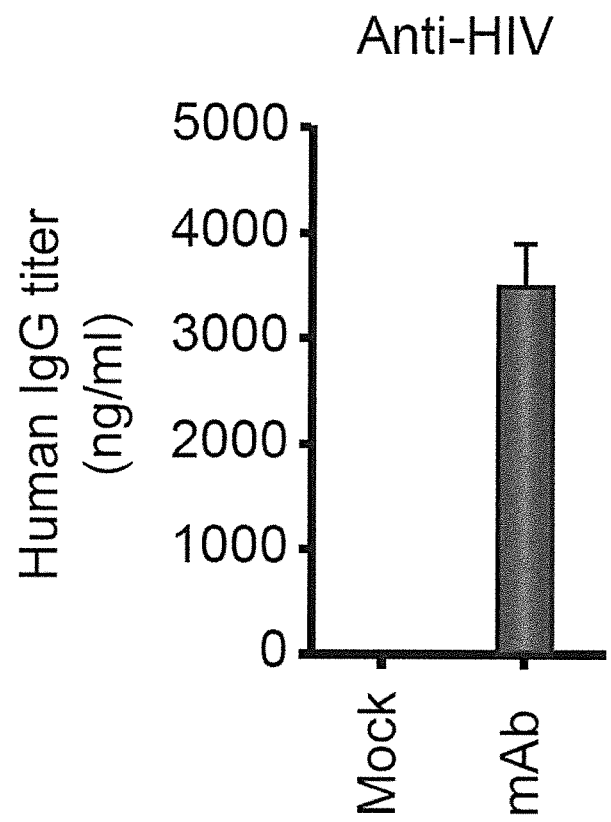

FIG. 42 shows for Example 8 data resulting from an ELISA assay (titers of anti-HIV antibodies expressed by mRNA). Individual supernatants (triplicates; pooled) were analyzed by IgG-specific ELISA. For mock co-transfection, an mRNA encoding eGFP was used.

Figure 43:
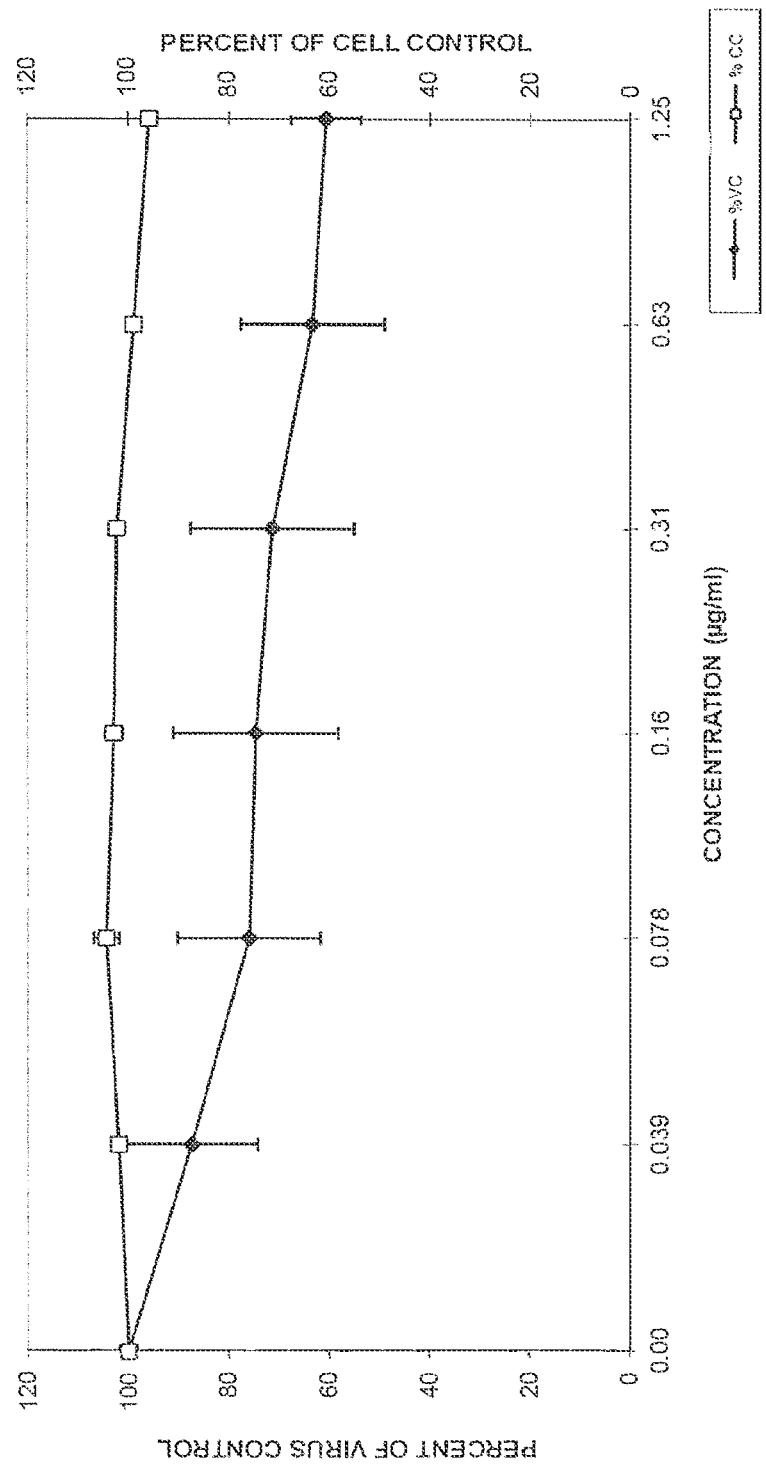
Figure 43:
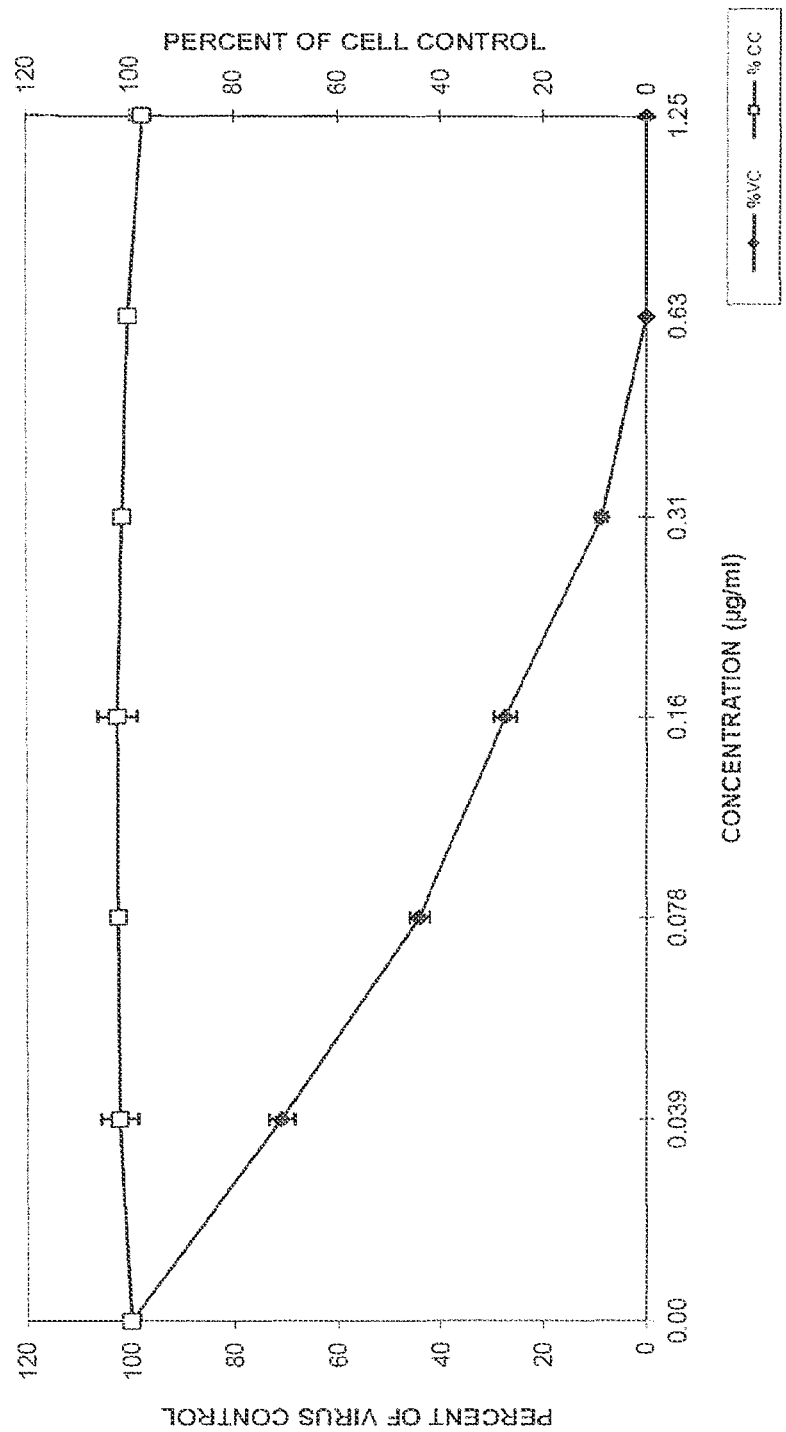
Figure 43:
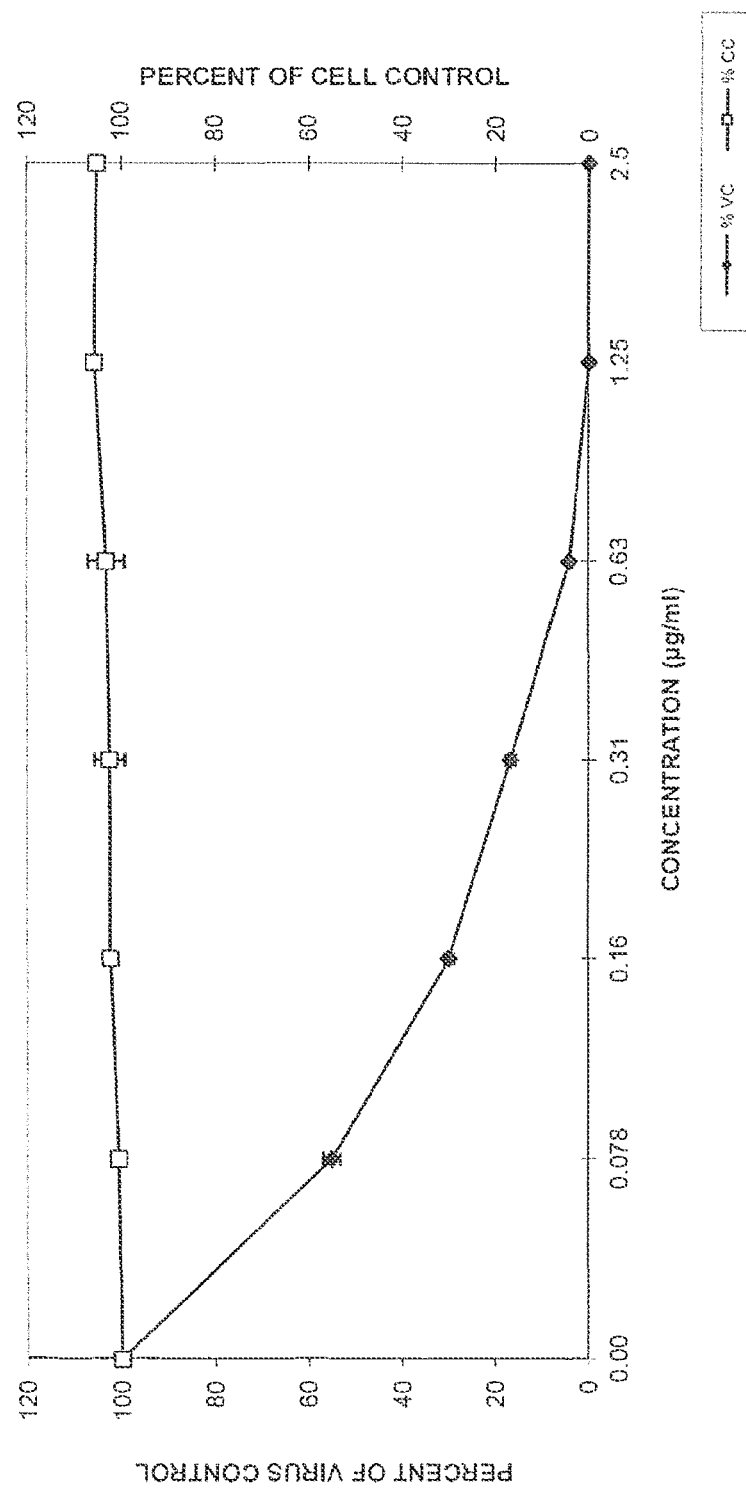

FIG. 43 shows for Example 8 the HIV entry in MAGI-R5 cells in a Magi R5-Tropic Antiviral Assay (VC=virus control; CC=cell control) of a control without RNA (A); the HIV entry in MAGI-R5 cells in a Magi R5-Tropic Antiviral Assay (VC=virus control; CC=cell control) of mRNA-encoded VRC01 (B); and the HIV entry in MAGI-R5 cells in a Magi R5-Tropic Antiviral Assay (VC=virus control; CC=cell control) of commercially available recombinant VRC01 control (C).

Figure 44:
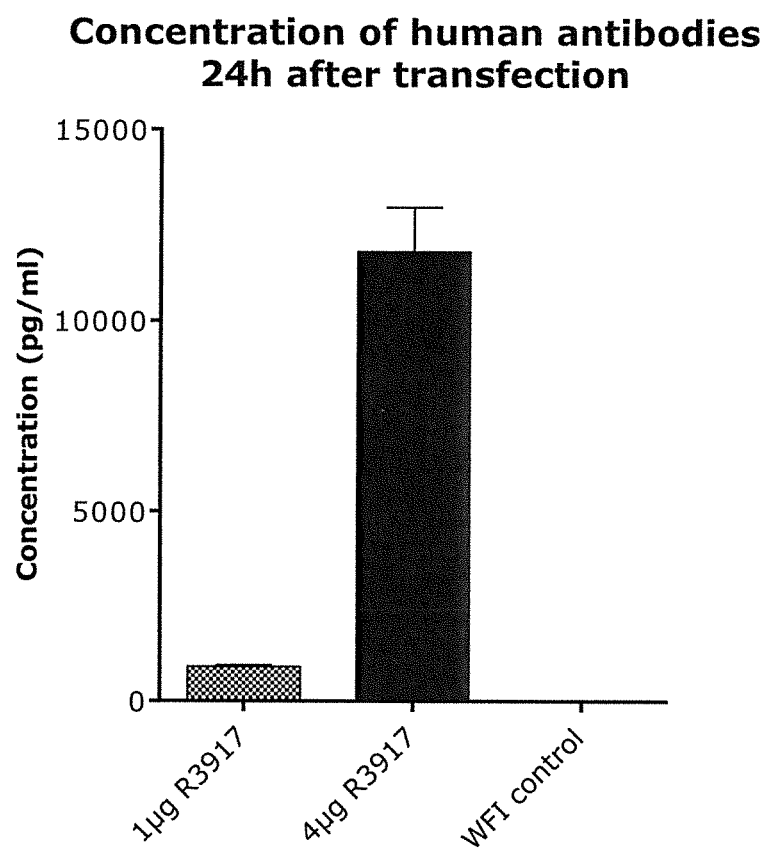

FIG. 44 shows for Example 9 the concentration of human antibodies in the supernatant of R3917-transfected HEK293T cells evaluated by ELISA. The plates were coated with anti-human antibodies, followed by incubation with the supernatant of R3917-transfected cells and anti-human detection antibodies. The concentration of human antibodies was calculated from the standard curve generated using commercially available Rituximab. The supernatant from the sham-transfected cells (WFI, water for injection) served as a control.

Figure 45:
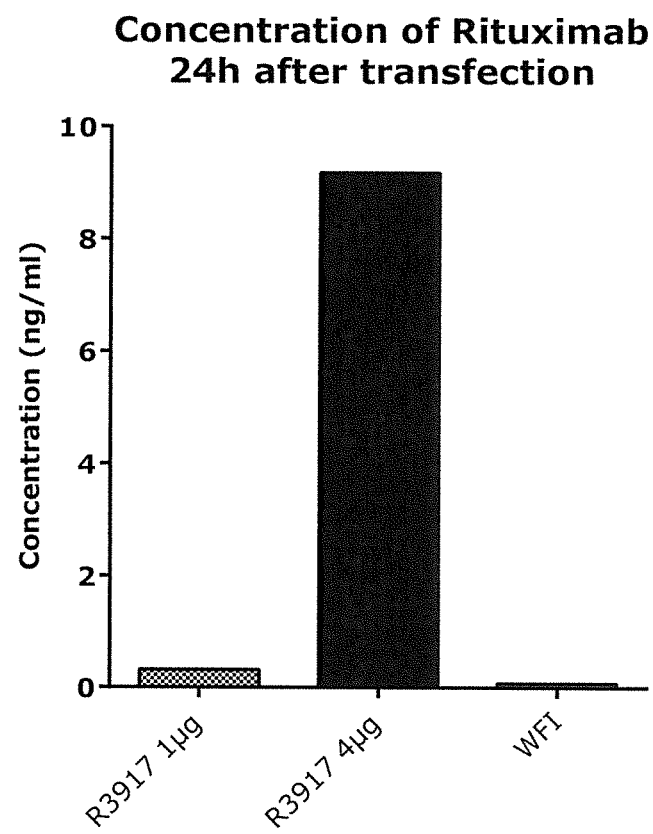

FIG. 45 shows for Example 9 the concentration of the functional Rituximab antibodies in the supernatant of R3917-transfected cells evaluated by flow cytometry. 24 h after the transfection of HEK293T cells with mRNA-encoded Rituximab (R3917) supernatant was collected and used for staining of CD20-expressing Raji cells. The concentration of Rituximab was calculated from the standard curve generated using commercially available Rituximab. The supernatant from the sham-transfected cells (WFI) served as a control.

Figure 46:
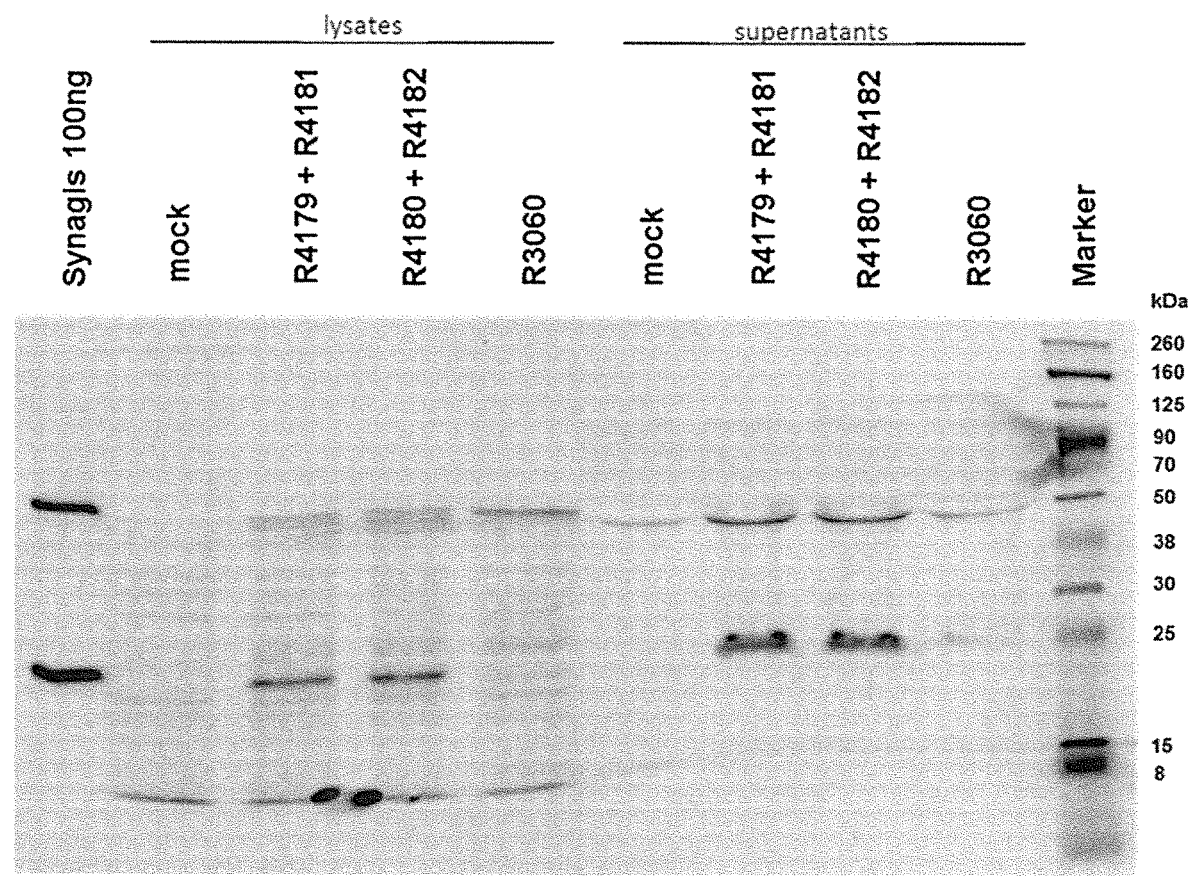

FIG. 46 shows for Example 10 the expression of anti-RSV F antibodies by mRNA transfected cells evaluated by Western blot analysis. Aliquots of cell lysates and supernatants were separated by SDS-PAGE, blotted onto a membrane, and stained with an anti-human detection antibody recognizing heavy as well as light chain. 100 ng of a recombinant antibody were used as positive control and for rough quantification of mRNA-mediated antibody expression. Mock-transfected cells served as negative control.

EXAMPLES

The Examples shown in the following are merely illustrative and shall describe the present invention in a further way. These Examples shall not be construed to limit the present invention thereto.

Figure 6:
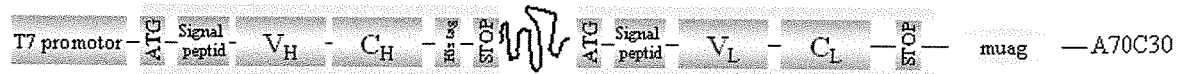
FIG. 6 shows a presentation of an exemplified antibody-coding (modified) RNA according to
the invention as an expression construct. In this:
$V_H$=variable domain of the heavy chain;
$C_H$=constant domain of the heavy chain;
$V_L$=variable domain of the light chain;
$C_L$=constant domain of the light chain;
SIRES=internal ribosomal entry site (IRES, superIRES)
muag=mutated form of the 3' UTR of the alpha-globin gene; and
A70C30=polyA-polyC tail.
Figure 7:
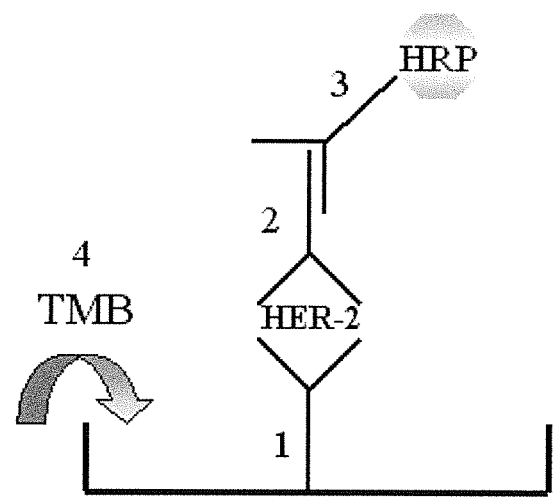
FIG. 7 shows a diagram of the detection of an antibody coded by an RNA according to the invention by means of ELISA on the example of the antigen Her2.

Example 1: Preparation of an mRNA Encoding Heavy and Light Chain Variable Regions and Antibody Expression 1.1 Preparation of Expression Vectors for Modified RNA Sequences:

For the production of modified RNA sequences according to the invention, the GC-enriched and translation-optimized DNA sequences which code for a heavy chain and a light chain of the antibodies shown below in Table 12 (e.g. cetuximab (Erbitux), trastuzumab (Herceptin) and rituximab (Rituxan), cf. SEQ ID NO: 61161-61175, where SEQ ID NO: 61161, 61163, 61166, 61168, 61171 and 61173 represent the particular coding sequences which are not GC-optimized of the heavy and the light chains of these antibodies and SEQ ID NO: 61162, 61164, 61165, 61167, 61169, 61170, 61172, 61174, and 61175 represent the coding GC-enriched sequences (see above)) were cloned into the pCV19 vector (CureVac GmbH) by standard molecular biology methods. To ensure equimolar expression of the two chains, an IRES (internal ribosomal entry site) was introduced. The mutated 3' UTR (untranslated region) of the alpha-globin gene and a polyA-polyC tail at the 3' end serve for additional stabilizing of the mRNA. The signal peptide of the HLA-A*0201 gene is coded for secretion of the antibody expressed. A His tag was additionally introduced for detection of the antibody. FIG. 6 shows the expression constructs used for cetuximab (Erbitux), trastuzumab (Herceptin) and rituximab (Rituxan).

TABLE 12

SEQ ID NOs of exemplified and preferred antibodies encoded by the mRNA according to the present invention and of exemplified and preferred mRNAs according to the invention

| Antibody | Protein heavy chain (SEQ ID NO) | Protein light chain (SEQ ID NO) | Optimized CDS heavy chain (SEQ ID NO) | Optimized CDS light chain (SEQ ID NO) | mRNA sequence (SEQ ID NO) |
|---|---|---|---|---|---|
| Cetuximab (Erbitux) | 61237 | 61238 | 61240 | 61241 | 61243 ("R3578") |
| Trastuzumab | 61270 | 61271 | 61273 | 61274 | 61276 ("R1965") |
| Rituximab (Rituxan) | 61303 | 61305 | 61306 | 61308 | 61310 ("R3001") |
| Blinatumomab | 61640 (single chain) | — | 61642 (single chain) | — | 61643 ("R3981") |
| Anti-BoNTx_v1 | 61603 | 61606 | 61604 | 61607 | 61605 (heavy chain; R4120") 61608 (light chain; "R4122") |
| Anti-BoNTx_v2 | 61609 | 61612 | 61610 | 61613 | 61611 (heavy chain; R5045") 61614 (light chain; "R5046") |
| Anti-HA CR8033_v1 | 61456 | 61457 | 61458 | 61459 | 61465 ("R3996") |

TABLE 12-continued

SEQ ID NOs of exemplified and preferred antibodies encoded by the mRNA according to the present invention and of exemplified and preferred mRNAs according to the invention

| Antibody | Protein heavy chain (SEQ ID NO) | Protein light chain (SEQ ID NO) | Optimized CDS heavy chain (SEQ ID NO) | Optimized CDS light chain (SEQ ID NO) | mRNA sequence (SEQ ID NO) |
|---|---|---|---|---|---|
| Anti-HA CR8033_v2 | 61469 | 61470 | 61471 | 61472 | 61474 ("R3998") |
| Anti-HA CR8033_v3 | 61475 | 61476 | 61477 | 61478 | 61480 ("R4000") |
| Anti-HA CR8033_v4 | 61481 | 61482 | 61483 | 61484 | 61486 ("R4002") |
| Anti-HA CR8033_v5 | 61487 | 61488 | 61489 | 61490 | 61492 ("R4004") |
| Anti-HA CR8033_v6 | 61493 | 61494 | 61495 | 61496 | 61498 ("R4012") |
| Anti-Rabies | 61408 | 61412 | 61409 | 61413 | 61410 (heavy chain; "R4116") 61414 (light chain; "R4118") |
| Anti-Rabies | 61384 | 61385 | 61402 | 61403 | 61405 ("R3059") |
| Anti-HIV | 61370 | 61381 | 61371 | 61382 | 61372 (heavy chain; "R5319") 61383 (light chain; "R5320") |
| Rituximab (Rituxan) | 61320 | 61332 | 61321 | 61333 | 61337 ("R3917") |
| Anti-RSV F | 61675 | 61697 | 61676 | 61698 | 61677 (heavy chain; "R4179") 61699 (light chain; "R4181") |
| Anti-RSV F | 61686 | 61708 | 61687 | 61709 | 61688 (heavy chain; "R4180") 61710 (light chain; "R4182") |
| Anti-RSV F | 61660 | 61661 | 61662 | 61663 | 61666 ("R3060") |

Table 13 below shows further RNA constructs, which were produced, including their SEQ ID NOs and the antibodies, which they encode.

TABLE 13

SEQ ID NOs of exemplified and preferred mRNAs according to the invention encoding the indicated antibodies.

| RNA construct name | SEQ ID NO | Encoded antibody |
|---|---|---|
| R3578 | 61243 | Cetuximab (Erbitux) |
| R3000 | 61244 | Cetuximab (Erbitux) |
| R1965 | 61276 | Trastuzumab (Herceptin) |
| R2999 | 61277 | Trastuzumab (Herceptin) |
| R3012 | 61278 | Trastuzumab (Herceptin) |
| R3001 | 61310 | Rituximab |
| R3484 | 61311 | Rituximab |
| R4128 | 61322 | Rituximab |
| R5910 | 61323 | Rituximab |
| R4129 | 61334 | Rituximab |
| R5911 | 61335 | Rituximab |
| R3917 | 61337 | Rituximab |
| R4126 | 61348 | Lexatumumab |
| R4127 | 61359 | Lexatumumab |
| R3985 | 61361 | Lexatumumab |
| R5319 | 61372 | VRC01 |
| R5320 | 61383 | VRC01 |
| R3059 | 61404 | SO57 |
| R3059 | 61405 | SO57 |
| R3061 | 61406 | SO57 |
| R4634 | 61407 | SO57 |
| R4116 | 61410 | SO57 |
| R4635 | 61411 | SO57 |
| R4118 | 61414 | SO57 |
| R4636 | 61415 | SO57 |
| R4640 | 61416 | SO57 |
| R4640 | 61417 | SO57 |
| R5230 | 61428 | anti-rabies_Mouse_ab |
| R5231 | 61439 | anti-rabies_Mouse_ab |
| R4112 | 61460 | CR8033 |
| R4530 | 61461 | CR8033 |
| R4114 | 61462 | CR8033 |
| R4531 | 61463 | CR8033 |
| R3996 | 61465 | CR8033 |
| R4633 | 61466 | CR8033 |
| R4639 | 61467 | CR8033 |

TABLE 13-continued

SEQ ID NOs of exemplified and preferred mRNAs according to the invention encoding the indicated antibodies.

| RNA construct name | SEQ ID NO | Encoded antibody |
|---|---|---|
| R4639 | 61468 | CR8033 |
| R3998 | 61473 | CR8033 |
| R3998 | 61474 | CR8033 |
| R4000 | 61479 | CR8033 |
| R4000 | 61480 | CR8033 |
| R4002 | 61485 | CR8033 |
| R4002 | 61486 | CR8033 |
| R4004 | 61491 | CR8033 |
| R4004 | 61492 | CR8033 |
| R4012 | 61497 | CR8033 |
| R4012 | 61498 | CR8033 |
| R4007 | 61520 | 5J8 |
| R4008 | 61542 | FLA5.10 |
| R4010 | 61564 | PN-SIA49 |
| R5417 | 61575 | Ipilimumab |
| R5418 | 61586 | Ipilimumab |
| R4120 | 61603 | anti-BoNT-A |
| R4120 | 61604 | anti-BoNT-A |
| R4120 | 61605 | anti-BoNT-A |
| R4122 | 61606 | anti-BoNT-A |
| R4122 | 61607 | anti-BoNT-A |
| R4122 | 61608 | anti-BoNT-A |
| R5045 | 61609 | anti-BoNT-A |
| R5045 | 61610 | anti-BoNT-A |
| R5045 | 61611 | anti-BoNT-A |
| R5046 | 61612 | anti-BoNT-A |
| R5046 | 61613 | anti-BoNT-A |
| R5046 | 61614 | anti-BoNT-A |
| R3118, R3729 | 61615 | anti-BoNT-A |
| R3118 | 61616 | anti-BoNT-A |
| R3729 | 61617 | anti-BoNT-A |
| R3979 | 61638 | Blinatumomab |
| R3981 | 61643 | Blinatumomab |
| R3058 | 61665 | anti-RSV |
| R3060 | 61666 | anti-RSV |
| R4179 | 61677 | anti-RSV |
| R4180 | 61688 | anti-RSV |
| R4181 | 61699 | anti-RSV |
| R4182 | 61710 | anti-RSV |
| R4124 | 61721 | anti-VEGFR2 |

TABLE 13-continued

SEQ ID NOs of exemplified and preferred mRNAs according to the invention encoding the indicated antibodies.

| RNA construct name | SEQ ID NO | Encoded antibody |
|---|---|---|
| R4125 | 61732 | anti-VEGFR2 |
| R3983 | 61733 | anti-VEGFR2 |
| R3983 | 61734 | anti-VEGFR2 |

1.2 Preparation of the G/C-Enriched and Translation-Optimized Antibody-Coding mRNA An in vitro transcription was carried out by means of T7 polymerase (T7-Opti mRNA Kit, CureVac, Tubingen, Germany), followed by purification with Pure Messenger™ (CureVac, Tubingen, Germany). For this, a DNase digestion was first carried out, followed by an LiCl precipitation and thereafter an HPLC using a porous reverse phase as the stationary phase (PURE Messenger).

1.3 Cell Lines

RNA-based expression of humanised antibodies was done in either CHO-K1 or BHK-21 (Syrian hamster kidney, HER2-negative) cells. The tumour cell lines BT-474, A-431 and Raji strongly expressing HER2, EGFR and CD20, respectively, were used to record antibody levels by FACS analysis. All cell lines except CHO were maintained in RPMI medium supplemented with FCS and glutamine according to the supplier's information. CHO cells were grown in Ham's F12 supplemented with 10% FCS. All cell lines were obtained from the German collection of cell cultures (DSMZ, Braunschweig, Germany).

1.4 Antibody Expression

Various amounts of mRNA (G/C enriched as defined by FIGS. 12, 17, 22, 25, 26, 27) encoding the humanised antibodies Herceptin, Erbitux, and Rituxan, respectively, were transfected into either CHO or BHK cells by electroporation (300 V, 450 µF for CHO and 300 V, 150 µF for BHK). After transfection, cells were seeded onto 24-well cell culture plates at a density of 200.000 to 400.000 cells per well. For collection of secreted protein, medium was replaced by 250 µl of fresh medium after cell attachment to the plastic surface. Secreted protein was collected for 24-96 hours and stored at 4° C. In addition, cells were harvested into 50 µl of phosphate buffered saline (1×PBS buffer) containing 0.5% BSA and broken up by three freeze-thaw cycles. Cell lysates were cleared by centrifugation and stored at −80° C.

1.5 Western Blot Analysis

In order to detect translation of transfected RNA, proteins from either cell culture supernatants or cell lysates were separated by a 12% SDS-PAGE and blotted onto a nitrocellulose membrane. Humanised antibodies Herceptin (Roche), Erbitux (Merck KGAA), and Mabthera=Rituxan (Roche) were used as controls. After blotting was completed, membranes were consecutively incubated with a biotinylated goat anti-human IgG antibody (Dianova), streptavidin coupled to horseradish peroxidase (BD), and a chemiluminescent substrate (SuperSignal West Pico, Pierce). Staining was detected with a Fuji LAS-1000 chemiluminescence camera. Results are shown in FIG. 23.

1.6 FACS Analysis

Functional antibody formation can be demonstrated by FACS staining of antigen-expressing target cells. In order to examine the production of functional antibodies, cell culture supernatants of RNA-transfected cells were collected after 48 to 96 hours. Approximately 200.000 target cells expressing the respective antigen were incubated with either control antibodies (Herceptin, Erbitux, Mabthera) or cell culture supernatants. For detection of bound antibodies, cells were stained with biotinylated goat anti-human IgG antibody (Dianova) and PE-labelled streptavidin (Invitrogen). Cells were analysed on a FACSCalibur (BD).

Example 2: Effects of an mRNA Encoding Trastuzumab (Herceptin) in an In Vivo Tumor Model 2.1 Preparation of mRNA For the present example a DNA sequence encoding the Trastuzumab protein was prepared and used for subsequent in vitro transcription reactions as described in Example 1.

Briefly, a vector for in vitro transcription was constructed containing a T7 promoter and a GC-enriched sequence coding for the heavy and light chain of the Trastuzumab antibody, separated by the internal ribosomal entry site (IRES) from Encephalomyocarditis virus (EMCV). An α-globin 3'-UTR, followed by an A64 poly(A) sequence and a C30 sequence, was inserted 3' of the open reading frame (ORF). The C30 sequence was followed by a restriction site used for linearization of the vector before in vitro transcription. This DNA construct is shown in FIGS. 22 and 39 (SEQ ID NO: 61175). This vector was transcribed in vitro in the presence of a cap analog resulting in 5'-capped (m7G) mRNA ("R1965").

2.2 Animal Study

Before the start of the experiment, 7 weeks old female BALB/c nu/nu mice (n=14 per group) were subcutaneously implanted with slow-release estrogen pellets (0.72 mg 17β-estradiol) because the BT-474 cell line is estrogen receptor positive and estrogen enhances tumorigenicity. Mice were inoculated subcutaneously with $10 \times 10^6$ BT-474 tumour cells (100 µl of a cell/matrigel suspension) per mouse on day 0. Treatment was started on day 11 when tumors became injectable. Mice were treated twice weekly for up to 3.5 weeks with a single dose of 50 µg of mRNA (R1965) in a 50 µl injection volume (Ringer Lactate buffer).

2.3 Statistical Analysis

The statistical difference in survival was evaluated using Mantel-Cox (p=0.0499) and Gehan-Breslow (p=0.0425) tests, which assume the proportional hazards or give more weight to deaths at early time points, respectively.

2.4 Results

Results are shown in FIG. 28. This experiment demonstrates the effectiveness of the mRNA-encoded antibody Trastuzumab with respect to enhancing survival of nude BALB/c mice harboring a human tumor cell xenograft (BT-474 breast cancer cell line). The Her-2 positive tumor cell line BT-474 was used to establish tumors which were then treated by intratumoral injections of mRNA encoding the anti-Her-2 antibody Trastuzumab. The effectiveness of treatment was demonstrated by prolonged survival of treated animals compared to untreated animals (FIG. 28). The median survival time compared to untreated mice was increased by 5.5 days.

Example 3: In Vitro and In Vivo Effects of an mRNA Encoding Cetuximab (Erbitux)

3.1 Preparation of mRNA

For the present example a DNA sequence encoding the Cetuximab protein was prepared and used for subsequent in vitro transcription reactions as described in Example 1.

Briefly, a vector for in vitro transcription was constructed containing a T7 promoter and a GC-enriched sequence coding for the heavy and light chain of the Cetuximab antibody, separated by the internal ribosomal entry site (IRES) from Encephalomyocarditis virus (EMCV). An α-globin 3'-UTR, followed by an A64 poly(A) sequence and a C30 sequence, was inserted 3' of the open reading frame (ORF). The C30 sequence was followed by a restriction site used for linearization of the vector before in vitro transcription. This DNA construct is shown in FIGS. 17 and 40 (SEQ ID NO: 61170). This vector was transcribed in vitro. After in vitro transcription, the mRNA was enzymatically capped and polyadenylated. The resulting mRNA was termed "R3578".

3.2 In Vitro Expression of the Antibody Cetuximab

The expression of functional antibodies by mRNA-encoded Cetuximab was evaluated in vitro. To this end, HEK293T cells were transfected with 1 μg or 4 μg of mRNA (R3578) using the Lipofectamine2000 reagent. 24 hours after the transfection, the supernatant was collected and used for staining of A431 cells (EGFR-expressing cell line) and analysed by flow cytometry (FACS). The concentration of Cetuximab in the supernatant of the transfected cells was calculated using a standard curve generated with the commercially available Cetuximab protein. As shown in FIG. 29, transfection with 4 μg of mRNA (R3578) resulted in the production of functional antibodies at the concentration of approximately 40 ng/ml.

3.3 Animal Study 6-7 weeks old female BALB/c nu/nu mice (n=10) were inoculated subcutaneously in the right flank (near the dorsal region) with a cell suspension of about 5×10$^6$ SW48 cells (human colon cancer cell line; 100 μl of a cell/matrigel suspension). When the tumor reached a volume of 400-500 mm$^3$, the tumor tissue blocks were harvested for transplantation. SW48 tumor blocks (about 1.5 mm×1.5 mm×1.5 mm in size) were subcutaneously transplanted in the right flank (near the dorsal region) of 125 animals; eventually 40 tumor-bearing mice were enrolled in the study. The animals were weighed and randomized into treatment groups when the tumor size reached a volume of 100-150 mm$^3$. The date to start treatment was designated as day 0. All groups consisted of 10 animals each. The mRNA or Ringer lactate buffer was administered in a 50 μl volume intratumorally as shown in Table 14.

TABLE 14

Group designation and dosing schedule

| Group | No. of animals | Treatment | Dose | Frequency and days of dosing (after randomization) |
|---|---|---|---|---|
| 1 | 10 | Untreated | — | — |
| 2 | 10 | Ringer Lactate | — | Every 3 days for a total number of 7 injections |
| 3 | 10 | R3578 (Cetuximab (Erbitux) SEQ ID NO: 61243) | 100 μg | Every 3 days for a total number of 7 injections |
| 4 | 10 | R3578 (Cetuximab (Erbitux) SEQ ID NO: 61243) | 50 μg | Every 3 days for a total number of 7 injections |

Animals in a deteriorating condition with a body weight loss greater than 30% or bearing a tumor exceeding 2,000 mm$^3$ in size were euthanized.

Tumor volume, expressed in mm$^3$, was calculated using the following formula, in which "a" and "b" are the long and the short diameters of a tumor, respectively.

$$V(mm^3) = (a \times b^2)/2$$

Statistical Analysis

The statistical difference in survival was evaluated using Mantel-Cox and Gehan-Breslow tests, which assume the proportional hazards or give more weight to deaths at early time points, respectively. The hazard ratio (logrank) as part of the survival analysis of two data sets was included in the results. Hazard is defined as the slope of the survival curve and the hazard ratio compares the rate of death between two groups. The statistical difference between groups was evaluated using Mann-Whitney test.

Results

This experiment demonstrates the efficacy of the mRNA-encoded antibody Cetuximab with respect to enhancing survival of nude BALB/c mice harboring a human tumor cell xenograft (SW48 human colon cancer cell line).

As shown in FIG. 30, compared to the buffer-treated mice, the treatment with R3578 increased the time to the first death incident by 20% (7 days; first incident at day 42 compared to day 35 in RiLa-treated mice) in the group injected with 100 μg of mRNA-encoded Cetuximab (FIG. 30A) and approximately 15% (5 days) in the group treated with 50 μg of R3578 (FIG. 30B). Moreover, at day 51 all mice in the RiLa group were dead, whereas in total four mice treated with R3578 were still alive (one mouse in group treated with 100 μg R3578 and three mice treated with 50 μg R3578) were still alive. Consequently, the median survival time compared to RiLa-injected mice was increased in animals treated with 100 μg or 50 μg of mRNA-encoded Cetuximab.

To confirm the expression and functionality of mRNA-encoded Cetuximab in vivo, the sera from mice injected with 100 μg and 50 μg of R3578 were collected 24 hours after the third application and tested by flow cytometry (FACS) for the presence of functional antibodies as described above. The sera from untreated animals and mice injected with RiLa served as controls. As shown in FIG. 31, Cetuximab antibodies were clearly detectable in both groups injected with R3578 confirming the in vivo expression and functionality (capability to bind to EGFR) of mRNA-encoded antibodies.

Example 4: Effects of an mRNA Encoding a Single Chain, Bispecific Antibody (Blinatumomab) in an In Vivo Tumor Model As a further example, mRNA coding for Blinatumomab was tested in vivo (a bispecific anti-CD3/anti-CD19 antibody).

4.1 Preparation of mRNA

For the present example a DNA sequence encoding the Blinatumomab antibody was prepared and used for subsequent in vitro transcription reactions in a similar manner as described in Example 1, except that the antibody encoded by the mRNA was Blinatumomab.

Briefly, a vector for in vitro transcription was constructed containing a T7 promoter and a GC-enriched sequence coding for Blinatumomab (a fusion protein consisting of the variable regions of two single-chain monoclonal antibodies (scFvs)—CD19 and CD3—covalently linked by a non-immunogenic five-amino acid chain). An α-globin 3'-UTR, followed by an A64 poly(A) sequence and a C30 sequence, was inserted 3' of the open reading frame (ORF). The C30 sequence was followed by a restriction enzyme site used for linearization of the vector before in vitro transcription. The respective CDS sequence as well as the sequence of the mRNA can be retrieved from Table 12 (Example 1). This vector was transcribed in vitro in the presence of a cap analog resulting in 5'-capped (m7G) mRNA ("R3981").

4.2 Animal Study

NOG female mice (n=6 per group) were inoculated subcutaneously in the right flank with a cell suspension consisting of 1×10⁶ NALM-6 cells (human pre-B cell leukemia) and 1×10⁸ freshly isolated human PBMCs (peripheral blood mononuclear cells). The NALM-6 cells were co-injected together with human peripheral mononuclear cells (PBMCs) as source of human T-cells because Blinatumomab as a bispecific antibody recognizes the CD19 protein on the human NALM-6 cells and the CD3 protein on the human T cells. One hour after cell inoculation mice were treated by peritumoral injections of the mRNA encoding Blinatumomab ("R3981"; 100 µg) or buffer (Ringer Lactate) as a control and this treatment was repeated on five consecutive days. The detailed group description is depicted in Table 15.

TABLE 15

Animal groups and dosing schedule.

| Group | No. of animals | PBMCs | Treatment | Dose | Treatment schedule |
|---|---|---|---|---|---|
| 1 | 6 | — | Ringer Lactate | — | At five consecutive days beginning at day 0 |
| 2 | 6 | + | Ringer Lactate | — | At five consecutive days beginning at day 0 |
| 3 | 6 | + | R3981 (Blinatumomab SEQ ID NO: 61643) | 100 µg | At five consecutive days beginning at day 0 |

The animal health status was checked daily. Animals in a deteriorating condition with a body weight loss greater than 20% or bearing a tumor exceeding 2 cm³ in size were euthanized.

Tumor volume, expressed in cm³, was calculated using the following formula, in which "a" and "b" are the long and the short diameters of a tumor, respectively.

$$V(cm^3) = (a \times b^2)/2$$

Statistical Analysis

The statistical analysis of tumor growth curves was performed using 2-way ANOVA test with Bonferroni post test. The statistical analysis of differences in tumor volume at day 34 was performed using t-test with Welch's correction (the data were normally distributed as determined by Kolmogorov-Smirnov normality test). The statistical difference in survival was evaluated using Mantel-Cox test.

Results

This experiment shows the efficacy of the mRNA-encoded Blinatumomab antibody in terms of reduction of tumor growth and enhancing survival of NOG mice harboring a human cell xenograft (NALM-6 human pre-B leukemia cells).

Subcutaneously injected NALM-6 cells developed palpable tumors in control treated mice at day 25. Thereafter, the tumor rapidly increased in size in all buffer-treated animals (FIG. 32). Contrary to the control group, only one of six mice in the cohort treated with the mRNA-encoded Blinatumomab developed a measurable tumor. As a result, a statistically significant inhibition of tumor growth in the group injected with R3981 in comparison to buffer-treated mice was observed.

To further demonstrate the impact of the mRNA-encoded Blinatumomab treatment on the growth of the subcutaneously injected NALM-6 cells the tumor volume of each mouse at day 34 was depicted (FIG. 33). Day 34 was chosen for this analysis as the last day when all animals in all groups were still alive and therefore the mean tumor volumes can be compared. As shown in FIG. 33, treatment with R3981 significantly inhibited tumor growth compared to the buffer control.

In addition to the effect on tumor growth, the difference in survival between the experiments groups was evaluated. As shown in FIG. 34, treatment with the mRNA-encoded Blinatumomab significantly enhanced mice survival compared to the buffer-treated animals. At day 49, all animals in the R3981-treated group were alive (5/6 mice were completely tumor-free and only one mouse had a measurable tumor) compared to the control group where five of six animals were already dead. Consequently, the R3981-treated group had an undefined median survival time (MS), whereas the buffer-treated group reached MS at 38.25 days. Thus treatment with the mRNA encoding Blinatumomab significantly enhanced the survival compared to the buffer-treated animals.

Example 5: In Vitro Expression of mRNA-Encoded Anti-BoNTx Antibody

In this experiment the in vitro expression of mRNA-encoded anti-BoNTx antibody was evaluated.

5.1 Preparation of mRNA

For the present example DNA sequences encoding an antibody directed against the Botulinum neurotoxin (BoNTx) (Amersdorfer et al., 1997. Infect. Immun. 65(9): 3743-52) were prepared and used for subsequent in vitro transcription reactions. Heavy (HC) and light (LC) chain of the antibody were encoded as separate entities and constructs differed regarding signal peptides used for protein secretion (Table 16).

Vectors for in vitro transcription were constructed containing a T7 promoter and a GC-enriched sequence coding for the heavy and light chain of the antibody, respectively. An α-globin 3'-UTR, followed by an A64 poly(A) sequence and a C30 sequence, was inserted 3' of the open reading frame (ORF). The C30 sequence was followed by a restriction site used for linearization of the vector before in vitro transcription. The respective CDS sequences as well as the sequences of the mRNA can be retrieved from Table 12 (Example 1). For capping of the mRNA, in vitro transcription was conducted in the presence of cap analog.

TABLE 16 mRNA constructs

| mRNA | encoded antibody | signal peptide | RNA design |
|---|---|---|---|
| R5045 (any of SEQ ID NOs 61609-61611)/R5046 (any of SEQ ID NOs 61612-61614) | anti-BoNTx | HLA-2 | HC and LC encoded on separate mRNA molecules |
| R4120 (any of SEQ ID NOs 61603-61605)/R4122 (any of SEQ ID NOs 61606-61608) | anti-BoNTx | immuno-globulin | HC and LC encoded on separate mRNA molecules |

5.2 In Vitro Expression of the Anti-BoNTx Antibody Evaluated by Western Blot Analysis The expression of mRNA-encoded anti-BoNTx antibody was evaluated in vitro. To this end, BHK cells were transfected with 10 µg of mRNA using the Lipofectamine2000 reagent. 24 hours after the transfection, cells and supernatants were collected for Western blot analysis to determine the expression of human antibodies.

5.3 Results

As shown in FIG. 35, human antibodies were clearly detectable in lysates and supernatants of mRNA-transfected cells. The mRNA-transfected cells produced both, heavy and light chain, and gave rise to high and equivalent levels of both chains in the supernatant, thus strongly suggesting the production of correctly folded and assembled antibodies. Expression was specific as no antibodies were detected in the supernatants of mock-transfected cells.

Example 6: In Vitro Expression of mRNA-Encoded Anti-Influenza (Anti-HA) Antibody In these experiments the in vitro expression and binding to the native antigen of mRNA-encoded CR8033 (anti-HA: anti-hemagglutinin) antibody was evaluated.

6.1 Preparation of mRNA

For the present example DNA sequences encoding the CR8033 anti-hemagglutinin antibody (Dreyfus et al., 2012. Science 337(6100):1343-8) were prepared and used for subsequent in vitro transcription reactions. The antibody was represented by bi-cistronic sequences in which heavy chain (HC) and light chain (LC) were separated by the internal ribosomal entry site (IRES) from either Encephalomyocarditis (EMCV) or Foot-and-mouth disease (FMDV) virus. Moreover, sequences varied with respect to the order of heavy and light chain or utilized different signal peptides for the secretion of both chains (Table 17).

Vectors for in vitro transcription were constructed containing a T7 promoter and a GC-enriched sequence coding for the heavy and light chain of the antibody. An α-globin 3'-UTR, followed by an A64 poly(A) sequence and a C30 sequence, was inserted 3' of the open reading frame (ORF). The C30 sequence was followed by a restriction site used for linearization of the vector before in vitro transcription. The respective CDS sequences as well as the sequences of the mRNA can be retrieved from Table 12 (Example 1). For capping of the mRNA, in vitro transcription was conducted in the presence of cap analog.

TABLE 17 mRNA constructs

| mRNA | encoded antibody | signal peptide | RNA design |
| --- | --- | --- | --- |
| R3996 (SEQ ID NO: 61465) | CR8033 (anti-HA) | immunoglobulin | HC:EMCV-IRES:LC |
| R4000 (SEQ ID NO: 61479, 61480) | CR8033 (anti-HA) | Albumin (ALB) | HC:EMCV-IRES:LC |

6.2 In Vitro Expression of the CR8033 Antibody Evaluated by Western Blot Analysis The expression of antibodies by mRNA-encoded CR8033 was evaluated in vitro. To this end, BHK cells were transfected with 10 μg of mRNA using the Lipofectamine2000 reagent. 24 hours after the transfection, cells and supernatants were collected for Western blot analysis to determine the expression of human antibodies.

6.3 In Vitro Expression of Functional CR8033 Antibody Evaluated by Flow Cytometry To confirm the functionality of the in vitro-produced mRNA-encoded antibody, the supernatant obtained after transfection of BHK cells (as described above) was used for staining of hemagglutinin (HA) expressing HeLa cells. To this end, HeLa cells were transfected with 1 μg of HA-expressing mRNA using the Lipofectamine2000 reagent and, after staining, analyzed by flow cytometry (FACS). The expression is presented as median fluorescence intensity.

6.4 Results

Figure 36:
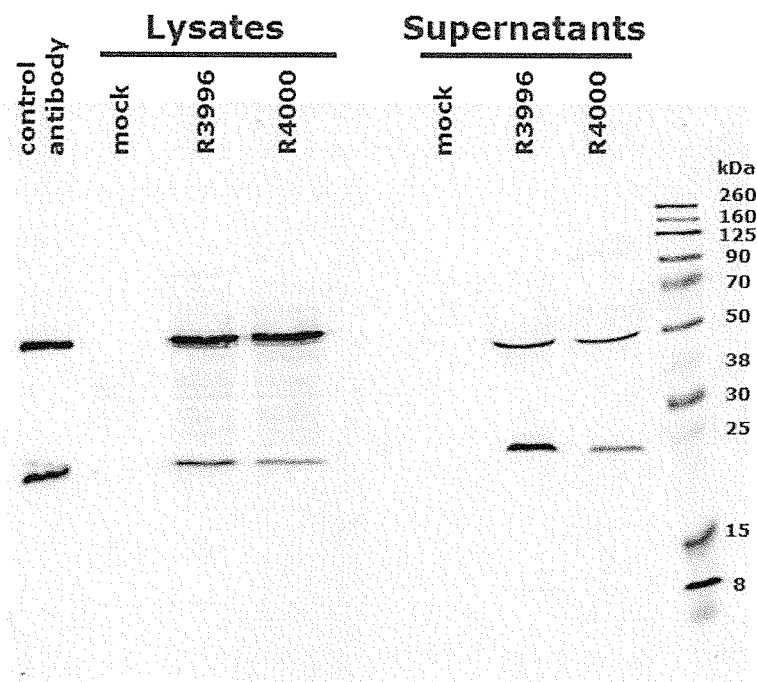

As shown in FIG. 36, mRNA-transfected cells produced both, heavy and light chain, and gave rise to high and equivalent levels of both chains in the supernatant, thus strongly suggesting the production of correctly folded and assembled antibodies. Expression was specific as no antibodies were detected in the supernatants of mock-transfected cells.

Figure 37:
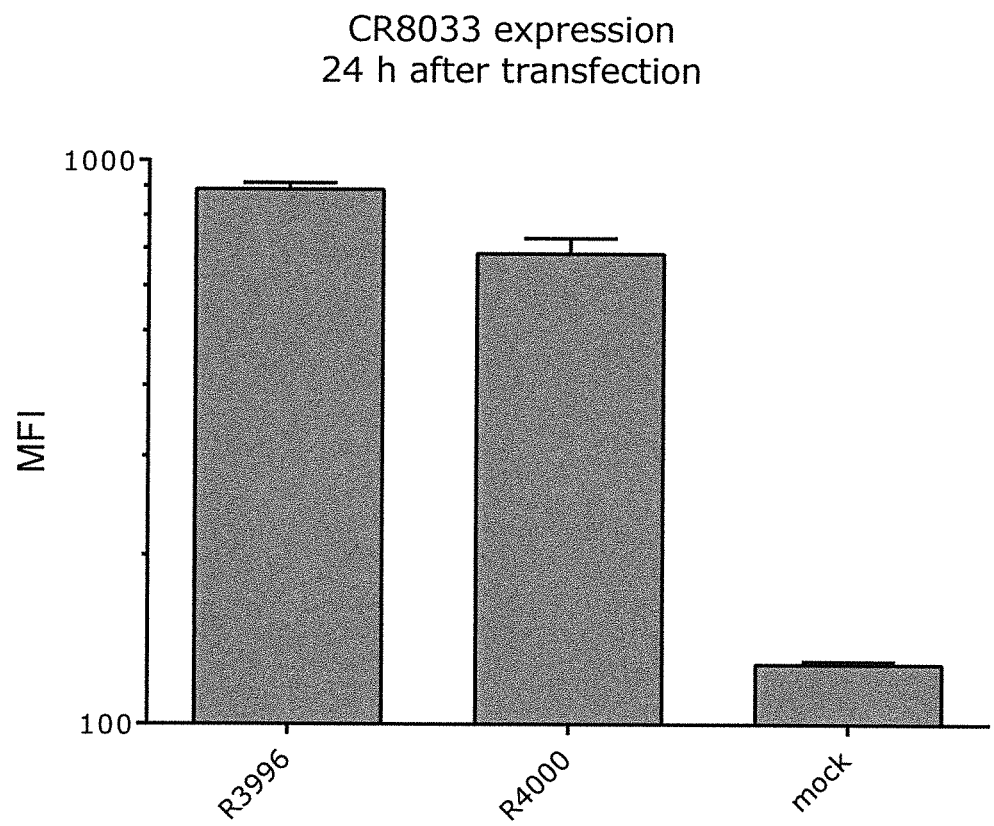

As shown in FIG. 37, all antibody-encoding mRNAs resulted in the production of functional antibodies.

Example 7: In Vitro and In Vivo Expression of mRNA-Encoded Anti-Rabies (anti-RAV G) Antibody In this experiment the in vitro expression and binding to the native antigen of mRNA-encoded anti-RAV G antibody was evaluated.

7.1 Preparation of mRNA

For the present example DNA sequences encoding an antibody directed against the Rabies virus glycoprotein (RAV G) (SO57 antibody; Prosniak et al., 2003. J. Infect. Dis. 188(1):53-6) were prepared and used for subsequent in vitro transcription reactions. Heavy (HC) and light (LC) chain of the antibody were either linked by the internal ribosomal entry site (IRES) from Encephalomyocarditis virus (EMCV) or encoded as separate entities (Table 18).

Vectors for in vitro transcription were constructed containing a T7 promoter and a GC-enriched sequence coding for the heavy and/or light chain of the antibody. An α-globin 3'-UTR, followed by an A64 poly(A) sequence and a C30 sequence, was inserted 3' of the open reading frame (ORF). The C30 sequence was followed by a restriction site used for linearization of the vector before in vitro transcription. The respective CDS sequences as well as the sequences of the mRNA can be retrieved from Table 12 (Example 1). For capping of the mRNA, in vitro transcription was conducted in the presence of cap analog.

TABLE 18 mRNA constructs

| mRNA | encoded antibody | signal peptide | RNA design |
| --- | --- | --- | --- |
| R4116 (SEQ ID NO: 61410)/R4118 (SEQ ID NO: 61414) | anti-RAV G | immuno-globulin | HC and LC encoded on separate mRNA molecules |
| R3059 (SEQ ID NO: 614104/61405) | anti-RAV G | immuno-globulin | HC:EMCV-IRES:LC |

7.2 In Vitro Expression of the Functional Anti-RAV G Antibody Evaluated by Flow Cytometry To demonstrate functionality of in vitro-produced mRNA-encoded antibody, the supernatant obtained after transfection of BHK cells was used for staining of RAV G expressing HeLa cells. To this end, BHK cells were transfected with 10 μg of antibody-encoding mRNA and HeLa cells were transfected with 1 μg of RAV G-expressing mRNA, respectively, using the Lipofectamine2000 reagent. After staining, HeLa cells were analyzed by flow cytometry (FACS). The expression level of the anti-RAV G antibody is presented as median fluorescence intensity.

7.3 Results

As shown in FIG. 38, all antibody-encoding mRNAs resulted in the production of functional antibodies. However, the antibody produced from mRNA molecules separately encoding heavy chain and light chain produced higher antibody levels as compared to the antibody produced from an mRNA molecule encoding both, heavy chain and light chain. All antibodies were functional as they recognized and bound RAV G antigen expressed on the surface of HeLa cells. Encoding heavy and light chain by separate mRNA molecules instead of a bi-cistronic construct strongly increased the amount of functional antibodies secreted by mRNA-transfected cells.

Example 8: In Vitro Expression of mRNA-Encoded Anti-HIV Antibody

In this experiment the in vitro expression and neutralization activity to the HIV-1Ba-L HIV strain was tested for RNA-encoded antibodies.

8.1 Preparation of mRNA

For the present example DNA sequences encoding an antibody directed against the HIV (VRC01; Wu et al., Science 329(5993):856-861, 2010) were prepared and used for subsequent in vitro transcription reactions. Heavy (HC) and light (LC) chain of the antibody were encoded as separate entities (Table 19). For the heavy chains of VRC01, the sequence of the IgG constant region of S057 and the sequence of an immunoglobulin kappa light chain constant region (GenBank: AGH70219.1) was used.

Vectors for in vitro transcription were constructed containing a T7 promoter and a GC-enriched sequence coding for the heavy and/or light chain of the antibody. An α-globin 3'-UTR, followed by an A64 poly(A) sequence and a C30 sequence, was inserted 3' of the open reading frame (ORF). The C30 sequence was followed by a restriction site used for linearization of the vector before in vitro transcription. The respective CDS sequences as well as the sequences of the mRNA can be retrieved from Table 12. For capping of the mRNA, in vitro transcription was conducted in the presence of cap analog. Cells were transfected with lipofectamin 2000 complexed mRNA.

TABLE 19 mRNA constructs

| mRNA construct | encoded antibody | RNA design |
|---|---|---|
| R5319 (SEQ ID NO: 61372)/R5320 (SEQ ID NO: 61383) | VRC01 | HC and LC encoded on separate mRNA molecules |

8.2 In Vitro Expression of the Functional Anti-HIV Antibody Evaluated by IgG ELISA To demonstrate expression of in vitro-produced mRNA-encoded antibody, the supernatant obtained after transfection of BHK cells was subjected to an IgG-specific ELISA where plates were coated with an anti-human IgG antibody. Antibody detection was obtained in a plate reader.

8.3 In Vitro Functionality of an Anti-HIV Antibody Evaluated in MAGI-R5 Cells—Inhibitory Effect on HIV Infection The inhibitory activity of the mRNA-encoded antibody of the invention on HIV infection is measured on the human MAGI R5 recombinant cell line coexpressing the human CCR5 receptor and CD4 at their extracellular membrane. The cells used in the assay contain the HIV-1 LTR promoter that drives expression of β-gal upon infection (this driven by the interaction of tat and the LTR).

Consequently, to demonstrate the functionality of anti-HIV antibody, the supernatant obtained after transfection of BHK cells was subjected to the virus entry test using MAGI-R5 cells which report the entry of HIV by chemo luminescence (Magi R5-Tropic Antiviral Assay performed at Southern Research, Maryland, USA). Inhibition of virus entry correlates with reduced RLU (relative light units). Upon virus entry, the receptor (CCR5) fused to beta-gal is expressed which is detected by chemo-luminescence, thus, the lower the RLU values the more inhibition of virus entry is observed.

8.4 Results

As shown in FIG. 42, mRNA encoding anti-HIV antibody expressed antibodies.

As shown in FIG. 43, increasing concentrations of expressed anti-HIV antibody reduced virus entry in MAGI cells (CC=cell control containing cells only; VC=virus control containing also virus). Included as a control was commercially available recombinant VRC01 (FIG. 43C). mRNA-encoded VRC01 (FIG. 43B) inhibited the entry of HIV similar to recombinant VRC01 (FIG. 43C). Thus, the mRNA-encoded antibody of the invention is able to protect a human recombinant cell line (MAGI R5 cell) from the infection by a HIV virus.

Example 9: In Vitro Expression of mRNA-Encoded Rituximab

In these experiments the in vitro expression of mRNA-encoded Rituximab and binding to its native antigen was evaluated.

9.1. Preparation of mRNA

For the present example a DNA sequence encoding the Rituximab protein was prepared and used for subsequent in vitro transcription reactions.

A vector for in vitro transcription was constructed containing a T7 promoter and a GC-enriched sequence coding for the heavy and light chain of the Rituximab antibody, separated by the internal ribosomal entry site (IRES) from Encephalomyocarditis virus (EMCV). An α-globin 3'-UTR, followed by an A64 poly(A) sequence and a C30 sequence, was inserted 3' of the open reading frame (ORF). The C30 sequence was followed by a restriction site used for linearization of the vector before in vitro transcription. This vector was transcribed in vitro in the presence of a cap analog resulting in 5'-capped (m7G) mRNA (R3917; SEQ ID NO: 61337).

9.2 In Vitro Expression of the Rituximab Antibody Evaluated by ELISA

The expression of functional antibodies by mRNA-encoded Rituximab was evaluated in vitro. To this end, HEK293T cells were transfected with 1 μg or 4 μg of mRNA (R3917) using the Lipofectamine2000 reagent. 24 hours after the transfection, the supernatant was collected and used in ELISA to determine the expression of human antibodies.

9.3 In Vitro Expression of the Functional Rituximab Antibody Evaluated by Flow Cytometry To confirm the functionality of the in vitro-produced mRNA-encoded Rituximab, the supernatant obtained after transfection of HEK293T cells (as described above) was used for staining of Raji cells (the cell line expressing human CD20) and the cells were analysed by flow cytometry (FACS). The concentration of Rituximab in the supernatant of the transfected cells was calculated using a standard curve generated with the commercially available Rituximab protein.

9.4 Results

In these experiments the in vitro expression of mRNA-encoded Rituximab and binding to its native antigen was evaluated.

As shown in FIG. 44, the concentration of over 10 ng/ml of human antibodies was detected in the supernatant of cells transfected with 4 µg of R3917, the expression was dose-dependent and specific as no antibodies were detected in the supernatants of the sham-transfected cells. These antibodies were functional as they recognized and bound CD20 antigen expressed on the surface of Raji cells (FIG. 45). The estimated concentration of the antibodies using ELISA (here, a method that measures human antibodies) and flow cytometry (here, a method that measures only functional Rituximab) was similar suggesting that all antibodies detected in the supernatant are fully functional.

Example 10: In Vitro Expression of mRNA-Encoded Anti-RSV F Antibody

In this experiment the in vitro expression of an mRNA-encoded antibody against human respiratory syncytial virus F protein (anti-RSV F antibody; Palivizumab) was investigated.

10.1 Preparation of mRNA

For the present example DNA sequences encoding an antibody directed against the human respiratory syncytial virus F protein (RSV F) (Synagis antibody) were prepared and used for subsequent in vitro transcription reactions. Heavy (HC) and light (LC) chain of the antibody were either linked by the internal ribosomal entry site (IRES) from Encephalomyocarditis virus (EMCV) or encoded as separate entities (Table 20). Vectors for in vitro transcription were constructed containing a T7 promoter and a GC-enriched sequence coding for the heavy and/or light chain of the antibody. An α-globin 3'-UTR, followed by an A64 poly(A) sequence and a C30 sequence, was inserted 3' of the open reading frame (ORF). The C30 sequence was followed by a restriction site used for linearization of the vector before in vitro transcription. For capping of the mRNA, in vitro transcription was conducted in the presence of cap analog.

TABLE 20

| mRNA constructs | | | |
|---|---|---|---|
| mRNA construct | encoded antibody | | RNA design |
| R4179 (SEQ ID NO: 61677)/R4181 (SEQ ID NO: 61699) | anti-RSV F | immuno-globulin | HC and LC encoded on separate mRNA molecules |
| R4180 (SEQ ID NO: 61688)/R4182 (SEQ ID NO: 61710) | anti-RSV F | immuno-globulin | HC and LC encoded on separate mRNA molecules |
| R3060 (SEQ ID NO: 61666) | anti-RSV F | HLA-2 | HC:EMCV-IRES:LC |

10.2 In vitro expression of the anti-RSV-F antibodies evaluated by Western blot analysis The expression of mRNA-encoded anti-RSV F antibody was evaluated in vitro. To this end, BHK cells were transfected with 10 µg of mRNA using the Lipofectamine2000 reagent. 24 hours after the transfection, cells and supernatants were collected for Western blot analysis to determine the expression of human antibodies.

10.3 Results

As shown in FIG. 46, human antibodies were clearly detectable in lysates and supernatants of mRNA-transfected cells. However, the antibody level was strongly dependent on the format of antibody representation. The mRNA-transfected cells produced both, heavy and light chain, while encoding heavy and light chain by separate mRNA molecules instead of a bi-cistronic construct strongly improved the ratio of heavy and light chain, thus giving rise to almost equivalent levels of both chains. Expression was specific as no antibodies were detected in the supernatants of mock-transfected cells.

SEQUENCE LISTING (61734 sequences)

SEQ ID NO: 1 - protein, 449 aa, Artificial Sequence
  AAB-003_gamma1-Chain
EVQLLESGGGLVQPGGSLRLSCAASGFTFSNYGMSWVRQAPGKGLEWVASIRSGGGRTYYSDNVKGRFTISRDNSKNTLYLQMNSLRAEDTAVYYCVRYDHYSGSSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 2 - protein, 443 aa, Artificial Sequence
  Abagovomab_HeavyChain
QVKLQESGAELARPGASVKLSCKASGYTFTNYWMQWVKQRPGQGLDWIGAIYPGDGNTRYTHKFKGKATLTADKSSSTAYMQLSSLASEDSGVYYCARGEGNYAWFAYWGQGTTVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 3 - protein, 214 aa, Artificial Sequence
  Abagovomab_LightChain
DIELTQSPASLSASVGETVTITCQASENIYSYLAWHQQKQGKSPQLLVYNAKTLAGGVSSRFSGSGSGTHFSLKIKSLQPEDFGIYYCQHHYGILPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 4 - protein, 450 aa, Artificial Sequence
  Abciximab_HeavyChain
EVQLQQSGAELVKPGASVKLSCTASGFNIKDTYVHWVKQRPEQGLEWIGRIDPANGYTKYDPKFQGKATITADTSSNTAYLQLSSLTSEDTAVYYCVRPLYDYYAMDYWGQGTSVTVSSAKTTAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 5 - protein, 214 aa, Artificial Sequence
  Abciximab_LightChain
DILMTQSPSSMSVSLGDTVSITCHASQGISSNIGWLQQKPGKSFMGLIYYGTNLVDGVPSRFSGSGSGADYSLTISSLDSEDFADYYCVQYAQLPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 6 - protein, 447 aa, Artificial Sequence
  Abituzumab_HeavyChain1
QVQLQQSGGELAKPGASVKVSCKASGYTFSSFWMHWVRQAPGQGLEWIGYINPRSGYTEYNEIFRDKATMTTDTSTSTAYMELSSLRSEDTAVYYCASFLGRGAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVEPKSSDKTHTCPPCPAPPVAGPSVFLFPPKPKDTLMISRTPEVTCVVVDVSHEDPEVQFNWYVDGVEVHNAKTKPREEQAQSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 7 - protein, 214 aa, Artificial Sequence
  Abituzumab_LightChain1
DIQMTQSPSSLSASVGDRVTITCRASQDISNYLAWYQQKPGKAPKLLIYYTSKIHSGVPSRFSGSGSGTDYTFTISSLQPEDIATYYCQQGNTFPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 8 - protein, 444 aa, Artificial Sequence
  Abrilumab_HeavyChain1
QVQLVQSGAEVKKPGASVKVSCKVSGYTLSDLSIHWVRQAPGKGLEWMGGFDPQDGETIYAQKFQGRVTMTEDTSTDTAYMELSSLKSEDTAVYYCATGSSSSWFDPWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 9 - protein, 214 aa, Artificial Sequence
  Abrilumab_LightChain1
DIQMTQSPSSVSASVGDRVTITCRASQGISSWLAWYQQKPGKAPKLLIYGASNLESGVPSRFSGSGSGTDFTLTISSLQPEDFANYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 10 - protein, 213 aa, Artificial Sequence
  Abrilumab_LightChain1_variant2
QIVLTQSPAIMSASPGEKVTITCSASSSVSYMNWFQQKPGTSPKLWIYSTSNLASGVPARFSGSGSGTSYSLTISRMEAEDAATYYCQQRSSYPNTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 11 - protein, 449 aa, Artificial Sequence
  Actoxumab_HeavyChain1
EVQLVQSGAEVKKSGESLKISCKGSGYSFTSYWIGWVRQMPGKGLEWMGIFYPGDSSTRYSPSFQGQVTISADKSVNTAYLQWSSLKASDTAMYYCARRRNWGNAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 12 - protein, 215 aa, Artificial Sequence
  Actoxumab_LightChain1
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSTWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 13 - protein, 224 aa, Artificial Sequence
  Adalimumab_HeavyChain
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 14 - protein, 214 aa, Artificial Sequence
  Adalimumab_LightChain
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 15 - protein, 453 aa, Artificial Sequence
  Aducanumab_HeavyChain1
QVQLVESGGGVVQPGRSLRLSCAASGFAFSSYGMHWVRQAPGKGLEWVAVIWFDGTKKYYTDSVKGRFTISRDNSKNTLYLQMNTLRAEDTAVYYCARDRGIGARRGPYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 16 - protein, 214 aa, Artificial Sequence
  Aducanumab_LightChain1
DIQMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 17 - protein, 453 aa, Artificial Sequence
  Afasevikumab_HeavyChain1
EVQLVESGGGLVQPGRSLRLSCAASGFTFDDYAMHWVRQAPGKGLEWVSGINWSSGGIGYADSVKGRFTISRDNAKNSLYLQMNSLRAEDTALYYCARDIGGFGEFYWNFGLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 18 - protein, 215 aa, Artificial Sequence
  Afasevikumab_LightChain1
EIVLTQSPATLSLSPGERATLSCRASQSVRSYLAWYQQKPGQAPRLLIYDASNRATGIPARFSGSGSGTDFTLTISSLEPEDFAVYYCQQRSNWPPATFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 19 - protein, 431 aa, Artificial Sequence
  Aflibercept_Fusion_protein1
SDTGRPFVEMYSEIPEIIHMTEGRELVIPCRVTSPNITVTLKKFPLDTLIPDGKRIIWDSRKGFIISNATYKEIGLLTCEATVNGHLYKTNYLTHRQTNTIIDVVLSPSHGIELSVGEKLVLNCTARTELNVGIDFNWEYPSSKHQHKKLVNRDLKTQSGSEMKKFLSTLTIDGVTRSDQGLYTCAASSGLMTKKNSTFVRVHEKDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 20 - protein, 444 aa, Artificial Sequence
  Afutuzuab_HeavyChain1
QVQLVQSGAEVKKPGSSVKVSCKASGYAFSYSWINWVRQAPGQGLEWGRIFPGDGDTDYNGKFKGRVTITADKSTSTAYELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVHEALHNHYTQKSLSLSPG

SEQ ID NO: 21 - protein, 217 aa, Artificial Sequence
  Afutuzuab_LightChain1
DIVTQTPLSLPVTPGEPASISCRSSKSLLHSNGITYLYWYLQKPGQSPQLLIYQSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 22 - protein, 449 aa, Artificial Sequence
  Afutuzumab_HeavyChain1
QVQLVQSGAEVKKPGSSVKVSCKASGYAFSYSWINWVRQAPGQGLEWMGRIFPGDGDTDYNGKFKGRVTITADKSTSTAYMELSSLRSEDTAVYYCARNVFDGYWLVYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 23 - protein, 219 aa, Artificial Sequence
  Afutuzumab_LightChain1
DIVMTQTPLSLPVTPGEPASISCRSSKSLLHSNGITYLYWYLQKPGQSPQLLIYQMSNLVSGVPDRFSGSGSGTDFTLKISRVEAEDVGVYYCAQNLELPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 24 - protein, 228 aa, Artificial Sequence
  Alacizumab_pegol_HeavyChain1
EVQLVESGGGLVQPGGSLRLSCAASGFTFSSYGMSWVRQAPGKGLEWVATITSGGSYTYYVDSVKGRFTISRDNAKNTLYLQMNSLRAEDTAVYYCVRIGEDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAA

SEQ ID NO: 25 - protein, 214 aa, Artificial Sequence
  Alacizumab_pegol_LightChain1
DIQMTQSPSSLSASVGDRVTITCRASQDIAGSLNWLQQKPGKAIKRLIYATSSLDSGVPKRFSGSRSGSDYTLTISSLQPEDFATYYCLQYGSFPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 26 - protein, 451 aa, Artificial Sequence
  Alemtuzumab_HeavyChain
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 27 - protein, 219 aa, Artificial Sequence
  Alemtuzumab_HeavyChain_variant_1bey_H
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKV

SEQ ID NO: 28 - protein, 220 aa, Artificial Sequence
  Alemtuzumab_HeavyChain_variant_1ce1_H
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVE

SEQ ID NO: 29 - protein, 437 aa, Artificial Sequence
  Alemtuzumab_HeavyChain_variant_8005_H
QVQLQESGPGLVRPSQTLSLTCTVSGFTFTDFYMNWVRQPPGRGLEWIGFIRDKAKGYTTEYNPSVKGRVTMLVDTSKNQFSLRLSSVTAADTAVYYCAREGHTAAPFDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 30 - protein, 211 aa, Artificial Sequence
  Alemtuzumab_LightChain
DIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 31 - protein, 214 aa, Artificial Sequence
  Alemtuzumab_LightChain_variant_8005_L
DIQMTQSPSSLSASVGDRVTITCKASQNIDKYLNWYQQKPGKAPKLLIYNTNNLQTGVPSRFSGSGSGTDFTFTISSLQPEDIATYYCLQHISRPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 32 - protein, 447 aa, Artificial Sequence
  Alirocumab_HeavyChain1
EVQLVESGGGLVQPGGSLRLSCAASGFTFNNYAMNWVRQAPGKGLDWVSTISGSGGTTNYADSVKGRFIISRDSSKHTLYLQMNSLRAEDTAVYYCAKDSNWGNFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 33 - protein, 220 aa, Artificial Sequence
  Alirocumab_LightChain1
DIVMTQSPDSLAVSLGERATINCKSSQSVLYRSNNRNFLGWYQQKPGQPPNLLIYWASTRESGVPDRFSGSGSGTDFTLTISSLQAEDVAVYYCQQYYTTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 34 - protein, 245 aa, Artificial Sequence
  ALX-0061_HeavyChain1
EVQLVESGGGLVQPGGSLRLSCAASGSVFKINVMAWYRQAPGKGRELVAGIISGGSTSYADSVKGRFTISRDNAKNTLYLQMNSLRPEDTAVYYCAFITTESDYDLGRRYWGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSS

SEQ ID NO: 35 - protein, 449 aa, Artificial Sequence
  Amatuximab_HeavyChain1
QVQLQQSGPELEKPGASVKISCKASGYSFTGYTMNWVKQSHGKSLEWIGLITPYNGASSYNQKFRGKATLTVDKSSSTAYMDLLSLTSEDSAVYFCARGGYDGRGFDYWGSGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 36 - protein, 213 aa, Artificial Sequence
  Amatuximab_LightChain1
DIELTQSPAIMSASPGEKVTMTCSASSSVSYMHWYQQKSGTSPKRWIYDTSKLASGVPGRFSGSGSGNSYSLTISSVEAEDDATYYCQQWSKHPLTFGSGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 37 - protein, 450 aa, Artificial Sequence
  Anetumab_ravtansine_HeavyChain1
QVELVQSGAEVKKPGESLKISCKGSGYSFTSYWIGWVRQAPGKGLEWMGIIDPGDSRTRYSPSFQGQVTISADKSISTAYLQWSSLKASDTAMYYCARGQLYGGTYMDGWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 38 - protein, 217 aa, Artificial Sequence
  Anetumab_ravtansine_LightChain1
DIALTQPASVSGSPGQSITISCTGTSSDIGGYNSVSWYQQHPGKAPKLMIYGVNNRPSGVSNRFSGSKSGNTASLTISGLQAEDEADYYCSSYDIESATPVFGGGTKLTVLGQPKAAPSVTLFPPSSEELQANKATLVCLISDFYPGAVTVAWKGDSSPVKAGVETTTPSKQSNNKYAASSYLSLTPEQWKSHRSYSCQVTHEGSTVEKTVAPTECS

SEQ ID NO: 39 - protein, 447 aa, Artificial Sequence
  Anifrolumab_HeavyChain1
EVQLVQSGAEVKKPGESLKISCKGSGYIFTNYWIAWVRQMPGKGLESMGIIYPGDSDIRYSPSFQGQVTISADKSITTAYLQWSSLKASDTAMYYCARHDIEGFDYWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 40 - protein, 215 aa, Artificial Sequence
  Anifrolumab_LightChain1
EIVLTQSPGTLSLSPGERATLSCRASQSVSSSFFAWYQQKPGQAPRLLIYGASSRATGIPDRLSGSGSGTDFTLTITRLEPEDFAVYYCQQYDSSAITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 41 - protein, 448 aa, Artificial Sequence
  Anrukinzumab_HeavyChain1
EVQLVESGGGLVQPGGSLRLSCAASGFTFISYAMSWVRQAPGKGLEWVASISSGGNTYYPDSVKGRFTISRDNAKNSLYLQMNSLRAEDTAVYYCARLDGYYFGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEALGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 42 - protein, 218 aa, Artificial Sequence
  Anrukinzumab_LightChain1
DIQMTQSPSSLSASVGDRVTITCKASESVDNYGKSLMHWYQQKPGKAPKLLIYRASNLESGVPSRFSGSGSGTDFTLTISSLQPEDFATYYCQQSNEDPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 43 - protein, 446 aa, Artificial Sequence
  Apolizumab_HeavyChain1
QVQLQESGPGLVKPSETLSLTCTVSGFSLTNYGVHWVRQSPGKGLEWIGVKWSGGSTEYNAAFISRLTISKDTSKNQVSLKLNSLTAADTAVYYCARNDRYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 44 - protein, 214 aa, Artificial Sequence
  Apolizumab_LightChain1
DIQMTQSPSSLSASVGDRVTITCRASENIYSYLAWYQQKPGKAPKLLVSNAKTLAEGVPSRFSGSGSGKQFTLTISSLQPEDFATYYCQHHYGNSYPFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 45 - protein, 126 aa, Artificial Sequence
  Apomab_HeavyChain
EVQLVQSGGGVERPGGSLRLSCAASGFTFDDYAMWVRQAPGKGLEWVSGINWQGGSTGYADSVKGRVTISRDNAKNSLYLQMNSLRAEDTAVYYCAKILGAGRGWYFDYWGKGTTVTVSSASTKGP

SEQ ID NO: 46 - protein, 108 aa, Artificial Sequence
  Apomab_LightChain
SELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVLG

SEQ ID NO: 47 - protein, 215 aa, Artificial Sequence
  Aquaporumab_LightChain
EIVLTQSPGTLSLSPGERATLSCRASQTVRTNYLAWFQQKPGQAPRLLIFGASSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 48 - protein, 442 aa, Artificial Sequence
  Arcitumomab_99tc_HeavyChain
EVKLVESGGGLVQPGGSLRLSCATSGFTFTDYYMNWVRQPPGKALEWLGFIGNKANGYTTEYSASVKGRFTISRDKSQSILYLQMNTLRAEDSATYYCTRDRGLRFYFDYWGQGTTLTVSSAKTTPPSVYPLAPGSAAQTNSMVTLGCLVKGYFPEPVTVTWNSGSLSSGVHTFPAVLQSDLYTLSSSVTVPSSPRPSETVTCNVAHPASSTKVDKKIVPRDCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSR

SEQ ID NO: 49 - protein, 213 aa, Artificial Sequence
  Arcitumomab_99tc_LightChain
QTVLSQSPAILSASPGEKVTMTCRASSSVTYIHWYQQKPGSSPKSWIYATSNLASGVPARFSGSGSGTSYSLTISRVEAEDAATYYCQHWSSKPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 50 - protein, 443 aa, Artificial Sequence
  Ascrinvacumab_HeavyChain1
QVQLQESGPGLVKPSQTLSLTCTVSGGSISSGEYYWNWIRQHPGKGLEWIGYIYYSGSTYYNPSLKSRVTISVDTSKNQFSLKLSSVTAADTAVYYCARESVAGFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 51 - protein, 215 aa, Artificial Sequence
  Ascrinvacumab_LightChain1
EIVLTQSPGTLSLSPGERATLSCRASQSVSSSYLAWYQQKPGQAPRLLIYGTSSRATGIPDRFSGSGSGTDFTLTISRLEPEDFAVYYCQQYGSSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 52 - protein, 438 aa, Artificial Sequence
  Aselizuab_HeavyChain1
EVQLVESGGGLVQPGGSLRLSCAASGFTFSTYASWVRQAPGKGLEWVASISTGGSTYYPDSVKGRFTISRDNAKNTLYLQNSLRAEDTAVYYCARDYDGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEETKNQVSLTCLVKGFYPSDIAVEWESNGQPENNYKTTPPVLDSDGSFFLYSRLTVDKSRWQEGNVFSCSVHEALHNHYTQKSLSLSLGK

SEQ ID NO: 53 - protein, 437 aa, Artificial Sequence
  Aselizuab_HeavyChain2
EVQLVESGGGLVQPGGSLRLSCAASGFTFSTYASWVRQAPGKGLEWVASISTGGSTYYPDSVKGRFTISRDNAKNTLYLQNSLRAEDTAVYYCARDYDGYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEETKNQVSLTCLVKGFYPSDIAVEWESNGQPENNYKTTPPVLDSDGSFFLYSRLTVDKSRWQEGNVFSCSVHEALHNHYTQKSLSLSLGK

SEQ ID NO: 54 - protein, 216 aa, Artificial Sequence
  Aselizuab_LightChain1
DIQTQSPSSLSASVGDRVTITCKASQSVDYDGDSYNWYQQKPGKAPKLLIYAASNLESGIPSRFSGSGSGTDFTLTISSLQPEDFATYYCQQSNEDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 55 - protein, 448 aa, Artificial Sequence
  Atezolizumab_HeavyChain1
EVQLVESGGGLVQPGGSLRLSCAASGFTFSDSWIHWVRQAPGKGLEWVAWISPYGGSTYYADSVKGRFTISADTSKNTAYLQMNSLRAEDTAVYYCARRHWPGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 56 - protein, 214 aa, Artificial Sequence
  Atezolizumab_LightChain1
DIQMTQSPSSLSASVGDRVTITCRASQDVSTAVAWYQQKPGKAPKLLIYSASFLYSGVPSRFSGSGSGTDFTLTISSLQPEDFATYYCQQYLYHPATFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 57 - protein, 441 aa, Artificial Sequence
  Atinumab_HeavyChain1
EVQLVESGGGLVQPGGSLRLSCAASGFTFSNYWMSWVRQAPGKGLEWVATIKQDGSQKNYVDSVKGRFTISRDNAKNSLYLRLNSLRAEDTAVYYCATELFDLWGRGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 58 - protein, 214 aa, Artificial Sequence
  Atinumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 59 - protein, 443 aa, Artificial Sequence
  Atlizuab_HeavyChain1
VQLQESGPGLVRPSQTLSLTCTVSGYSITSDHAWSWVRQPPGRGLEWIGYISYSGITTYNPSLKSRVTLRDTSKNQFSLRLSSVTAADTAVYYCARSLARTTADYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVHEALHNHYTQKSLSLSPG

SEQ ID NO: 60 - protein, 213 aa, Artificial Sequence
  Atlizuab_LightChain1
DIQTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 61 - protein, 264 aa, Artificial Sequence
  Aurograb_SingleChain
MAKVQLLQSATEVKKPGASVKVSCKAYGYTFTDYGITWVRQAPGQGLEWMGWISAYNGYTNYAQKFQDRITMTTDASTSTAYMELRSLRPDDTAVLYCARDREDASLLRDGHWGQGTLVTVSSGGGGSGGGGSGGGGSGGGGSETTLTQSPGTLSLSPGERATLSCRASQIVSSSYLAWYQQKPGQAPRLLIYGASSRATGIPDRFSGSGSGTDFTLTISKLEPEDFAVYYCQHYGSSSPWTSRPRDQSDIKRAAALEHHHHHH

SEQ ID NO: 62 - protein, 450 aa, Artificial Sequence
  Avelumab_HeavyChain1
EVQLLESGGGLVQPGGSLRLSCAASGFTFSSYIMMWVRQAPGKGLEWVSSIYPSGGITFYADTVKGRFTISRDNSKNTLYLQMNSLRAEDTAVYYCARIKLGTVTTVDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 63 - protein, 216 aa, Artificial Sequence
  Avelumab_LightChain1
QSALTQPASVSGSPGQSITISCTGTSSDVGGYNYVSWYQQHPGKAPKLMIYDVSNRPSGVSNRFSGSKSGNTASLTISGLQAEDEADYYCSSYTSSSTRVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 64 - protein, 448 aa, Artificial Sequence
  Bapineuzumab_HeavyChain1
EVQLLESGGGLVQPGGSLRLSCAASGFTFSNYGMSWVRQAPGKGLEWVASIRSGGGRTYYSDNVKGRFTISRDNSKNTLYLQMNSLRAEDTAVYYCVRYDHYSGSSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 65 - protein, 219 aa, Artificial Sequence
  Bapineuzumab_LightChain1
DVVMTQSPLSLPVTPGEPASISCKSSQSLLDSDGKTYLNWLLQKPGQSPQRLIYLVSKLDSGVPDRFSGSGSGTDFTLKISRVEAEDVGVYYCWQGTHFPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 66 - protein, 446 aa, Artificial Sequence
  Basiliximab_HeavyChain
QLQQSGTVLARPGASVKMSCKASGYSFTRYWMHWIKQRPGQGLEWIGAIYPGNSDTSYNQKFEGKAKLTAVTSASTAYMELSSLTHEDSAVYYCSRDYGYYFDFWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 67 - protein, 210 aa, Artificial Sequence
  Basiliximab_LightChain
QIVSTQSPAIMSASPGEKVTMTCSASSSRSYMQWYQQKPGTSPKRWIYDTSKLASGVPARFSGSGSGTSYSLTISSMEAEDAATYYCHQRSSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 68 - protein, 450 aa, Artificial Sequence
  Bavituximab_HeavyChain
EVQLQQSGPELEKPGASVKLSCKASGYSFTGYNMNWVKQSHGKSLEWIGHIDPYYGDTSYNQKFRGKATLTVDKSSSTAYMQLKSLTSEDSAVYYCVKGGYYGHWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 69 - protein, 214 aa, Artificial Sequence
  Bavituximab_LightChain
DIQMTQSPSSLSASLGERVSLTCRASQDIGSSLNWLQQGPDGTIKRLIYATSSLDSGVPKRFSGSRSGSDYSLTISSLESEDFVDYYCLQYVSSPPTFGAGTKLELKRADAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 70 - protein, 208 aa, Artificial Sequence
  Bavituximab_LightChain_variant_8734_L
DIQMTQSPSSLSASLGERVSLTCRASQDIGSSLNWLQQGPDGTIKRLIYATSSLDSGVPKRFSGSRSGSDYSLTISSLESEDFVDYYCLQYVSSPPTFGAGTKLELKRADAAPSVFIFPPSDEQLKSGTASVVCLLNNFYPREAKVQWKVDNALQSGNSQESVTEQDSKDSTYSLSKADYEKHKVYACEVTHQGLSSPVTKSFNRGEC

SEQ ID NO: 71 - protein, 456 aa, Artificial Sequence
  Begelomab_HeavyChain1
QVQLQQSGAELVKPGASVKLSCKASGYTFRSYDINWVRQRPEQGLEWIGWIFPGDGSTKYNEKFKGKATLTTDKSSSTAYMQLSRLTSEDSAVYFCARWTVVGPGYFDVWGAGTTVTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 72 - protein, 213 aa, Artificial Sequence; identical to SEQ ID NO: 10
  Begelomab_LightChain1

SEQ ID NO: 73 - protein, 451 aa, Artificial Sequence
  Benralizumab_HeavyChain1
EVQLVQSGAEVKKPGASVKVSCKASGYTFTSYVIHWVRQRPGQGLAWMGYINPYNDGTKYNERFKGKVTITSDRSTSTVYMELSSLRSEDTAVYLCGREGIRYYGLLGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 74 - protein, 214 aa, Artificial Sequence
  Benralizumab_LightChain1
DIQMTQSPSSLSASVGDRVTITCGTSEDIINYLNWYQQKPGKAPKLLIYHTSRLQSGVPSRFSGSGSGTDFTLTISSLQPEDFATYYCQQGYTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 75 - protein, 443 aa, Artificial Sequence
  Betalutin_HeavyChain1
EIQLQQSGPELVKPGASVKVSCKASGYSFTDYNMYWVKQSHGKSLEWIGYIDPYNGDTTYNQKFKGKATLTVDKSSSTAFIHLNSLTSEDSAVYYCARSPYGHYAMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMDTDGSYFVYSKLNVQKSNWEAGNTFTCSVLHEGLHNHHTEKSLSHSPGK

SEQ ID NO: 76 - protein, 214 aa, Artificial Sequence
  Betalutin_LightChain1
DIVMTQSHKLLSTSVGDRVSITCKASQDVSTAVDWYQQKPGQSPKLLINWASTRHTGVPDRFTGSGSGTDYTLTISSMQAEDLALYYCRQHYSTPFTFGSGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 77 - protein, 448 aa, Artificial Sequence
  Bevacituzuab_HeavyChain1
EVQLVESGGGLVQPGGSLRLSCAASGYTFTNYGNWVRQAPGKGLEWVGWINTYTGEPTYAADFKRRFTFSLDTSKSTAYLQNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPGK

SEQ ID NO: 78 - protein, 213 aa, Artificial Sequence
  Bevacituzuab_LightChain1
DIQTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 79 - protein, 213 aa, Artificial Sequence
  Bevacizumab_154-aspartic_acid_LightChain
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNADQSGNSQESVTEQDSKDSTYSLSSTLTLSKADYEKHKVYACEVTHQGLSSPVTKSFNRGE

SEQ ID NO: 80 - protein, 213 aa, Artificial Sequence; identical to SEQ ID NO: 79
  Bevacizumab_154-substitution_deriv_LightChain

SEQ ID NO: 81 - protein, 224 aa, Artificial Sequence
  Bevacizumab_180-serine_HeavyChain
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVSQSSGLYSLSSVVTVPSSSLGTQTYICNVNHKPSNTKVDKKVEPK

SEQ ID NO: 82 - protein, 224 aa, Artificial Sequence; identical to SEQ ID NO: 81
  Bevacizumab_180-substitution_deriv_HeavyCahin

SEQ ID NO: 83 - protein, 453 aa, Artificial Sequence
  Bevacizumab_beta_HeavyChain1
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 84 - protein, 214 aa, Artificial Sequence
  Bevacizumab_beta_LightChain1
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 85 - protein, 229 aa, Artificial Sequence
  Bevacizumab_FcDomain
SCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 86 - protein, 224 aa, Artificial Sequence
  Bevacizumab_HeavyChain
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 87 - protein, 476 aa, Artificial Sequence
  Bevacizumab_HeavyChain_variant1
ASATMGWSCIILFLVATATGVHSEVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 88 - protein, 123 aa, Artificial Sequence [sequence omitted]

SEQ ID NO: 89 - protein, 239 aa, Artificial Sequence
  Bevacizumab_LightChain1
ASKLATMGWSCIILFLVATATGVHSDIQMTQSPSSLSASVGDRVTITCRASQDISSYLNWYQQKPGKAPKLLIYYTSRLHSGVPSRFSGSGSGTDFTFTISSLQPEDIATYYCQQGNTLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 90 - protein, 237 aa, Artificial Sequence
  Bevacizumab_LightChain2
ASATMGWSCIILFLVATATGVHSDIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 91 - protein, 214 aa, Artificial Sequence; identical to SEQ ID NO: 84
  Bevacizumab_LightChain

SEQ ID NO: 92 - protein, 108 aa, Artificial Sequence
  Bevacizumab_LightChain_VJ-Region
DIQMTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKR

SEQ ID NO: 93 - protein, 107 aa, Artificial Sequence [sequence omitted]

SEQ ID NO: 94 - protein, 123 aa, Artificial Sequence [sequence omitted]

SEQ ID NO: 95 - protein, 107 aa, Artificial Sequence [sequence omitted]

SEQ ID NO: 96 - protein, 447 aa, Artificial Sequence
  Bevacizumab_gamma1-Chain
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSYVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFKKLTVDKSRWQQGNVFSCSVMHEALHNHYTQKSLSLSPGK

SEQ ID NO: 97 - protein, 453 aa, Artificial Sequence
  Bevacizumab_gamma1-Chain_CH3-Region_mutein
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 98 - protein, 449 aa, Artificial Sequence; identical to SEQ ID NO: 11
  Bezlotoxumab_HeavyChain1

SEQ ID NO: 99 - protein, 215 aa, Artificial Sequence; identical to SEQ ID NO: 12
  Bezlotoxumab_LightChain1

SEQ ID NO: 100 - protein, 445 aa, Artificial Sequence
  Bimagrumab_HeavyChain1
QVQLVQSGAEVKKPGASVKVSCKASGYTFTSSYINWVRQAPGQGLEWMGTINPVSGSTSYAQKFQGRVTMTRDTSISTAYMELSRLRSDDTAVYYCARGGWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 101 - protein, 444 aa, Artificial Sequence
  Bimagrumab_HeavyChain
QVQLVQSGAEVKKPGASVKVSCKASGYTFTSSYINWVRQAPGQGLEWMGTINPVSGSTSYAQKFQGRVTMTRDTSISTAYMELSRLRSDDTAVYYCARGGWFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 102 - protein, 217 aa, Artificial Sequence
  Bimagrumab_LightChain1
QSALTQPASVSGSPGQSITISCTGTSSDVGSYNYVNWYQQHPGKAPKLMIYGVSKRPSGVSNRFSGSKSGNTASLTISGLQAEDEADYYCGTFAGGSYYGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 103 - protein, 455 aa, Artificial Sequence
  Bimekizumab_HeavyChain1
EVQLVESGGGLVQPGGSLRLSCAASGFTFSDYNMAWVRQAPGKGLEWVATITYEGRNTYYRDSVKGRFTISRDNAKNSLYLQMNSLRAEDTAVYYCASPPQYYEGSIYRLWFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 104 - protein, 214 aa, Artificial Sequence
  Bimekizumab_LightChain1
AIQLTQSPSSLSASVGDRVTITCRADESVRTLMHWYQQKPGKAPKLLIYLVSNSEIGVPDRFSGSGSGTDFRLTISSLQPEDFATYYCQQTWSDPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 105 - protein, 448 aa, Artificial Sequence
  Bleselumab_HeavyChain1
QLQLQESGPGLLKPSETLSLTCTVSGGSISSPGYYGGWIRQPPGKGLEWIGSIYKSGSTYHNPSLKSRVTISVDTSKNQFSLKLSSVTAADTAVYYCTRPVVRYFGWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 106 - protein, 213 aa, Artificial Sequence
  Bleselumab_LightChain1
AIQLTQSPSSLSASVGDRVTITCRASQGISSALAWYQQKPGKAPKLLIYDASNLESGVPSRFSGSGSGTDFTLTISSLQPEDFATYYCQQFNSYPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 107 - protein, 504 aa, Artificial Sequence
  Blinatumomab_HeavyChain1
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELKHHHHHH

SEQ ID NO: 108 - protein, 504 aa, Artificial Sequence; identical to SEQ ID NO: 107
  Blinatumomab_SingleChain

SEQ ID NO: 109 - protein, 504 aa, Artificial Sequence; identical to SEQ ID NO: 107
  Blinatumumab_SingleChain_variable_fragment_fusion_protein_(bite)

SEQ ID NO: 110 - protein, 448 aa, Artificial Sequence
  Blontuvetmab_HeavyChain
QVQLQQSRAELVRPGASVTLSCKPSGYTFTDYEVHWVKQTPVHGLEWIGAIDPETGGTADNQKFKGKAILTADKSSSTAYMELRSLTSEDSAVYYCTNFVDVWGTGTTVTVSSASTTAPSVFPLAPSCGSQSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQKSLSHSPGK

SEQ ID NO: 111 - protein, 219 aa, Artificial Sequence
  Blontuvetmab_LightChain
DVVMSQSPSSLAVSVGEKVTMSCKSSQSLLYSGNQKNYLAWYQQKPGQSPRLLIYWASTRESGVPDRFTGSGSGTDFTLTISSVKAEDLAVFYCQQYYNYPLTFGGGTHLTVLGQPKASPSVTLFPPSSEELGANKATLVCLISDFYPSGVTVAWKADGSPITQGVETTKPSKQSNNKYAASSYLSLTPDKWKSHSSFSCLVTHEGSTVEKKVAPAECS

SEQ ID NO: 112 - protein, 444 aa, Artificial Sequence
  Blosozumab_HeavyChain1
QVQLVQSGAEVKKPGASVKVSCKVSGFPIKDTFQHWVRQAPGKGLEWMGWSDPEIGDTEYASKFQGRVTMTEDTSTDTAYMELSSLRSEDTAVYYCATGDTTYKFDFWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 113 - protein, 214 aa, Artificial Sequence
  Blosozumab_LightChain1
DIQMTQSPSSLSASVGDRVTITCKASQDVHTAVAWYQQKPGKAPKLLIYWASTRWTGVPSRFSGSGSGTDFTLTISSLQPEDFATYYCQQYSDYPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 114 - protein, 444 aa, Artificial Sequence
  Bococizumab_HeavyChain1
QVQLVQSGAEVKKPGASVKVSCKASGYTFTSYYMHWVRQAPGQGLEWMGEISPFGGRTNYNEKFKSRVTMTRDTSTSTVYMELSSLRSEDTAVYYCARERPLYASDLWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 115 - protein, 214 aa, Artificial Sequence
  Bococizumab_LightChain1
DIQMTQSPSSLSASVGDRVTITCRASQGISSALAWYQQKPGKAPKLLIYSASYRYTGVPSRFSGSGSGTDFTFTISSLQPEDIATYYCQQRYSLWRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 116 - protein, 446 aa, Artificial Sequence
  Brentuximab_vedotin_HeavyChain1
QIQLQQSGPEVVKPGASVKISCKASGYTFTDYYITWVKQKPGQGLEWIGWIYPGSGNTKYNEKFKGKATLTVDTSSSTAFMQLSSLTSEDTAVYFCANYGNYWFAYWGQGTQVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 117 - protein, 218 aa, Artificial Sequence
  Brentuximab_vedotin_LightChain1
DIVLTQSPASLAVSLGQRATISCKASQSVDFDGDSYMNWYQQKPGQPPKVLIYAASNLESGIPARFSGSGSGTDFTLNIHPVEEEDAATYYCQQSNEDPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 118 - protein, 445 aa, Artificial Sequence
  Briakinumab_HeavyChain1
QVQLVESGGGVVQPGRSLRLSCAASGFTFSSYGMHWVRQAPGKGLEWVAFIRYDGSNKYYADSVKGRFTISRDNSKNTLYLQMNSLRAEDTAVYYCKTHGSHDNWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 119 - protein, 217 aa, Artificial Sequence
  Briakinumab_LightChain1
QSVLTQPPSVSGAPGQRVTISCSGSRSNIGSNTVKWYQQLPGTAPKLLIYYNDQRPSGVPDRFSGSKSGTSASLAITGLQAEDEADYYCQSYDRYTHPALLFGTGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 120 - protein, 442 aa, Artificial Sequence
  Brodalumab_HeavyChain1
QVQLVQSGAEVKKPGASVKVSCKASGYTFTRYGISWVRQAPGQGLEWMGWISTYSGNTNYAQKLQGRVTMTTDTSTSTAYMELRSLRSDDTAVYYCARRQLYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 121 - protein, 214 aa, Artificial Sequence
  Brodalumab_LightChain1
EIVMTQSPATLSVSPGERATLSCRASQSVSSNLAWFQQKPGQAPRPLIYDASTRATGVPARFSGSGSGTDFTLTISSLQSEDFAVYYCQQYDNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 122 - protein, 252 aa, Artificial Sequence
  Brolucizumab_HeavyChain1
MEIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVLGGGGGSGGGGSGGGGSGGGGSEVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSS

SEQ ID NO: 123 - protein, 252 aa, Artificial Sequence; identical to SEQ ID NO: 122
  Brolucizumab_scFv_fragment

SEQ ID NO: 124 - protein, 447 aa, Artificial Sequence
  Brontictuzumab_HeavyChain1
QVQLVQSGAEVKKPGASVKISCKVSGYTLRGYWIEWVRQAPGKGLEWIGQILPGTGRTNYNEKFKGRVTMTADTSTDTAYMELSSLRSEDTAVYYCARFDGNYGYYAMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 125 - protein, 215 aa, Artificial Sequence
  Brontictuzumab_LightChain1
QAVVTQEPSLTVSPGGTVTLTCRSSTGAVTTSNYANWFQQKPGQAPRTLIGGTNNRAPGVPARFSGSLLGGKAALTLSGAQPEDEAEYYCALWYSNHWVFGGGTKLTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 126 - protein, 444 aa, Artificial Sequence
  BTT-1023_HeavyChain1
QVQLVESGGGVVQPGRSLRLSCAASGFTFFSYAMHWVRQTPGKGLEWVAVIWFDGSNENYVDSVKGRFTISRDNSKNTLYLQMNTLRAEDTAVYYCARDAWSYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 127 - protein, 214 aa, Artificial Sequence
  BTT-1023_LightChain1
VIQLTQSPSSLSASVGDRVTITCRASQGISRALAWYQQKPGKGPKLLIYDASSLESGVPSRFSGSGSGTDFTLTISSLQPEDFATYYCQQFNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 128 - protein, 447 aa, Artificial Sequence
  Burosumab_HeavyChain1
QVQLVQSGAEVKKPGASVKVSCKASGYTFTNHYMHWVRQAPGQGLEWMGIINPISGSTSNAQKFQGRVTMTRDTSTSTVYMELSSLRSEDTAVYYCARDIVDAFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 129 - protein, 213 aa, Artificial Sequence
  Burosumab_LightChain1
AIQLTQSPSSLSASVGDRVTITCRASQGISSALVWYQQKPGKAPKLLIYDASSLESGVPSRFSGSGSGTDFTLTISSLQPEDFATYYCQQFNDYFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 130 - protein, 448 aa, Artificial Sequence
  Canakinumab_HeavyChain1
QVQLVESGGGVVQPGRSLRLSCAASGFTFSVYGMNWVRQAPGKGLEWVAIIWYDGDNQYYADSVKGRFTISRDNSKNTLYLQMNGLRAEDTAVYYCARDLRTGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 131 - protein, 448 aa, Artificial Sequence; identical to SEQ ID NO: 130
  Canakinumab_HeavyChain

SEQ ID NO: 132 - protein, 214 aa, Artificial Sequence
  Canakinumab_LightChain1
EIVLTQSPDFQSVTPKEKVTITCRASQSIGSSLHWYQQKPDQSPKLLIKYASQSFSGVPSRFSGSGSGTDFTLTINSLEAEDAAAYYCHQSSSLPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 133 - protein, 214 aa, Artificial Sequence; identical to SEQ ID NO: 132
  Canakinumab_LightChain

SEQ ID NO: 134 - protein, 394 aa, Artificial Sequence [sequence omitted]

SEQ ID NO: 135 - protein, 399 aa, Artificial Sequence
  Cantuzumab_HeavyChain1
IDTTTGEPTYAQKFQGRIAFSLETSASTAYLQIKSLKSEDTATYFCARRGPYNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 136 - protein, 449 aa, Artificial Sequence
  Cantuzumab_HeavyChain
QVQLVQSGAEVKKPGETVKISCKASDYTFTYYGMNWVKQAPGQGLKWMGWIDTTTGEPTYAQKFQGRIAFSLETSASTAYLQIKSLKSEDTATYFCARRGPYNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 137 - protein, 219 aa, Artificial Sequence
  Cantuzumab_LightChain1
DIVMTQSPLSVPVTPGEPVSISCRSSKSLLHSNGNTYLYWFLQRPGQSPQLLIYRMSNLVSGVPDRFSGSGSGTAFTLRISRVEAEDVGVYYCLQHLEYPFTFGPGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 138 - protein, 448 aa, Artificial Sequence
  Cantuzumab_mertansine_HeavyChain1
VQLVQSGAEVKKPGETVKISCKASDYTFTYYGMNWVKQAPGQGLKWMGWIDTTTGEPTYAQKFQGRIAFSLETSASTAYLQIKSLKSEDTATYFCARRGPYNWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 139 - protein, 219 aa, Artificial Sequence; identical to SEQ ID NO: 137
  Cantuzumab_mertansine_LightChain1

SEQ ID NO: 140 - protein, 449 aa, Artificial Sequence; identical to SEQ ID NO: 136
  Cantuzumab_ravtansine_HeavyChain1

SEQ ID NO: 141 - protein, 219 aa, Artificial Sequence; identical to SEQ ID NO: 137
  Cantuzumab_ravtansine_LightChain1

SEQ ID NO: 142 - protein, 259 aa, Artificial Sequence
  Caplacizumab
EVQLVESGGGLVQPGGSLRLSCAASGRTFSYNPMGWFRQAPGKGRELVAAISRTGGSTYYPDSVEGRFTISRDNAKRMVYLQMNSLRAEDTAVYYCAAAGVRAEDGRVRTLPSEYTFWGQGTQVTVSSAAAEVQLVESGGGLVQPGGSLRLSCAASGRTFSYNPMGWFRQAPGKGRELVAAISRTGGSTYYPDSVEGRFTISRDNAKRMVYLQMNSLRAEDTAVYYCAAAGVRAEDGRVRTLPSEYTFWGQGTQVTVSS

SEQ ID NO: 143 - protein, 259 aa, Artificial Sequence; identical to SEQ ID NO: 142
  Caplacizumab_HeavyChain1

SEQ ID NO: 144 - protein, 259 aa, Artificial Sequence; identical to SEQ ID NO: 142
  Caplacizumab_HeavyChain1

SEQ ID NO: 145 - protein, 449 aa, Artificial Sequence
  Carlumab_HeavyChain1
QVQLVQSGAEVKKPGSSVKVSCKASGGTFSSYGISWVRQAPGQGLEWMGGIIPIFGTANYAQKFQGRVTITADESTSTAYMELSSLRSEDTAVYYCARYDGIYGELDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 146 - protein, 216 aa, Artificial Sequence
  Carlumab_LightChain1
EIVLTQSPATLSLSPGERATLSCRASQSVSDAYLAWYQQKPGQAPRLLIYDASSRATGVPARFSGSGSGTDFTLTISSLEPEDFAVYYCHQYIQLHSFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 147 - protein, 451 aa, Artificial Sequence
  Cergutuzumab_amunaleukin_HeavyChain1
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 148 - protein, 598 aa, Artificial Sequence
  Cergutuzumab_amunaleukin_HeavyChain2
QVQLVQSGAEVKKPGASVKVSCKASGYTFTEFGMNWVRQAPGQGLEWMGWINTKTGEATYVEEFKGRVTFTTDTSTSTAYMELRSLRSDDTAVYYCARWDFAYYVEAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALGAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGGGGGSGGGGSGGGGSAPASSSTKKTQLQLEHLLLDLQMILNGINNYKNPKLTRMLTAKFAMPKKATELKHLQCLEEELKPLEEVLNGAQSKNFHLRPRDLISNINVIVLELKGSETTFMCEYADETATIVEFLNRWITFAQSIISTLT

SEQ ID NO: 149 - protein, 215 aa, Artificial Sequence
  Cergutuzumab_amunaleukin_LightChain1
DIQMTQSPSSLSASVGDRVTITCKASAAVGTYVAWYQQKPGKAPKLLIYSASYRKRGVPSRFSGSGSGTDFTLTISSLQPEDFATYYCHQYYTYPLFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 150 - protein, 229 aa, Artificial Sequence
  Certolizumab_pegol_HeavyChain1
EVQLVESGGGLVQPGGSLRLSCAASGYVFTDYGMNWVRQAPGKGLEWMGWINTYIGEPIYADSVKGRFTFSLDTSKSTAYLQMNSLRAEDTAVYYCARGYRSYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAA

SEQ ID NO: 151 - protein, 229 aa, Artificial Sequence; identical to SEQ ID NO: 150
  Certolizumab_pegol_HeavyChain

SEQ ID NO: 152 - protein, 214 aa, Artificial Sequence
  Certolizumab_pegol_LightChain1
DIQMTQSPSSLSASVGDRVTITCKASQNVGTNVAWYQQKPGKAPKALIYSASFLYSGVPYRFSGSGSGTDFTLTISSLQPEDFATYYCQQYNIYPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 153 - protein, 214 aa, Artificial Sequence; identical to SEQ ID NO: 152
  Certolizumab_pegol_LightChain

SEQ ID NO: 154 - protein, 452 aa, Artificial Sequence
  Cetuximab_HeavyChain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 155 - protein, 449 aa, Artificial Sequence
  Cetuximab_HeavyChain_variant
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 156 - protein, 213 aa, Artificial Sequence
  Cetuximab_LightChain
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGA

SEQ ID NO: 157 - protein, 214 aa, Artificial Sequence
  Cetuximab_LightChain_variant
DILLTQSPVILSVSPGERVSFSCRASQSIGTNIHWYQQRTNGSPRLLIKYASESISGIPSRFSGSGSGTDFTLSINSVESEDIADYYCQQNNNWPTTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 158 - protein, 225 aa, Artificial Sequence
  Citatuzumab_bogatox_HeavyChain1
HHHHHHEVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 159 - protein, 481 aa, Artificial Sequence
  Citatuzumab_bogatox_LightChain1
DIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECTRHRQPRGWEQLYNTVSFNLGEAYEYPTFIQDLRNELAKGTPVCQLPVTLQTIADDKRFVLVDITTTSKKTVKVAIDVTDVYVVGYQDKWDGKDRAVFLDKVPTVATSKLFPGVTNRVTLTFDGSYQKLVNAAKADRKALELGVNKLEFSIEAIHGKTINGQEAAKFFLIVIQMVSEAARFKYIETEVVDRGLYGSFKPNFKVLNLENNWGDISDAIHKSSPQCTTINPALQLISPSNDPWVVNKVSQISPDMGILKFKSSK

SEQ ID NO: 160 - protein, 460 aa, Artificial Sequence
  Cixutumumab_HeavyChain1
EVQLVQSGAEVKKPGSSVKVSCKASGGTFSSYAISWVRQAPGQGLEWMGGIIPIFGTANYAQKFQGRVTITADKSTSTAYMELSSLRSEDTAVYYCARAPLRFLEWSTQDHYYYYYMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 161 - protein, 214 aa, Artificial Sequence
  Cixutumumab_LightChain1
SSELTQDPAVSVALGQTVRITCQGDSLRSYYATWYQQKPGQAPILVIYGENKRPSGIPDRFSGSSSGNTASLTITGAQAEDEADYYCKSRDGSGQHLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPAECS

SEQ ID NO: 162 - protein, 450 aa, Artificial Sequence
  Clazakizumab_HeavyChain1
EVQLVESGGGLVQPGGSLRLSCAASGFSLSNYYVTWVRQAPGKGLEWVGIIYGSDETAYATSAIGRFTISRDNSKNTLYLQMNSLRAEDTAVYYCARDDSSDWDAKFNLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 163 - protein, 217 aa, Artificial Sequence
  Clazakizumab_LightChain1
AIQMTQSPSSLSASVGDRVTITCQASQSINNELSWYQQKPGKAPKLLIYRASTLASGVPSRFSGSGSGTDFTLTISSLQPDDFATYYCQQGYSLRNIDNAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 164 - protein, 449 aa, Artificial Sequence
  Clivatuzumab_tetraxetan_HeavyChain1
QVQLQQSGAEVKKPGASVKVSCEASGYTFPSYVLHWVKQAPGQGLEWIGYINPYNDGTQYNEKFKGKATLTRDTSINTAYMELSRLRSDDTAVYYCARGFGGSYGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 165 - protein, 215 aa, Artificial Sequence
  Clivatuzumab_tetraxetan_LightChain1
DIQLTQSPSSLSASVGDRVTMTCSASSSVSSSYLYWYQQKPGKAPKLWIYSTSNLASGVPARFSGSGSGTDFTLTISSLQPEDSASYFCHQWNRYPYTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 166 - protein, 445 aa, Artificial Sequence
  Codrituzumab_HeavyChain1
QVQLVQSGAEVKKPGASVKVSCKASGYTFTDYEMHWVRQAPGQGLEWMGALDPKTGDTAYSQKFKGRVTLTADKSTSTAYMELSSLTSEDTAVYYCTRFYSYTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 167 - protein, 219 aa, Artificial Sequence
  Codrituzumab_LightChain1
DVVMTQSPLSLPVTPGEPASISCRSSQSLVHSNRNTYLHWYLQKPGQSPQLLIYKVSNRFSGVPDRFSGSGSGTDFTLKISRVEAEDVGVYYCSQNTHVPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 168 - protein, 450 aa, Artificial Sequence
  Coltuximab_ravtansine_HeavyChain1
QVQLVQPGAEVVKPGASVKLSCKTSGYTFTSNWMHWVKQAPGQGLEWIGEIDPSDSYTNYNQNFQGKAKLTVDKSTSTAYMEVSSLRSDDTAVYYCARGSNPYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 169 - protein, 211 aa, Artificial Sequence
  Coltuximab_ravtansine_LightChain1
EIVLTQSPAIMSASPGERVTMTCSASSGVNYMHWYQQKPGTSPRRWIYDTSKLASGVPARFSGSGSGTDYSLTISSMEPEDAATYYCHQRGSYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 170 - protein, 452 aa, Artificial Sequence
  Conatumumab_CV_HeavyChain
QVQLQESGPGLVKPSQTLSLTCTVSGGSISSGDYFWSWIRQLPGKGLEWIGHIHNSGTTYYNPSLKSRVTISVDTSKKQFSLRLSSVTAADTAVYYCARDRGGDYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 171 - protein, 215 aa, Artificial Sequence
  Conatumumab_CV_LightChain
EIVLTQSPGTLSLSPGERATLSCRASQGISRSYLAWYQQKPGQAPSLLIYGASSRATGIPDRFSGSGSGTDFTLTISRLEPEDFAVYYCQQFGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 172 - protein, 452 aa, Artificial Sequence; identical to SEQ ID NO: 170
  Conatumumab_HeavyChain1

SEQ ID NO: 173 - protein, 452 aa, Artificial Sequence; identical to SEQ ID NO: 170
  Conatumumab_HeavyChain

SEQ ID NO: 174 - protein, 215 aa, Artificial Sequence; identical to SEQ ID NO: 171
  Conatumumab_LightChain1

SEQ ID NO: 175 - protein, 215 aa, Artificial Sequence; identical to SEQ ID NO: 171
  Conatumumab_LightChain

SEQ ID NO: 176 - protein, 448 aa, Artificial Sequence
  Concizumab_HeavyChain1
EVQLVESGGGLVKPGGSLRLSCAASGFTFSNYAMSWVRQTPEKRLEWVATISRSGSYSYFPDSVQGRFTISRDNAKNSLYLQMNSLRAEDTAVYYCARLGGYDEGDAMDSWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 177 - protein, 219 aa, Artificial Sequence
  Concizumab_LightChain1
DIVMTQTPLSLSVTPGQPASISCKSSQSLLESDGKTYLNWYLQKPGQSPQLLIYLVSILDSGVPDRFSGSGSGTDFTLKISRVEAEDVGVYYCLQATHFPQTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 178 - protein, 438 aa, Artificial Sequence
  Crenezumab_HeavyChain1
EVQLVESGGGLVQPGGSLRLSCAASGFTFSSYGMSWVRQAPGKGLELVASINSNGGSTYYPDSVKGRFTISRDNAKNSLYLQMNSLRAEDTAVYYCASGDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 179 - protein, 219 aa, Artificial Sequence
  Crenezumab_LightChain1
DIVMTQSPLSLPVTPGEPASISCRSSQSLVYSNGDTYLHWYLQKPGQSPQLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 180 - protein, 455 aa, Artificial Sequence
  Crotedumab_HeavyChain1
EVQLVESGGGLVQPGGSLRLSCAASGFTFSNYLMNWVRQAPGKGLEWLANIQEDGIEKYYVDSVKGRFTISRDNAKNSLYLQMNSLRAEDTAVYYCAREPSHYDILTGYDYYYGMDVWGQGTTVTVSSASTKGPSVFPLAPCSRSTSESTAALGCLVKDYFPEPVTVSNNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 181 - protein, 455 aa, Artificial Sequence
  Crotedumab_HeavyChain2
EVQLVESGGGLVQPGGSLHLSCAASGFTFSNYLMNWVRQAPGKGLEWLANIQEDGIEKYYVDSVKGRFTISRDNAKNSLYLQMNSLRAEDTAVYYCAREPSHYDILTGYDYYYGMDVWGQGTTVTVSSASTKGPSVFPLAPCSRSTSESTAALGCLVKDYFPEPVTVSNNSGALTSGVHTFPAVLQSSGLYSLSSVVTVPSSSLGTKTYTCNVDHKPSNTEVDERVESKYGPPCPPCPAPEFLGGPSVFLFPPKPKDTLMISRTPEVTCVVVDVSQEDPEVQFNWYVDGVEVHNAKTKPREEQFWSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDESRWQEHNVFSCSVMHEALHNHYTQKSLSLSLGK

SEQ ID NO: 182 - protein, 214 aa, Artificial Sequence
  Crotedumab_LightChain1
DIQMTQSPSSLSASVGDRVTITCRASQGIRNDLGWYQQKPGKAPKRLIYAASSLQSGVPSRFSGSGSGTEFILTVSSLQPEDFATYYCLQYNENPFTFGPGTKVDIKRTVAAPSVFIFPPSDEQLKSGTASVVCLLNNFYPREAKVQWKVDNALQSGNSQESVTEQDSKDSTYSLSSTLTLSKADYEEHKVYACEVTHQGLSSPVTKSFNRGEC

SEQ ID NO: 183 - protein, 214 aa, Artificial Sequence
  Crotedumab_LightChain2
DIQMTQSPSSLSASVGDRVTITCRASQGIRNDLGWYQQKPGKAPKRLIYAASSLQSGVPSRFSGSGSGTEFILTVSSLQPEDFATYYCLQYNSNPFTFGPGTKVDIKRTVAAPSVFIFPPSDEQLKSGTASVVCLLNNFYPREAKVQNKVDNALQSGNSQESVTEQDSKDSTYSLSSTLTLSEADYEKHKVYACEVTHQGLSSPVTKSFNRGEC

SEQ ID NO: 184 - protein, 444 aa, Artificial Sequence
  Dacetuzumab_HeavyChain1
EVQLVESGGGLVQPGGSLRLSCAASGYSFTGYYIHWVRQAPGKGLEWVARVIPNAGGTSYNQKFKGRFTLSVDNSKNTAYLQMNSLRAEDTAVYYCAREGIYWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 185 - protein, 219 aa, Artificial Sequence
  Dacetuzumab_LightChain1
DIQMTQSPSSLSASVGDRVTITCRSSQSLVHSNGNTFLHWYQQKPGKAPKLLIYTVSNRFSGVPSRFSGSGSGTDFTLTISSLQPEDFATYFCSQTTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 186 - protein, 106 aa, Artificial Sequence
  Dacliximab_LightChain_VJ-Region
DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGQGTKVEVK

SEQ ID NO: 187 - protein, 116 aa, Artificial Sequence
  Dacliximab_gamma2-Chain_VDJ-Region
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTLVTVSS

SEQ ID NO: 188 - protein, 442 aa, Artificial Sequence
  Daclizumab_HeavyChain
QVQLVQSGAEVKKPGSSVKVSCKASGYTFTSYRMHWVRQAPGQGLEWIGYINPSTGYTEYNQKFKDKATITADESTNTAYMELSSLRSEDTAVYYCARGGGVFDYWGQGTTLTVSSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 189 - protein, 210 aa, Artificial Sequence
  Daclizumab_LightChain
DIQMTQSPSTLSASVGDRVTITCSASSSISYMHWYQQKPGKAPKLLIYTTSNLASGVPARFSGSGSGTEFTLTISSLQPDDFATYYCHQRSTYPLTFGSGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 190 - protein, 447 aa, Artificial Sequence
  Dalotuzumab_HeavyChain1
QVQLQQSGPGLVKPSQTLSLTCTVSGWSISGGWLWNWIRQPPGKGLQWIGWISWDGTNNWKPSLKDRVTISVDTSKNQFSLKLSSVTAADTAVWWCARWGRVFFDWWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 191 - protein, 219 aa, Artificial Sequence
  Dalotuzumab_LightChain1
DIVMTQSPLSLPVTPGQPASISCRSSQSIVHSNGNTWLQWWLQKPGQSPQLLIWKVSNRLWGVPDRFSGSGSGTDFTLKISRVQAQDVGVWWCFQGSHVPWTFGQGTKVQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 192 - protein, 229 aa, Artificial Sequence
  Dapirolizumab_pegol_HeavyChain1
EVQLVESGGGLVQPGGSLRLSCAVSGFSSTNYHVHWVRQAPGKGLEWMGVIWGDGDTSYNSVLKSRFTISRDTSKNTVYLQMNSLRAEDTAVYYCARQLTHYYVLAAWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCAA

SEQ ID NO: 193 - protein, 214 aa, Artificial Sequence
  Dapirolizumab_pegol_LightChain1
DIQMTQSPSSLSASVGDRVTITCRASEDLYYNLAWYQRKPGKAPKLLIYDTYRLADGVPSRFSGSGSGTDYTLTISSLQPEDFASYYCQQYYKFPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 194 - protein, 452 aa, Artificial Sequence
  Daratumumab_HeavyChain1
EVQLLESGGGLVQPGGSLRLSCAVSGFTFNSFAMSWVRQAPGKGLEWVSAISGSGGGTYYADSVKGRFTISRDNSKNTLYLQMNSLRAEDTAVYFCAKDKILWFGEPVFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 195 - protein, 214 aa, Artificial Sequence
  Daratumumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQRSNWPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 196 - protein, 450 aa, Artificial Sequence
  Dectrekumab_HeavyChain1
EVQLVESGGGVVQPGRSLRLSCAASGFTFSSYGMHWVRQAPGKGLEWVAIIWYDGSNKYYADSVKGRFTISRDNSKNTLYLQMNSLRAEDTAVYYCARLWFGDLDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 197 - protein, 216 aa, Artificial Sequence
  Dectrekumab_LightChain1
EIVLTQSPATLSLSPGERAILSCRAGQSVSSYLVWYQQKPGQAPRLLIYDASNRATGIPARFSGSGSGTDFTLTISSLEPEDFAVYYCQQRSSWPPVYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 198 - protein, 444 aa, Artificial Sequence
  Demcizumab_HeavyChain1
QVQLVQSGAEVKKPGASVKISCKASGYSFTAYYIHWVKQAPGQGLEWIGYISSYNGATNYNQKFKGRVTFTTDTSTSTAYMELRSLRSDDTAVYYCARDYDYDVGMDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 199 - protein, 218 aa, Artificial Sequence
  Demcizumab_LightChain1
DIVMTQSPDSLAVSLGERATISCRASESVDNYGISFMKWFQQKPGQPPKLLIYAASNQGSGVPDRFSGSGSGTDFTLTISSLQAEDVAVYYCQQSKEVPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 200 - protein, 450 aa, Artificial Sequence
  Denintuzumab_mafodotin_HeavyChain1
QVQLQESGPGLVKPSQTLSLTCTVSGGSISTSGMGVGWIRQHPGKGLEWIGHIWWDDDKRYNPALKSRVTISVDTSKNQFSLKLSSVTAADTAVYYCARMELWSYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 201 - protein, 213 aa, Artificial Sequence
  Denintuzumab_mafodotin_LightChain1
EIVLTQSPATLSLSPGERATLSCSASSSVSYMHWYQQKPGQAPRLLIYDTSKLASGIPARFSGSGSGTDFTLTISSLEPEDVAVYYCFQGSVYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 202 - protein, 452 aa, Artificial Sequence
  Denosumab_HeavyChain
EVQLLESGGGLVQPGGSLRLSCAASGFTFSSYAMSWVRQAPGKGLEWVSGITGSGGSTYYADSVKGRFTISRDNSKNTLYLQMNSLRAEDTAVYYCAKDPGTTVIMSWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 203 - protein, 215 aa, Artificial Sequence
  Denosumab_LightChain
EIVLTQSPGTLSLSPGERATLSCRASQSVRGRYLAWYQQKPGQAPRLLIYGASSRATGIPDRFSGSGSGTDFTLTISRLEPEDFAVFYCQQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 204 - protein, 446 aa, Artificial Sequence
  Depatuxizumab_HeavyChain1
QVQLQESGPGLVKPSQTLSLTCTVSGYSISSDFAWNWIRQPPGKGLEWMGYISYSGNTRYQPSLKSRITISRDTSKNQFFLKLNSVTAADTATYYCVTAGRGFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 205 - protein, 214 aa, Artificial Sequence
  Depatuxizumab_LightChain1
DIQMTQSPSSMSVSVGDRVTITCHSSQDINSNIGWLQQKPGKSFKGLIYHGTNLDDGVPSRFSGSGSGTDYTLTISSLQPEDFATYYCVQYAQFPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 206 - protein, 446 aa, Artificial Sequence; identical to SEQ ID NO: 204
  Depatuxizumab_mafodotin_HeavyChain1

SEQ ID NO: 207 - protein, 214 aa, Artificial Sequence; identical to SEQ ID NO: 205
  Depatuxizumab_mafodotin_LightChain1

SEQ ID NO: 208 - protein, 443 aa, Artificial Sequence
  Dinutuximab_beta_HeavyChain1
EVQLLQSGPELEKPGASVMISCKASGSSFTGYNMNWVRQNIGKSLEWIGAIDPYYGGTSYNQKFKGRATLTVDKSSSTAYMHLKSLTSEDSAVYYCVSGMEYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 209 - protein, 220 aa, Artificial Sequence
  Dinutuximab_beta_LightChain1
EIVMTQSPATLSVSPGERATLSCRSSQSLVHRNGNTYLHWYLQKPGQSPKLLIHKVSNRFSGVPDRFSGSGSGTDFTLKISRVEAEDLGVYFCSQSTHVPPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 210 - protein, 443 aa, Artificial Sequence; identical to SEQ ID NO: 208
  Dinutuximab_HeavyChain1

SEQ ID NO: 211 - protein, 220 aa, Artificial Sequence; identical to SEQ ID NO: 209
  Dinutuximab_LightChain1

SEQ ID NO: 212 - protein, 220 aa, Artificial Sequence; identical to SEQ ID NO: 209
  Dinutuximab_LightChain

SEQ ID NO: 213 - protein, 450 aa, Artificial Sequence
  Diridavumab_HeavyChain1
EVQLVESGAEVKKPGSSVKVSCKASGGPFRSYAISWVRQAPGQGPEWMGGIIPIFGTTKYAPKFQGRVTITADDFAGTVYMELSSLRSEDTAMYYCAKHMGYQVRETMDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 214 - protein, 217 aa, Artificial Sequence
  Diridavumab_LightChain1
QSVLTQPPSVSAAPGQKVTISCSGSSSNIGNDYVSWYQQLPGTAPKLLIYDNNKRPSGIPDRFSGSKSGTSATLGITGLQTGDEANYYCATWDRRPTAYVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 215 - protein, 446 aa, Artificial Sequence
  Domagrozumab_HeavyChain1
EVQLLESGGGLVQPGGSLRLSCAASGFTFSSYAMSWVRQAPGKGLEWVSTISSGGSYTSYPDSVKGRFTISRDNSKNTLYLQMNSLRAEDTAVYYCAKQDYAMNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 216 - protein, 445 aa, Artificial Sequence
  Domagrozumab_HeavyChain
EVQLLESGGGLVQPGGSLRLSCAASGFTFSSYAMSWVRQAPGKGLEWVSTISSGGSYTSYPDSVKGRFTISRDNSKNTLYLQMNSLRAEDTAVYYCAKQDYAMNYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 217 - protein, 214 aa, Artificial Sequence
  Domagrozumab_LightChain1
DIQMTQSPSSLSASVGDRVTITCKASQDVSTAVAWYQQKPGKAPKLLIYSASYRYTGVPSRFSGSGSGTDFTLTISSLQPEDFATYYCQQHYSTPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 218 - protein, 445 aa, Artificial Sequence
  Drozituab_HeavyChain1
EVQLVQSGGGVERPGGSLRLSCAASGFTFDDYASWVRQAPGKGLEWVSGINWQGGSTGYADSVKGRVTISRDNAKNSLYLQNSLRAEDTAVYYCAKILGAGRGWYFDYWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPG

SEQ ID NO: 219 - protein, 213 aa, Artificial Sequence
  Drozituab_LightChain1
SELTQDPAVSVALGQTVRITCSGDSLRSYYASWYQQKPGQAPVLVIYGANNRPSGIPDRFSGSSSGNTASLTITGAQAEDEADYYCNSADSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 220 - protein, 451 aa, Artificial Sequence
  Drozitumab_HeavyChain1
EVQLVQSGGGVERPGGSLRLSCAASGFTFDDYAMSWVRQAPGKGLEWVSGINWQGGSTGYADSVKGRVTISRDNAKNSLYLQMNSLRAEDTAVYYCAKILGAGRGWYFDYWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 221 - protein, 213 aa, Artificial Sequence; identical to SEQ ID NO: 219
  Drozitumab_LightChain1

SEQ ID NO: 222 - protein, 451 aa, Artificial Sequence
  Duligotumab_HeavyChain1
EVQLVESGGGLVQPGGSLRLSCAASGFTLSGDWIHWVRQAPGKGLEWVGEISAAGGYTDYADSVKGRFTISADTSKNTAYLQMNSLRAEDTAVYYCARESRVSFEAAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 223 - protein, 214 aa, Artificial Sequence
  Duligotumab_LightChain1
DIQMTQSPSSLSASVGDRVTITCRASQNIATDVAWYQQKPGKAPKLLIYSASFLYSGVPSRFSGSGSGTDFTLTISSLQPEDFATYYCQQSEPEPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 224 - protein, 451 aa, Artificial Sequence; identical to SEQ ID NO: 222
  Duligotuzumab_HeavyChain1

SEQ ID NO: 225 - protein, 214 aa, Artificial Sequence; identical to SEQ ID NO: 223
  Duligotuzumab_LightChain1

SEQ ID NO: 226 - protein, 451 aa, Artificial Sequence
  Dupilumab_HeavyChain1
EVQLVESGGGLEQPGGSLRLSCAGSGFTFRDYAMTWVRQAPGKGLEWVSSISGSGGNTYYADSVKGRFTISRDNSKNTLYLQMNSLRAEDTAVYYCAKDRLSITIRPRYYGLDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 227 - protein, 219 aa, Artificial Sequence
  Dupilumab_LightChain1
DIVMTQSPLSLPVTPGEPASISCRSSQSLLYSIGYNYLDWYLQKSGQSPQLLIYLGSNRASGVPDRFSGSGSGTDFTLKISRVEAEDVGFYYCMQALQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 228 - protein, 451 aa, Artificial Sequence
  Durvalumab_HeavyChain1
EVQLVESGGGLVQPGGSLRLSCAASGFTFSRYWMSWVRQAPGKGLEWVANIKQDGSEKYYVDSVKGRFTISRDNAKNSLYLQMNSLRAEDTAVYYCAREGGWFGELAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 229 - protein, 215 aa, Artificial Sequence
  Durvalumab_LightChain1
EIVLTQSPGTLSLSPGERATLSCRASQRVSSSYLAWYQQKPGQAPRLLIYDASSRATGIPDRFSGSGSGTDFTLTISRLEPEDFAVYYCQQYGSLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 230 - protein, 446 aa, Artificial Sequence
  Dusigitumab_HeavyChain1
QVQLVQSGAEVKKPGASVKVSCKASGYTFTSYDINWVRQATGQGLEWMGWMNPNSGNTGYAQKFQGRVTMTRNTSISTAYMELSSLRSEDTAVYYCARDPYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 231 - protein, 217 aa, Artificial Sequence
  Dusigitumab_LightChain1
QSVLTQPPSVSAAPGQKVTISCSGSSSNIENNHVSWYQQLPGTAPKLLIYDNNKRPSGIPDRFSGSKSGTSATLGITGLQTGDEADYYCETWDTSLSAGRVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 232 - protein, 449 aa, Artificial Sequence
  Ecromeximab_HeavyChain1
EVTLVESGGDFVKPGGSLKVSCAASGFAFSHYAMSWVRQTPAKRLEWVAYISSGGSGTYYSDSVKGRFTISRDNAKNTLYLQMRSLRSEDSAMYFCTRVKLGTYYFDSWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 233 - protein, 214 aa, Artificial Sequence
  Ecromeximab_LightChain1
DIQMTQTASSLPASLGDRVTISCSASQDISNYLNWYQQKPDGTVKLLIFYSSNLHSGVPSRFSGGGSGTDYSLTISNLEPEDIATYFCHQYSKLPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 234 - protein, 447 aa, Artificial Sequence
  Eculizumab_HeavyChain1
VQLVQSGAEVKKPGASVKVSCKASGYIFSNYWIQWVRQAPGQGLEWMGEILPGSGSTEYTENFKDRVTMTRDTSTSTVYMELSSLRSEDTAVYYCARYFFGSSPNWYFDVWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 235 - protein, 214 aa, Artificial Sequence [sequence omitted]

SEQ ID NO: 236 - protein, 125 aa, Artificial Sequence
  Efalizumab_HeavyChain
EVQLVESGGGLVQPGGSLRLSCAASGYSFTGHWMNWVRQAPGKGLEWVGIMIHPSDSETRYNQKFKDIRFTISVDKSKNTLYLQMNSLRAEDTAVYYCARIGIYFYGTTYFDYIWGQGTLVTVSS

SEQ ID NO: 237 - protein, 108 aa, Artificial Sequence
  Efalizumab_LightChain
DIQMTQSPSSLSASVGDRVTITCRASKTISKYLAWYQQKPGKAPKLLIYSGSTLQSGVPSRFSGSGSGTDFTLTISSLQPEDFATYYCQQHNEYPLTFGQGTKVEIKR

SEQ ID NO: 238 - protein, 256 aa, Artificial Sequence
  Efungumab_SingleChain_variable_fragment
MAEVQLVESGAEVKKPGESLRISCKGSGCIISSYWISWVRQMPGKGLEWMGKIDPGDSYINYSPSFQGHVTISADKSINTAYLQWNSLKASDTAMYYCARGGRDFGDSFDYWGQGTLVTVSSGGGGSGGGGSGGGGSDVVMTQSPSFLSAFVGDRITITCRASSGISRYLAWYQQAPGKAPKLLIYAASTLQTGVPSRFSGSGSGTEFTLTINSLQPEDFATYYCQHLNSYPLTFGGGTKVDIKRAAALEHHHHHH

SEQ ID NO: 239 - protein, 454 aa, Artificial Sequence
  Eldelumab_HeavyChain1
QMQLVESGGGVVQPGRSLRLSCTASGFTFSNNGMHWVRQAPGKGLEWVAVIWFDGMNKFYVDSVKGRFTISRDNSKNTLYLEMNSLRAEDTAIYYCAREGDGSGIYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 240 - protein, 216 aa, Artificial Sequence
  Eldelumab_LightChain1
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPIFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 241 - protein, 447 aa, Artificial Sequence
  Elgemtumab_HeavyChain1
EVQLLESGGGLVQPGGSLRLSCAASGFTFSSYAMSWVRQAPGKGLEWVSAINSQGKSTYYADSVKGRFTISRDNSKNTLYLQMNSLRAEDTAVYYCARWGDEGFDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 242 - protein, 214 aa, Artificial Sequence
  Elgemtumab_LightChain1
DIQMTQSPSSLSASVGDRVTITCRASQGISNWLAWYQQKPGKAPKLLIYGASSLQSGVPSRFSGSGSGTDFTLTISSLQPEDFATYYCQQYSSFPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 243 - protein, 449 aa, Artificial Sequence
  Elotuzumab_HeavyChain1
EVQLVESGGGLVQPGGSLRLSCAASGFDFSRYWMSWVRQAPGKGLEWIGEINPDSSTINYAPSLKDKFIISRDNAKNSLYLQMNSLRAEDTAVYYCARPDGNYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 244 - protein, 214 aa, Artificial Sequence
  Elotuzumab_LightChain1
DIQMTQSPSSLSASVGDRVTITCKASQDVGIAVAWYQQKPGKVPKLLIYWASTRHTGVPDRFSGSGSGTDFTLTISSLQPEDVATYYCQQYSSYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 245 - protein, 446 aa, Artificial Sequence
  Emactuzumab_HeavyChain1
QVQLVQSGAEVKKPGASVKVSCKASGYTFTSYDISWVRQAPGQGLEWMGVIWTDGGTNYAQKLQGRVTMTTDTSTSTAYMELRSLRSDDTAVYYCARDQRLYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 246 - protein, 213 aa, Artificial Sequence
  Emactuzumab_LightChain1
DIQMTQSPSSLSASVGDRVTITCRASEDVNTYVSWYQQKPGKAPKLLIYAASNRYTGVPSRFSGSGSGTDFTLTISSLQPEDFATYYCQQSFSYPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 247 - protein, 441 aa, Artificial Sequence
  Emibetuzumab_HeavyChain1
QVQLVQSGAEVKKPGASVKVSCKASGYTFTDYYMHWVRQAPGQGLEWMGRVNPNRRGTTYNQKFEGRVTMTTDTSTSTAYMELRSLRSDDTAVYYCARANWLDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 248 - protein, 215 aa, Artificial Sequence
  Emibetuzumab_LightChain1
DIQMTQSPSSLSASVGDRVTITCSVSSSVSSIYLHWYQQKPGKAPKLLIYSTSNLASGVPSRFSGSGSGTDFTLTISSLQPEDFATYYCQVYSGYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 249 - protein, 448 aa, Artificial Sequence
  Emicizumab_HeavyChain1
QVQLVESGGGLVQPGGSLRLSCAASGFTFSYYDIQWVRQAPGKGLEWVSSISPSGQSTYYRREVKGRFTISRDNSKNTLYLQMNSLRAEDTAVYYCARRTGREYGGGWYFDYWGQGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQKEMTKNQVSLTCLVKGFYPSDIAVEWESNGQPENNYKTTPPVLDSDGSFFLYSKLTVDKSRWQEGNVFSCSVMHEALHNRYTQKSLSLSP

SEQ ID NO: 250 - protein, 444 aa, Artificial Sequence
  Emicizumab_HeavyChain2
QVQLVQSGSELKKPGASVKVSCKASGYTFTDNNMDWVRQAPGQGLEWMGDINTRSGGSIYNEEFQDRVIMTVDKSTDTAYMELSSLRSEDTATYHCARRKSYGYYLDEWGEGTLVTVSSASTKGPSVFPLAPCSRSTSESTAALGCLVKDYFPEPVTVSWNSGALTSGVHTFPAVLQSSGLYSLSSVVTVPSSSLGTQTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQYNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSKLTVDKSRWQEGNVFSCSVMHEALHNHYTQESLSLSP

SEQ ID NO: 251 - protein, 214 aa, Artificial Sequence
  Emicizumab_LightChain1
DIQMTQSPSSLSASVGDRVTITCKASRNIERQLAWYQQKPGQAPELLIYQASRKESGVPDRFSGSRYGTDFTLTISSLQPEDIATYYCQQYSDPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 252 - protein, 449 aa, Artificial Sequence
  Enavatuzumab_HeavyChain1
EVQLVESGGGLVQPGGSLRLSCAASGFTFSSYWMSWVRQAPGKGLEWVAEIRLKSDNYATHYAESVKGRFTISRDDSKNSLYLQMNSLRAEDTAVYYCTGYYADAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 253 - protein, 218 aa, Artificial Sequence
  Enavatuzumab_LightChain1
DIQMTQSPSSLSASVGDRVTITCRASQSVSTSSYSYMHWYQQKPGKAPKLLIKYASNLESGVPSRFSGSGSGTDFTLTISSLQPEDFATYYCQHSWEIPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 254 - protein, 447 aa, Artificial Sequence
  Enfortumab_HeavyChain
EVQLVESGGGLVQPGGSLRLSCAASGFTFSSYNMNWVRQAPGKGLEWVSYISSSSSTIYYADSVKGRFTISRDNAKNSLSLQMNSLRDEDTAVYYCARAYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 255 - protein, 214 aa, Artificial Sequence
  Enfortumab_LightChain
DIQMTQSPSSVSASVGDRVTITCRASQGISGWLAWYQQKPGKAPKFLIYAASTLQSGVPSRFSGSGSGTDFTLTISSLQPEDFATYYCQQANSFPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 256 - protein, 447 aa, Artificial Sequence; identical to SEQ ID NO: 254
  Enfortumab_vedotin_HeavyChain1

SEQ ID NO: 257 - protein, 214 aa, Artificial Sequence; identical to SEQ ID NO: 255
  Enfortumab_vedotin_LightChain1

SEQ ID NO: 258 - protein, 452 aa, Artificial Sequence
  Enoblituzumab_HeavyChain
EVQLVESGGGLVQPGGSLRLSCAASGFTFSSFGMHWVRQAPGKGLEWVAYISSDSSAIYYADTVKGRFTISRDNAKNSLYLQMNSLRDEDTAVYYCGRGRENIYYGSRLDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELVGGPSVFLLPPKPKDTLMISRTPEVTCVVVDVSHEDPEVKFNWYVDGVEVHNAKTKPPEEQYNSTLRVVSVLTVLHQDWLNGKEYKCKVSNKALPAPIEKTISKAKGQPREPQVYTLPPSREEMTKNQVSLTCLVKGFYPSDIAVEWESNGQPENNYKTTPLVLDSDGSFFLYSKLTVDKSRWQQGNVFSCSVMHEALHNHYTQKSLSLSPGK

SEQ ID NO: 259 - protein, 214 aa, Artificial Sequence
  Enoblituzumab_LightChain
DIQLTQSPSFLSASVGDRVTITCKASQNVDTNVAWYQQKPGKAPKALIYSASYRYSGVPSRFSGSGSGTDFTLTISSLQPEDFATYYCQQYNNYPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 260 - protein, 452 aa, Artificial Sequence
  Enokizumab_HeavyChain1
QVQLVQSGAEVKKPGSSVKVSCKASGGTFSYYWIEWVRQAPGQGLEWMGEILPGSGTTNPNEKFKGRVTITADESTSTAYMELSSLRSEDTAVYYCARADYYGSDYVKFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 261 - protein, 214 aa, Artificial Sequence
  Enokizumab_LightChain1
DIQMTQSPSSLSASVGDRVTITCKASQHVITHVTWYQQKPGKAPKLLIYGTSYSYSGVPSRFSGSGSGTDFTLTISSLQPEDFATYYCQQFYEYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 262 - protein, 204 aa, Artificial Sequence
  Enokizumab_LightChain
DIQMTQSPSSLSASVGDRVTITCKASQHVITHVTWYQQKPGKAPKLLIYGTSYSYSGVPSRFSGSGSGTDFTLTISSLQPEDFATYYCQQFYEYPLTFGGGTKVEIKRTVAAPSVFIFPPSDEQLKSGTASVVCLLNNFYPREAKVQWKVESVTEQDSKDSTYSLSSTLTLSKADYEKHKVYACEVTHQGLSSPVTKSFNRGEC

SEQ ID NO: 263 - protein, 452 aa, Artificial Sequence
  Enoticumab_HeavyChain1
QVQLVESGGGVVQPGRSLRLSCAASGFTFSSYGMHWVRQAPGKGLEWVSFLWYDGTNKNYVESVKGRFTISRDNSKNMLYLEMNSLRAEDTAVYYCARDHDFRSGYEGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 264 - protein, 214 aa, Artificial Sequence
  Enoticumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQHRSNWPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 265 - protein, 443 aa, Artificial Sequence
  Ensituximab_HeavyChain1
QVQLKESGPDLVAPSQSLSITCTVSGFSLSKFGVNWVRQPPGKGLEWLGVIWGDGSTSYNSGLISRLSISKENSKSQVFLKLNSLQADDTATYYCVKPGGDYWGHGTSVTVSSASTKGPSVFPLAPSSKSTSGGTAALGCLVKDYFPEPVTVSWNSGALTSGVHTFPAVLQSSGPYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTMPPVLDSDGSFFLYSKLTVDKSRWQQGNVFSCSVMHEALHNHYTQKSLSLSPGK

SEQ ID NO: 266 - protein, 213 aa, Artificial Sequence
  Ensituximab_LightChain1
QVVLTQSPVIMSASPGEKVTMTCSASSSISYMYWYQQKPGTSPKRWIYDTSKLASGVPARFSGSGSGTSYSLTISNMEAGDAATYYCHQRDSYPWTFGGGTNLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 267 - protein, 256 aa, Artificial Sequence; identical to SEQ ID NO: 238
  Ensituximab_SingleChain_variable_fragment

SEQ ID NO: 268 - protein, 329 aa, Artificial Sequence
  Entolimod_chain1
MRGSHHHHHHGMASMTGGQQMGRDLYDDDDKDPMAQVINTNSLSLLTQNNLNKSQSSLSSAIERLSSGLRINSAKDDAAGQAIANRFTSNIKGLTQASRNANDGISIAQTTEGALNEINNNLQRVRELSVQATNGTNSDSDLKSIQDEIQQRLEEIDRVSNQTQFNGVKVLSQDNQMKIQVGANDGETITIDLQKIDVKSLGLDGFNVNSPGISGGGGGILDSMGTLINEDAAAAKKSTANPLASIDSALSKVDAVRSSLGAIQNRFDSAITNLGNTVTNLNSARSRIEDADYATEVSNMSKAQILQQAGTSVLAQANQVPQNVLSLLR

SEQ ID NO: 269 - protein, 446 aa, Artificial Sequence
  Epratuzumab_HeavyChain
QVQLVQSGAEVKKPGSSVKVSCKASGYTFTSYWLHWVRQAPGQGLEWIGYINPRNDYTEYNQNFKDKATITADESTNTAYMELSSLRSEDTAFYFCARRDITTFYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 270 - protein, 219 aa, Artificial Sequence
  Epratuzumab_LightChain
DIQLTQSPSSLSASVGDRVTMSCKSSQSVLYSANHKNYLAWYQQKPGKAPKLLIYWASTRESGVPSRFSGSGSGTDFTFTISSLQPEDIATYYCHQYLSSWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 271 - protein, 254 aa, Artificial Sequence [sequence omitted]

SEQ ID NO: 272 - protein, 152 aa, Artificial Sequence [sequence omitted]

SEQ ID NO: 273 - protein, 236 aa, Artificial Sequence
  Erlizuab_HeavyChain1
EVQLVESGGGLVQPGGSLRLSCATSGYTFTEYTHWRQAPGKGLEWVAGINPKNGGTSHNQRFDRFTISVDKSTSTAYQNSLRAEDTAVYYCARWRGLNYGFDVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEL

SEQ ID NO: 274 - protein, 213 aa, Artificial Sequence
  Erlizuab_LightChain1
DIQTQSPSSLSASVGDRVTITCRASQDINNYLNWYQQKPGKAPKLLIYYTSTLHSGVPSRFSGSGSGTDYTLTISSLQPEDFATYYCQQGNTLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 275 - protein, 447 aa, Artificial Sequence
  Etaracizumab_HeavyChain1
QVQLVESGGGVVQPGRSLRLSCAASGFTFSSYDMSWVRQAPGKGLEWVAKVSSGGGSTYYLDTVQGRFTISRDNSKNTLYLQMNSLRAEDTAVYYCARHLHGSFASWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 276 - protein, 214 aa, Artificial Sequence
  Etaracizumab_LightChain1
EIVLTQSPATLSLSPGERATLSCQASQSISNFLHWYQQRPGQAPRLLIRYRSQSISGIPARFSGSGSGTDFTLTISSLEPEDFAVYYCQQSGSWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 277 - protein, 442 aa, Artificial Sequence
  Etrolizuab_HeavyChain1
EVQLVESGGGLVQPGGSLRLSCAASGFFITNNYWGWVRQAPGKGLEWVGYISYSGSTSYNPSLKSRFTISRDTSKNTFYLQNSLRAEDTAVYYCARTGSSGYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPG

SEQ ID NO: 278 - protein, 442 aa, Artificial Sequence
  Etrolizuab_HeavyChain2
EVQLVESGGGLVQPGGSLRLSCAASGFFITNNYWGWVRQAPGKGLEWVGYISYSGSTSYNPSKLSRFTISRDTSKNTFYLQNSLRAEDTAVYYCARTGSSGYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPG

SEQ ID NO: 279 - protein, 213 aa, Artificial Sequence
  Etrolizuab_LightChain1
DIQTQSPSSLSASVGDRVTITCRASESVDDLLHWYQQKPGKAPKLLIKYASQSISGVPSRFSGSGSGTDFTLTISSLQPEDFATYYCQQGNSLPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 280 - protein, 446 aa, Artificial Sequence
  Etrolizumab_HeavyChain1
EVQLVESGGGLVQPGGSLRLSCAASGFFITNNYWGWVRQAPGKGLEWVGYISYSGSTSYNPSLKSRFTISRDTSKNTFYLQMNSLRAEDTAVYYCARTGSSGYFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 281 - protein, 214 aa, Artificial Sequence
  Etrolizumab_LightChain1
DIQMTQSPSSLSASVGDRVTITCRASESVDDLLHWYQQKPGKAPKLLIKYASQSISGVPSRFSGSGSGTDFTLTISSLQPEDFATYYCQQGNSLPNTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 282 - protein, 453 aa, Artificial Sequence
  Evinacumab_HeavyChain1
EVQLVESGGGVIQPGGSLRLSCAASGFTFDDYAMNWVRQGPGKGLEWVSAISGDGGSTYYADSVKGRFTISRDNSKNSLYLQMNSLRAEDTAFFYCAKDLRNTIFGVVIPDAFDIWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 283 - protein, 214 aa, Artificial Sequence
  Evinacumab_LightChain1
DIQMTQSPSTLSASVGDRVTITCRASQSIRSWLAWYQQKPGKAPKLLIYKASSLESGVPSRFSGSGSGTEFTLTISSLQPDDFATYYCQQYNSYSYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 284 - protein, 441 aa, Artificial Sequence
  Evolocumab_HeavyChain1
EVQLVQSGAEVKKPGASVKVSCKASGYTLTSYGISWVRQAPGQGLEWMGWVSFYNGNTNYAQKLQGRGTMTTDPSTSTAYMELRSLRSDDTAVYYCARGYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 285 - protein, 215 aa, Artificial Sequence
  Evolocumab_LightChain1
ESALTQPASVSGSPGQSITISCTGTSSDVGGYNSVSWYQQHPGKAPKLMIYEVSNRPSGVSNRFSGSKSGNTASLTISGLQAEDEADYYCNSYTSTSMVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 286 - protein, 451 aa, Artificial Sequence
  Exbivirumab_HeavyChain1
QVQLVESGGGVVQPGGSLRLSCAPSGFVFRSYGMHWVRQTPGKGLEWVSLIWHDGSNRFYADSVKGRFTISRDNSKNTLYLQMNSLRAEDTAMYFCARERLIAAPAAFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 287 - protein, 214 aa, Artificial Sequence
  Exbivirumab_LightChain1
SYVLTQPPSVSVAPGKTARISCGGNNIGTKNVHWYQQKPGQAPVLVVYADSDRPSGIPERFSGSNSGNTATLTISRVEAGDEADYYCQVWDSVSYHVVFGGGTTLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 288 - protein, 449 aa, Artificial Sequence
  Farletuzumab_HeavyChain1
EVQLVESGGGVVQPGRSLRLSCSASGFTFSGYGLSWVRQAPGKGLEWVAMISSGGSYTYYADSVKGRFAISRDNAKNTLFLQMDSLRPEDTGVYFCARHGDDPAWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 289 - protein, 217 aa, Artificial Sequence
  Farletuzumab_LightChain1
DIQLTQSPSSLSASVGDRVTITCSVSSSISSNNLHWYQQKPGKAPKPWIYGTSNLASGVPSRFSGSGSGTDYTFTISSLQPEDIATYYCQQWSSYPYMYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 290 - protein, 446 aa, Artificial Sequence
  Fasinumab_HeavyChain1
QVQLVQSGAEVKKPGASVKVSCKVSGFTLTELSIHWVRQAPGKGLEWMGGFDPEDGETIYAQKFQGRVTMTEDTSTDTAYMELTSLRSEDTAVYYCSTIFGVVTNFDNWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 291 - protein, 214 aa, Artificial Sequence
  Fasinumab_LightChain1
DIQMTQSPSSLSASAGDRVTITCRASQAIRNDLGWYQQKPGKAPKRLIYAAFNLQSGVPSRFSGSGSGTEFTLTISSLQPEDLASYYCQQYNRYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 292 - protein, 450 aa, Artificial Sequence
  Fezakinumab_HeavyChain1
QVQLVQSGAEVKKPGASVKVSCKASGYTFTNYYMHWVRQAPGQGLEWVGWINPYTGSAFYAQKFRGRVTMTRDTSISTAYMELSRLRSDDTAVYYCAREPEKFDSDDSDVWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 293 - protein, 217 aa, Artificial Sequence
  Fezakinumab_LightChain1
QAVLTQPPSVSGAPGQRVTISCTGSSSNIGAGYGVHWYQQLPGTAPKLLIYGDSNRPSGVPDRFSGSKSGTSASLAITGLQAEDEADYYCQSYDNSLSGYVFGGGTQLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 294 - protein, 449 aa, Artificial Sequence
  FG-3019_HeavyChain1
EGQLVQSGGGLVHPGGSLRLSCAGSGFTFSSYGMHWVRQAPGKGLEWVSGIGTGGGTYSTDSVKGRFTISRDNAKNSLYLQMNSLRAEDMAVYYCARGDYYGSGSFFDCWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 295 - protein, 214 aa, Artificial Sequence
  FG-3019_LightChain1
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 296 - protein, 448 aa, Artificial Sequence
  Fibatuzumab_HeavyChain1
QVQLVQSGAEVKKPGASVKVSCKASGYTFTGYWMNWVRQAPGQGLEWMGDIYPGSGNTNYDEKFQGRVTMTRDTSISTAYMELSRLRSDDTAVYYCARGGYYEDFDSWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 297 - protein, 214 aa, Artificial Sequence
  Fibatuzumab_LightChain1
DIQMTQSPSFLSASVGDRVTITCRASQGIISYLAWYQQKPEKAPKRLIYAASSLQSGVPSRFSGSGSGTEFTLTISSLQPEDFATYYCGQYANYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 298 - protein, 448 aa, Artificial Sequence
  Ficlatuzumab_HeavyChain1
QVQLVQPGAEVKKPGTSVKLSCKASGYTFTTYWMHWVRQAPGQGLEWIGEINPTNGHTNYNQKFQGRATLTVDKSTSTAYMELSSLRSEDTAVYYCARNYVGSIFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 299 - protein, 447 aa, Artificial Sequence
  Ficlatuzumab_HeavyChain
VQLVQPGAEVKKPGTSVKLSCKASGYTFTTYWMHWVRQAPGQGLEWIGEINPTNGHTNYNQKFQGRATLTVDKSTSTAYMELSSLRSEDTAVYYCARNYVGSIFDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 300 - protein, 214 aa, Artificial Sequence
  Ficlatuzumab_LightChain1
DIVMTQSPDSLAMSLGERVTLNCKASENVVSYVSWYQQKPGQSPKLLIYGASNRESGVPDRFSGSGSATDFTLTISSVQAEDVADYHCGQSYNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 301 - protein, 450 aa, Artificial Sequence
  Figitumumab_HeavyChain1
EVQLLESGGGLVQPGGSLRLSCTASGFTFSSYAMNWVRQAPGKGLEWVSAISGSGGTTFYADSVKGRFTISRDNSRTTLYLQMNSLRAEDTAVYYCAKDLGWSDSYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 302 - protein, 214 aa, Artificial Sequence
  Figitumumab_LightChain1
DIQMTQFPSSLSASVGDRVTITCRASQGIRNDLGWYQQKPGKAPKRLIYAASRLHRGVPSRFSGSGSGTEFTLTISSLQPEDFATYYCLQHNSYPCSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 303 - protein, 453 aa, Artificial Sequence
  Firivumab_HeavyChain1
QVQLVQSGAEVKMPGSSVKVSCKTSGVFFSSHAISWVRQAPGQGLEWMGGISPMFGTTHYAQKFQGRVTITADQSTTTAYMELTSLTSEDTAVYYCARDGAGSYYPLNWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 304 - protein, 214 aa, Artificial Sequence
  Firivumab_LightChain1
EIVLTQSPATLSLSPGERATLSCRASENIWNNLAWYQQKPGQAPRLLISGASTGATGVPSRFRGSGSRTEFTLTISSLQSEDFAIYFCQQYNSWPRTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 305 - protein, 449 aa, Artificial Sequence
  Flanvotumab_HeavyChain1
QVQLVQSGSELKKPGASVKISCKASGYTFTSYAMNWVRQAPGQGLESMGWINTNTGNPTYAQGFTGRFVFSMDTSVSTAYLQISSLKAEDTAIYYCAPRYSSSWYLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 306 - protein, 215 aa, Artificial Sequence
  Flanvotumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQRSNWLMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 307 - protein, 454 aa, Artificial Sequence
  Fletikumab_HeavyChain1
QVQLVQSGAEVKRPGASVKVSCKASGYTFTNDIIHWVRQAPGQRLEWMGWINAGYGNTQYSQNFQDRVSITRDTSASTAYMELISLRSEDTAVYYCAREPLWFGESSPHDYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 308 - protein, 214 aa, Artificial Sequence
  Fletikumab_LightChain1
AIQLTQSPSSLSASVGDRVTITCRASQGISSALAWYQQKPGKAPKLLIYDASSLESGVPSRFSGSGSGTDFTLTISSLQPEDFATYYCQQFNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 309 - protein, 447 aa, Artificial Sequence
  Fontolizumab_HeavyChain1
QVQLVQSGAELKKPGSSVKVSCKASGYIFTSSWINWVKQAPGQGLEWIGRIDPSDGEVHYNQDFKDKATLTVDKSTNTAYMELSSLRSEDTAVYYCARGFLPWFADWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 310 - protein, 214 aa, Artificial Sequence
  Fontolizumab_LightChain1
DIQMTQSPSTLSASVGDRVTITCKASENVDTYVSWYQQKPGKAPKLLIYGASNRYTGVPSRFSGSGSGTDFTLTISSLQPDDFATYYCGQSYNYPFTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 311 - protein, 448 aa, Artificial Sequence
  Foralumab_HeavyChain1
QVQLVESGGGVVQPGRSLRLSCAASGFKFSGYGMHWVRQAPGKGLEWVAVIWYDGSKKYYVDSVKGRFTISRDNSKNTLYLQMNSLRAEDTAVYYCARQMGYWHFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 312 - protein, 215 aa, Artificial Sequence
  Foralumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQRSNWPPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 313 - protein, 448 aa, Artificial Sequence
  Foravirumab_HeavyChain1
QVQLVESGGGAVQPGRSLRLSCAASGFTFSSYGMHWVRQAPGKGLEWVAVILYDGSDKFYADSVKGRFTISRDNSKNTLYLQMNSLRAEDTAVYYCAKVAVAGTHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 314 - protein, 448 aa, Artificial Sequence
  Foravirumab_HeavyChain
EVQLVESGGGAVQPGRSLRLSCAASGFTFSSYGMHWVRQAPGKGLEWVAVILYDGSDKFYADSVKGRFTISRDNSKNTLYLQMNSLRAEDTAVYYCAKVAVAGTHFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 315 - protein, 214 aa, Artificial Sequence
  Foravirumab_LightChain1
DIQMTQSPSSLSASVGDRVTITCRASQGIRNDLGWYQQKPGKAPKLLIYAASSLQSGVPSRFSGSGSGTDFTLTISSLQPEDFATYYCQQLNSYPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 316 - protein, 447 aa, Artificial Sequence
  Fresolimumab_HeavyChain1
QVQLVQSGAEVKKPGSSVKVSCKASGYTFSSNVISWVRQAPGQGLEWMGGVIPIVDIANYAQRFKGRVTITADESTSTTYMELSSLRSEDTAVYYCASTLGLVLDAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 317 - protein, 215 aa, Artificial Sequence
  Fresolimumab_LightChain1
ETVLTQSPGTLSLSPGERATLSCRASQSLGSSYLAWYQQKPGQAPRLLIYGASSRAPGIPDRFSGSGSGTDFTLTISRLEPEDFAVYYCQQYADSPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 318 - protein, 449 aa, Artificial Sequence
  Fulranumab_HeavyChain1
EVQLVESGGGLVQPGGSLRLSCAASGFTLRSYSMNWVRQAPGKGLEWVSYISRSSHTIFYADSVKGRFTISRDNAKNSLYLQMDSLRDEDTAMYYCARVYSSGWHVSDYFDYWGQGILVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 319 - protein, 214 aa, Artificial Sequence; identical to SEQ ID NO: 308
  Fulranumab_LightChain1

SEQ ID NO: 320 - protein, 452 aa, Artificial Sequence
  Futuximab_HeavyChain1
EVQLQQPGSELVRPGASVKLSCKASGYTFTSYWMHWVKQRPGQGLEWIGNIYPGSRSTNYDEKFKSKATLTVDTSSSTAYMQLSSLTSEDSAVYYCTRNGDYYVSSGDAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 321 - protein, 214 aa, Artificial Sequence
  Futuximab_LightChain1
DIQMTQTTSSLSASLGDRVTISCRTSQDIGNYLNWYQQKPDGTVKLLIYYTSRLHSGVPSRFSGSGSGTDFSLTINNVEQEDVATYFCQHYNTVPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 322 - protein, 445 aa, Artificial Sequence
  Galcanezumab_HeavyChain1
QVQLVQSGAEVKKPGSSVKVSCKASGYTFGNYWMQWVRQAPGQGLEWMGAIYEGTGKTVYIQKFADRVTITADKSTSTAYMELSSLRSEDTAVYYCARLSDYVSGFGYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEAAGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 323 - protein, 214 aa, Artificial Sequence
  Galcanezumab_LightChain1
DIQMTQSPSSLSASVGDRVTITCRASKDISKYLNWYQQKPGKAPKLLIYYTSGYHSGVPSRFSGSGSGTDFTLTISSLQPEDFATYYCQQGDALPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 324 - protein, 457 aa, Artificial Sequence
  Galiximab_HeavyChain1
QVQLQESGPGLVKPSETLSLTCAVSGGSISGGYGWGWIRQPPGKGLEWIGSFYSSSGNTYYNPSLKSQVTISTDTSKNQFSLKLNSMTAADTAVYYCVRDRLFSVVGMVYNNWFDVWGPGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 325 - protein, 216 aa, Artificial Sequence
  Galiximab_LightChain1
ESALTQPPSVSGAPGQKVTISCTGSTSNIGGYDLHWYQQLPGTAPKLLIYDINKRPSGISDRFSGSKSGTAASLAITGLQTEDEADYYCQSYDSSLNAQVFGGGTRLTVLGQPKAAPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 326 - protein, 449 aa, Artificial Sequence
  Ganitumab_HeavyChain1
QVQLQESGPGLVKPSGTLSLTCAVSGGSISSSNWWSWVRQPPGKGLEWIGEIYHSGSTNYNPSLKSRVTISVDKSKNQFSLKLSSVTAADTAVYYCARWTGRTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 327 - protein, 219 aa, Artificial Sequence
  Ganitumab_LightChain1
DVVMTQSPLSLPVTPGEPASISCRSSQSLLHSNGYNYLDWYLQKPGQSPQLLIYLGSNRASGVPDRFSGSGSGTDFTLKISRVEAEDVGVYYCMQGTHWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 328 - protein, 456 aa, Artificial Sequence
  Gantenerumab_HeavyChain1
QVELVESGGGLVQPGGSLRLSCAASGFTFSSYAMSWVRQAPGKGLEWVSAINASGTRTYYADSVKGRFTISRDNSKNTLYLQMNSLRAEDTAVYYCARGKGNTHKPYGYVRYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 329 - protein, 215 aa, Artificial Sequence
  Gantenerumab_LightChain1
DIVLTQSPATLSLSPGERATLSCRASQSVSSSYLAWYQQKPGQAPRLLIYGASSRATGVPARFSGSGSGTDFTLTISSLEPEDFATYYCLQIYNMPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 330 - protein, 116 aa, Artificial Sequence
  Gemtuzumab_HeavyChain1
QVQLQQSGAELAKPGASVKMSCKASGYTFTSYRMHWVKQRPGQGLEWIGYINPSTGYTEYNQKFKDKATLTADKSSSTAYMQLSSLTFEDSAVYYCARGGGVFDYWGQGTTLTVSS

SEQ ID NO: 331 - protein, 117 aa, Artificial Sequence [sequence omitted]

SEQ ID NO: 332 - protein, 107 aa, Artificial Sequence
  Gemtuzumab_LightChain2
DIQMTQSPSTLSASVGDRVTITCRASQSINTWLAWYQQKPGKAPKLLMYKASSLESGVPSRFIGSGSGTEFTLTISSLQPDDFATYYCQQYNSDSKMFGQGTKVEVK

SEQ ID NO: 333 - protein, 106 aa, Artificial Sequence
  Gemtuzumab_ozogamicin_LightChain1
QIVLTQSPAIMSASPGEKVTITCSASSSISYMHWFQQKPGTSPKLWIYTTSNLASGVPARFSGSGSGTSYSLTISRMEAEDAATYYCHQRSTYPLTFGSGTKLELK

SEQ ID NO: 334 - protein, 445 aa, Artificial Sequence
  Gevokizumab_HeavyChain1
QVQLQESGPGLVKPSQTLSLTCSFSGFSLSTSGMGVGWIRQPSGKGLEWLAHIWWDGDESYNPSLKSRLTISKDTSKNQVSLKITSVTAADTAVYFCARNRYDPPWFVDWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 335 - protein, 214 aa, Artificial Sequence
  Gevokizumab_LightChain1
DIQMTQSTSSLSASVGDRVTITCRASQDISNYLSWYQQKPGKAVKLLIYYTSKLHSGVPSRFSGSGSGTDYTLTISSLQQEDFATYFCLQGKMLPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 336 - protein, 449 aa, Artificial Sequence
  Girentuximab_HeavyChain1
DVKLVESGGGLVKLGGSLKLSCAASGFTFSNYYMSWVRQTPEKRLELVAAINSDGGITYYLDTVKGRFTISRDNAKNTLYLQMSSLKSEDTALFYCARHRSGYFSMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 337 - protein, 214 aa, Artificial Sequence
  Girentuximab_LightChain1
DIVMTQSQRFMSTTVGDRVSITCKASQNVVSAVAWYQQKPGQSPKLLIYSASNRYTGVPDRFTGSGSGTDFTLTISNMQSEDLADFFCQQYSNYPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 338 - protein, 445 aa, Artificial Sequence
  Glembatumumab_HeavyChain1
QVQLQESGPGLVKPSQTLSLTCTVSGGSISSFNYYWSWIRHHPGKGLEWIGYIYYSGSTYSNPSLKSRVTISVDTSKNQFSLTLSSVTAADTAVYYCARGYNWNYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 339 - protein, 215 aa, Artificial Sequence
  Glembatumumab_LightChain1
EIVMTQSPATLSVSPGERATLSCRASQSVDNNLVWYQQKPGQAPRLLIYGASTRATGIPARFSGSGSGTEFTLTISSLQSEDFAVYYCQQYNNWPPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 340 - protein, 444 aa, Artificial Sequence
  Goilixiab_HeavyChain1
EVQLVESGGGLAKPGGSLRLSCAASGFRFTFNNYYDWVRQAPGQGLEWVSRISSSGDPTWYADSVKGRFTISRENAKNTLFLQNSLRAEDTAVYYCASLTTGSDSWGQGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVHEALHNHYTQKSLSLSPGK

SEQ ID NO: 341 - protein, 213 aa, Artificial Sequence
  Goilixiab_LightChain1
DIQTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 342 - protein, 446 aa, Artificial Sequence
  Guselkumab_HeavyChain1
EVQLVQSGAEVKKPGESLKISCKGSGYSFSNYWIGWVRQMPGKGLEWMGIIDPSNSYTRYSPSFQGQVTISADKSISTAYLQWSSLKASDTAMYYCARWYYKPFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 343 - protein, 217 aa, Artificial Sequence
  Guselkumab_LightChain1
QSVLTQPPSVSGAPGQRVTISCTGSSSNIGSGYDVHWYQQLPGTAPKLLIYGNSKRPSGVPDRFSGSKSGTSASLAITGLQSEDEADYYCASWTDGLSLVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 344 - protein, 120 aa, Artificial Sequence
  HuMab-001_HeavyChain_VDJ-Region
QVQLQQWGAGLLKPSETLSLTCAVYGGSFSGYYWNWIRQPPGKGLEWIGEINHSGSTNYNPSLKSRVTISVDTSKNQFSLKLSSVTAADTAVYYCARGNYGSGYYYFDLWGRGTQVTVSS

SEQ ID NO: 345 - protein, 107 aa, Artificial Sequence
  HuMab-001_LightChain_VJ-Region
DIQMTQSPSSLSASVGDRVTITCRASQGISSWLAWYQQKPEKAPKSLIFAASSLQSGVPSRFSGSGSGTDFTLTISSLQPEDFATYYCQQYISFPITFGQGTRLEIK

SEQ ID NO: 346 - protein, 122 aa, Artificial Sequence
  HuMab-005_HeavyChain_gamma-Chain_VDJ-Region
EVQLVQSGAEVKKPGESLKISCKASGYSFHFYWIGWVRQMPGKGLEWMGSIYPGDSDTRYRPSFQGQVTISADKSISTAYLQWTSLKASDTAIYYCARQRGDYYYFYGMDVWGQGTTVTVSS

SEQ ID NO: 347 - protein, 107 aa, Artificial Sequence
  HuMab-005_LightChain_VJ-Region
EIVLTQSPGTLSLSPGERATLSCRASQSVSSSYLAWYQQKPGQVPRLLIYGASSRATGIPDRFSGSGSGTDFTLTISRLEPEDFAVYYCQQYGSSLTFGGGTKVEIK

SEQ ID NO: 348 - protein, 119 aa, Artificial Sequence
  HuMab-006_HeavyChain_VDJ-Region
EVQLLESGGGLVQPGGSLRLSCAASGFTFSNYALIWVRQAPGKGLEWVSIIRGGAGSTYYADSVKGRFTISRDNSKNTLYLQMNSLRAEDTAVYYCAKARIWGPLFDYWGQGTLVTVSS

SEQ ID NO: 349 - protein, 108 aa, Artificial Sequence [sequence omitted]

SEQ ID NO: 350 - protein, 120 aa, Artificial Sequence
  HuMab-019_HeavyChain_VDJ-Region
QVQLQQWGAGLLKPSETLSLTCAVYGGSFSDYYWNWIRQPPGKGLEWIGEIHHVGSTNYNPSLKSRVTISVDTSKSQFSLKLSSVTAADTAVYYCARGYYDSGVYYFDYWAQGTLVTVSS

SEQ ID NO: 351 - protein, 120 aa, Artificial Sequence
  HuMab-021_HeavyChain_VDJ-Region
QVQLQQWGAGLLKPSETLSLTCAVYGGSFSDYYWNWIRQPPGKGLEWIGEIHHSGSTNYNPSLKSRVTISVDTSKNQFSLKLSSVTAADTAVYYCARGYYASGVYYFDYWGQGTLVTVSS

SEQ ID NO: 352 - protein, 107 aa, Artificial Sequence
  HuMab-021_LightChain_VJ-Region
DIQMTQSPSSLSASVGDRVTITCRASQGISSWLAWYQQKPEKAPKSLIYAASSLQSGVPSRFSGSGSGTDFTLTISSLQPEDFATYYCQQYNSYPITFGQGTRLEIK

SEQ ID NO: 353 - protein, 120 aa, Artificial Sequence
  HuMab-025_HeavyChain_VDJ-Region
QVQLQQWGAGLLKPSETLSLTCAVYGGSFSDYYWNWIRQPPGKGLEWIGEIHHSGSTNYNPSLKSRVTISVDTSKNQFSLKLSSVTAADTAVYYCARGYYDSGVYYFDYWAQGTLVTVSS

SEQ ID NO: 354 - protein, 107 aa, Artificial Sequence
  HuMab-025_LightChain_VJ-Region
DIQMTQSPSSLSASVGDRVTITCRASQGISRWLAWYQQKPEKAPKSLIYAASSLRSGVPSRFSGSGSGTDFTLTISSLQPEDFATYYCQQYNSYPITFGQGTRLEIK

SEQ ID NO: 355 - protein, 120 aa, Artificial Sequence
  HuMab-027_HeavyChain_VDJ-Region
QVQLQQWGAGLLKPSETLSLTCAVYGGSFSDYFWNWIRQPPGKGLEWIGEIHHSGSTNYNPSLKSRVTISVDTSKNQFSLNLSSVTAADTAVYYCARGLIGSGYYYFDYWDQGTLVTVSS

SEQ ID NO: 356 - protein, 120 aa, Artificial Sequence
  HuMab-032_HeavyChain_VDJ-Region
QVQLQQWGAGLLKPSETLSLTCAVYGGSFSGYYWSWIRQPPGKGLEWIGEINHSGDTNYNPSLTSRVTISVDTSKNQFSLKLSSVTAADTAVYYCARLFYGSGIYYFDYWGQGTLVTVSS

SEQ ID NO: 357 - protein, 107 aa, Artificial Sequence
  HuMab-032_LightChain_VJ-Region
DIQMTQSPSSLSASVGDRVTITCRASQGISSWLAWYQQKPEKAPKSLIYATFRLQSGVPSRFSGSGSGTDFTLTISSLQPEDFATYYCQQYNSFPPTFGQGTKVEIK

SEQ ID NO: 358 - protein, 121 aa, Artificial Sequence
  HuMab-033_HeavyChain_VDJ-Region
QVQLVESGGGVVQTGRSLRLSCAASGFTFSSHAMHWVRQAPGKGLEWVAAISYDGSNKYYADSVKGRFTISRDNSKNTLYLQMNSLRAEDTAVYYCARGDYISSSGVFDYWGQGTLVTVSS

SEQ ID NO: 359 - protein, 120 aa, Artificial Sequence
  HuMab-035_HeavyChain_VDJ-Region
QVQLQQWGAGLLKPSETLSLTCAIYGGSFSGYYWSWIRQPPGKGLEWIGEINHSGDTNYNPSLTSRVTISVDTSKNQFSLKLSSVTAADTAVYYCARLFYGSGIYYFDYWGQGTLVTVSS

SEQ ID NO: 360 - protein, 120 aa, Artificial Sequence
  HuMab-036_HeavyChain_VDJ-Region
QVQLQQWGAGLLKPSETLSLTCAVYGGSFSDYYWSWIRQPPGKGLEWIGEINHSGSTNYNPSLKSRVTISVDTSKNQFSLKLSSVTAADTAVYYCARLYYGSGTYYFDYWGQGTLVTVSS

SEQ ID NO: 361 - protein, 107 aa, Artificial Sequence
  HuMab-036_LightChain_VJ-Region
DIQMTQSPSSLSASVGDRVTITCRASQGISSWLTWYQQKPEKAPKSLIYAASRLQSGVPSRFSGSGSGTDFTLTISSLQPEDFATYYCQQYNSFPPTFGQGTKVEIK

SEQ ID NO: 362 - protein, 122 aa, Artificial Sequence
  HuMab-041_HeavyChain_VDJ-Region
EVQLVQSGAEVKKPGESLKISCKGSGYSFTSYWIGWVRQMPGKGLEWMGSIYPGDSHTRYRPSFQGQVTISADKSISTAYLQWSSLKASDTAMYYCARQKGDFYYFFGLDVWGQGTAITVSS

SEQ ID NO: 363 - protein, 122 aa, Artificial Sequence
  HuMab-044_HeavyChain_VDJ-Region
EVQLVQSGAEVKKPGESLKISCKGSGYRFSSYWIGWVRQMPGKGLEWMGSIFPGDSDTRYSPSFQGQVTISADKSITTAYLQWSSLKASDTAMYYCARQAGDYYYYNGMDVWGQGTTVTVSS

SEQ ID NO: 364 - protein, 119 aa, Artificial Sequence
  HuMab-049_HeavyChain_VDJ-Region
EVQLLESGGDLVQPGGSLRLSCAASGFTFSSYAMSWVRQAPGKGLEWVSAISGRGGTTYYADSVKGRFTISRDNSKSTLCLQMNSLRAEDTAVYYCAKARANWDYFDYWGQGTLVTVSS

SEQ ID NO: 365 - protein, 107 aa, Artificial Sequence
  HuMab-049_LightChain_VJ-Region
DIQMTQSPSSVSASVGDRVTITCRASQGISSWLAWYQHKPGKAPKLLIYAASILQSGVPSRFSGSGSGTDFTLTISSLRPEDFATYYCQQANSFPITFGQGTRLEIK

SEQ ID NO: 366 - protein, 119 aa, Artificial Sequence
  HuMab-050_HeavyChain_VDJ-Region
EVQLLESGGGLVQPGGSLRLSCAASGFTFSSYAMNWVRQAPGKGLEWVSAISGRGGTTYYADSVKGRFTISRDNSKNTLYLQMSSLRAEDTAVYYCAKARANWDYFDYWGQGTLVTVSS

SEQ ID NO: 367 - protein, 107 aa, Artificial Sequence
  HuMab-050_LightChain_VJ-Region
DIQMTQSPSSVSASVGDRVTITCRASQGISSWLAWYQHKPGKAPKLLIYAASILQSGVPSRFSGSGSGTDFTLTISSLQPEDFATYYCQQANSFPITFGQGTRLEIK

SEQ ID NO: 368 - protein, 120 aa, Artificial Sequence
  HuMab-054_HeavyChain_VDJ-Region
QVQLQQWGAGLLKPSETLSLTCAVYGGSFSGYYWSWIRQPPGKGLEWIGEIHHSGSTNYNPSLKSRVTISVDTSKNQFSLKLSSVTAADTAVYYCARLWYGSGSYYFDYWGQGTLVTVSS

SEQ ID NO: 369 - protein, 107 aa, Artificial Sequence
  HuMab-054_LightChain_VJ-Region
DIQMTQSPSSLSASVGDRVTITCRASQGISSWLAWYQQKPEKAPKSLIYAASSLQSGVPSRFSGSGSGTDFTLTISSLQPEDFATYYCQQYNSFPPTFGGGTKVEIK

SEQ ID NO: 370 - protein, 119 aa, Artificial Sequence
  HuMab-055_HeavyChain_VDJ-Region
EVQLLESGGGLVQPGGSLRLSCAASGFTFSSYAMNWVRQAPGKGLEWVSAISGRGGTTYYADSVKGRFTISRDNSKSTLCLQMNSLRAEDTAVYYCAKARANWDYFDYWGQGTLVTVSS

SEQ ID NO: 371 - protein, 122 aa, Artificial Sequence
  HuMab-059_HeavyChain_VDJ-Region
QVQLVQSGAEVKKPGASVRVPCKASGYTFTRYGISWVRQAPGQGLEWMGWISAYNGKTYYAQKLQGRVTMTTDTSTSTAYMELRSLRSDDTAVYYCARSPLLWFEELYFDYWGQGTLVTVSS

SEQ ID NO: 372 - protein, 108 aa, Artificial Sequence
  HuMab-059_LightChain_VJ-Region
EIVLTQSPGTLSLSPGERATLSCRASQSVSSTYLAWYQQKPGQAPRLLIYGASSRATGIPDRFSGSGSGTDFTLTISRLEPEDFAVYYCQQYGTSLFTFGPGTKVDIK

SEQ ID NO: 373 - protein, 122 aa, Artificial Sequence
  HuMab-060_HeavyChain_VDJ-Region
EVQLVQSGAEVKKPGESLKISCKGSGYRFTSYWIGWVRQMPGKGLEWMGSIYPGDSYTRNSPSFQGQVTISADKSIATAYLQWNSLKASDTAMYYCARHAGDFYYFDGLDVWGQGTTVTVSS

SEQ ID NO: 374 - protein, 109 aa, Artificial Sequence
  HuMab-060_LightChain_VJ-Region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPPITFGQGTRLEIK

SEQ ID NO: 375 - protein, 122 aa, Artificial Sequence
  HuMab-067_HeavyChain_VDJ-Region
EVQLVQSGAEVKKPGESLKISCKGSGYSFTSYWIGWVRQMPGKGLEWMGIIYPGDSDTRYSPSFQGQVTISVDKSISTAYLQWSSLKASDTAMYYCARQKGDYYYHYGLDVWGQGTTVTVSS

SEQ ID NO: 376 - protein, 122 aa, Artificial Sequence
  HuMab-072_HeavyChain_VDJ-Region
EVQLVQSGAEVKKPGESLKISCKGSGYSFTSYWIGWVRQMPGKGLEWMGIIYPGDSDTRYSPSFQGQVTISADKSISTAYLQWSSLKASDTAMYYCARQKGDYYYFNGLDVWGQGTTVTVSS

SEQ ID NO: 377 - protein, 109 aa, Artificial Sequence
  HuMab-072_LightChain_VJ-Region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPRLTFGGGTKVEIK

SEQ ID NO: 378 - protein, 121 aa, Artificial Sequence
  HuMab-084_HeavyChain_VDJ-Region
QVQLVQSGAEVKKPGSSVKVSCKASGGTFRTYAINWVRQAPGQGLEWMGRINTVLGIVNHAQKFQGRVTITADKSTNTAYMELNSLRSEDTAVYYCAREKGVDYYYGIEVWGQGTTVTVSS

SEQ ID NO: 379 - protein, 107 aa, Artificial Sequence
  HuMab-084_LightChain_VJ-Region
DIQMTQSPSSVSASVGDRVTITCRASQGISSWLAWYQHKPGKAPKLLIYVASTLQSGVPSRFSGSGSGTDFTLTISSLQPEDFATYYCQQANSFPLTFGGGTKVEIK

SEQ ID NO: 380 - protein, 120 aa, Artificial Sequence
  HuMab-091_HeavyChain_VDJ-Region
QVQLQQWGAGLLKPSETLSLTCAVSGGSFSGYYWTWIRQPPGKGLEWIGEIYHSGDTNYNPSLKSRVTISVDTSKNQFSLKLYSVTAADTAVYYCARLYFGSGIYYLDYWGQGTLVTVSS

SEQ ID NO: 381 - protein, 107 aa, Artificial Sequence
  HuMab-091_LightChain_VJ-Region
DIQMTQSPSSLSASVGDRVTITCRASQGISSWLVWYQQKPEKAPKSLIYAASSLQSGVPSRFSGSGSGTDFTLTISSLQPEDFATYYCQQYNSFPPTFGQGTKVEIK

SEQ ID NO: 382 - protein, 122 aa, Artificial Sequence
  HuMab-093_HeavyChain_VDJ-Region
EVQLVQSGAEVKKPGESLKISCKGSGYSFTSYWIGWVRQMPGKGLEWMGRIYPGDSDTRYSPSFQGQVTISADKSITTAYLQWSSLRASDTAMYYCARQRGDYYYFFGLDIWGQGTTVTVSL

SEQ ID NO: 383 - protein, 124 aa, Artificial Sequence
  HuMab-098_HeavyChain_VDJ-Region
EVQLLESGGGLVQPGGSLRLSCAASGFTFSNYGMSWVRQAPGKGLEWVSAISGSAYSTYYADSVKGRFTISRDNSKNTLWLQMNSLRAEDTAVYYCAKAHYHGSGSYYTLFDYWGQGTLVTVSS

SEQ ID NO: 384 - protein, 107 aa, Artificial Sequence
  HuMab-098_LightChain_VJ-Region
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIK

SEQ ID NO: 385 - protein, 124 aa, Artificial Sequence
  HuMab-100_HeavyChain_VDJ-Region
EVQLLESGGGLVQPGGSLRLSCAASGFTFNNYGMNWVRQAPGKGLEWVSAISGTGYSTYYADSVKGRFTISRDNSKNTLYLQMNSLRAEDTAVYYCAKAHYFGSGSYYTLFDYWGQGTLVTVSS

SEQ ID NO: 386 - protein, 124 aa, Artificial Sequence
  HuMab-106_HeavyChain_VDJ-Region
EVQLVQSGAEVKKPGESLKISCKGSGYSFTRYWIGWVRQMPGKGLEWMGIIYPGDSDTRYSPSFQGQVTISADKSISTAYLQWSSLKASDTAMYYCARLTGDRGFDYYSGMDVWGQGTTVTVSS

SEQ ID NO: 387 - protein, 107 aa, Artificial Sequence
  HuMab-106_LightChain_VJ-Region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSFTFGPGTKVDIK

SEQ ID NO: 388 - protein, 117 aa, Artificial Sequence
  HuMab_10F8_HeavyChain_V-Region
QVQLVESGGGVVQPGRSLRLSCTASGFTFSHYGMYWVRQAPGKGLEWVAVIWYDGSYEYNEDSVKGRFTISRDNSKNTLYLQMNSLRAEDTAVYYCARDRVGLFDYWGQGTLVTVSS

SEQ ID NO: 389 - protein, 136 aa, Artificial Sequence
  HuMab_10F8_HeavyChain_V-Region_Precursor
MEFGLSWVFLVALLRGVQCQVQLVESGGGVVQPGRSLRLSCTASGFTFSHYGMYWVRQAPGKGLEWVAVIWYDGSYEYNADSVKGRFTISRDNSKNTLYLQMNSLRAEDTAVYYCARDRVGLFDYWGQGTLVTVSS

SEQ ID NO: 390 - protein, 107 aa, Artificial Sequence
  HuMab_10F8_LightChain_V-Region
EIVLTQSPGTLSLSPGERATLSCRASQSISSSYLAWYQQKPGQAPRLLIYGPSSRATGIPDRFSGSGSGTDFTLTISRLEPEDFAVYYCQQYAGSLTFGPGTKVDIK

SEQ ID NO: 391 - protein, 127 aa, Artificial Sequence
  HuMab_10F8_LightChain_V-Region_Precursor
METPAQLLFLLLLWLPDTTGEIVLTQSPGTLSLSPGERATLSCRASQSISSSYLAWYQQKPGQAPRLLIYGPSSRATGIPDRFSGSGSGTDFTLTISRLEPEDFAVYYCQQYAGSLTFGPGTKVDIK

SEQ ID NO: 392 - protein, 119 aa, Artificial Sequence
  HuMab-111_HeavyChain_VDJ-Region
QVQLVQSGAEVKKPGSSVKVSCKASGGTFSSYGISWVRQAPGPGLEWMGRIIPILGIANYAQKFQGRVTITADKSTNTAYMELSSLRSEDTAVYYCARDQEYSSNWYYWGQGTLVTVSS

SEQ ID NO: 393 - protein, 107 aa, Artificial Sequence
  HuMab-111_LightChain_VJ-Region
EIVLTQSPGTLSLSPGERATLSCRASQSVRSSYLAWYQQKPGQAPRLLIYGASSRATGIPDRFSGSGSGTDFTLTISRLEPEDFAVYYCQLYGSSPTFGPGTKVDIK

SEQ ID NO: 394 - protein, 121 aa, Artificial Sequence
  HuMab-123_HeavyChain_VDJ-Region
QVQLVQSGAEVKKPGASVKVSCKAAGYTFTNYGISWVRQAPGQALEWMGWITTYSSNTIYAQKLQGRVTMTTDTSTSTAYMELRSLRSDDTAVYYCARDRVVVRPDYFDYWGQGTLVTVSS

SEQ ID NO: 395 - protein, 107 aa, Artificial Sequence
  HuMab-123_LightChain_VJ-Region
EIVLTQSPATLSLSPGERATLSCRASQSVSSYLAWYQQKPGQAPRLLIYDTSNRATGIPARFSGSGSGTDFTLTISSLEPEDFAVYYCQQRSHWPRTFGQGTKVEIK

SEQ ID NO: 396 - protein, 121 aa, Artificial Sequence
  HuMab-124_HeavyChain_VDJ-Region
QVQLVQSGAEVKKPGASVKVSCKAAGYTFTNYGISWVRQAPGQGLEWMGWIITYNGNTIYAQRFQDRVTMTTDTSTSTAYMELRSLRSDDTAVYYCARDRIIVRPDYFDYWGQGTLVTVSS

SEQ ID NO: 397 - protein, 124 aa, Artificial Sequence
  HuMab-125_HeavyChain_VDJ-Region
EVQLLESGGGLVQPGGSLRLSCAASGFTFTDYAMNWVRQAPGKGLEWVSTISGSGYATYYADSVKGRFTISRDNSKTTLYLQMNSLRAEDTAVYYCAKGHTLGSGSYYTLFDYWGQGTLVTVSS

SEQ ID NO: 398 - protein, 107 aa, Artificial Sequence
  HuMab-125_LightChain_VJ-Region
DIQMTQSPSSLSASVGDRVTITCRASQGINSWLAWYQQKPEKAPKSLIYAASSLQSGVPSRFSGSGSGTDFTLTISSLQPEDFATYYCQQYNSYPYTFGQGTKLEIK

SEQ ID NO: 399 - protein, 123 aa, Artificial Sequence
  HuMab-127_HeavyChain_VDJ-Region
EVQLVQSGAEVKKPGESLTISCKGSGYSFSIYWIGWVRQMPGKGLEWMGIIFPGDSDIRYSPSFQGQVTISADKSISTAYLQWSSLKASDTAMYYCARQPGDWSPRHWYFDLWGRGTLVTVSS

SEQ ID NO: 400 - protein, 107 aa, Artificial Sequence
  HuMab-127_LightChain_VJ-Region
VIWMTQSPSLLSASTGDRVTISCRMSQGISSYLAWYQQKPGKAPELLIYAASTLQSGVPSRFSGSGSGTDFTLTISYLQSEDFATYYCQQYYSFPLTFGGGTKVEIK

SEQ ID NO: 401 - protein, 119 aa, Artificial Sequence
  HuMab-129_HeavyChain_VDJ-Region
QVQLVESGGGVVQPGRSLRLSCAASGFTFSTFAIHWVRQAPGKGLEWVAVISYDGGHKFYADSVKGRFTISRDNSKNTLYLQMNSLRAEDTAMYYCARGLGVWGAFDYWGQGTLVTVSS

SEQ ID NO: 402 - protein, 106 aa, Artificial Sequence
  HuMab-129_LightChain_VJ-Region
EIVLTQSPATLSLSPGERATLSCRASQSVSSYLAWYQQKPGQAPRLLIYDASNRATGIPARFSGSGSGTDFTLTISSLEPEDFAVYYCQQRSNWWTFGQGTKVEIK

SEQ ID NO: 403 - protein, 125 aa, Artificial Sequence
  HuMab-132_HeavyChain_VDJ-Region
QVQLVQSGAEVKKPGASVKVSCKASGYTFTSYGISWVRQAPGQGLEWMGWISAYNGNSNYVQKFQGRVTMTTDTTTSTAYMELRSLTSDDTAVYYCAREYSYDSGTYFYYGMDVWGQGTTVTVSS

SEQ ID NO: 404 - protein, 108 aa, Artificial Sequence
  HuMab-132_LightChain_VJ-Region
EIVLTQSPATLSLSPGERATLSCRASQSVSSYLAWYQQKPGQAPRLLIYDASNRATGIPARFSGSGSGTDFTLTISSLEPEDFAVYYCQQRSNWPMYTFGQGTKLEIK

SEQ ID NO: 405 - protein, 120 aa, Artificial Sequence
  HuMab-143_HeavyChain_VDJ-Region
QVQLQQWGAGLLKPSETLSLTCAVYGGSFSGYYWNWIRQPPGKGLEWIGEIHHSGSANYNPSLMSRVTISVDTSKNQFSLQLSSVTAADTAVYYCARGYYGSGYYYFDYWGQGTLVTVSS

SEQ ID NO: 406 - protein, 107 aa, Artificial Sequence
  HuMab-143_LightChain_VJ-Region
DIQMTQSPSSLSASVGDRVTITCRASQGISSWLAWYQQKPEKAPKSLIYAASRLQSGVPSRFSGSGSGTDFTLTISSLQPEDFATYYCQQYNSYPITFGQGTRLEIK

SEQ ID NO: 407 - protein, 122 aa, Artificial Sequence
  HuMab-150_HeavyChain_VDJ-Region
EVQLVQSGAEVKKPGESLKISCKGSGYSFTSYWIGWVRQMPGKGLEWMGSIYPGDSHTRYRPSFQGQVTISADKSISTAYLQWSSLKASDTAMYYCARQAGDYYYYNGMDVWGQGTTVTVSS

SEQ ID NO: 408 - protein, 107 aa, Artificial Sequence
  HuMab-150_LightChain_VJ-Region
EIVLTQSPGTLSLSPGERATLSCRASQSVSSSYLTWYQQKPGQAPRLLIYGASSRATGIPDRFSGSGSGTDFTLTISRLEPEDFAVYYCQQYGSSLTFGGGTKVEIK

SEQ ID NO: 409 - protein, 121 aa, Artificial Sequence
  HuMab-152_HeavyChain_VDJ-Region
QVQVVESGGGVVQPGRSLRLSCAASGFTFSSYAMHWVRQAPGKGLEWVAVISYDGSYKYYADSVKGRFTISRDNSKNTLYLQMNSLRAEDTAVYYCARGSITGSTGVFDYWGQGTLVTVSS

SEQ ID NO: 410 - protein, 107 aa, Artificial Sequence
  HuMab-152_LightChain_VJ-Region
DIQMTQSPSSLSASVGDRVTITCRASQGINSWLAWYQQKPEKAPKSLIYDASSLQSGVPSRFSGSGSGTDFTLTISSLQPENFATYYCQQYNSYPITFGQGTRLEIK

SEQ ID NO: 411 - protein, 121 aa, Artificial Sequence
  HuMab-153_HeavyChain_VDJ-Region
QVQLVESGGGVVQPGRSLRLSCAASGFTFSDYVIHWVRQAPGKGLEWVTVISYDGSNKYYADSVKGRFTISRDNSKNTLYLQMNSLSAEDTAMYYCARGGITGTTGVFDYWGQGTLVTVSS

SEQ ID NO: 412 - protein, 107 aa, Artificial Sequence
  HuMab-153_LightChain_VJ-Region
DIQMTQSPSSLSASVGDRVTITCRASQGISSWLAWYQQKPEKAPKSLIYDASSLQSGVPSRFSGSGYGTDFSLTISSLQPEDFAIYYCQQYKSYPITFGQGTRLEIK

SEQ ID NO: 413 - protein, 126 aa, Artificial Sequence
  HuMab-159_HeavyChain_VDJ-Region
EVQLVQSGAEVKKPGESLKISCKGSGYNFTSYWIGWVRQMPGKGLEWMGIIYPGDSDTRYSPSFQGQVTISADKSISTAYLQWSSLKASDTAMYYCARWGTYYDILTGYFNWFDPWGQGTLVTVSS

SEQ ID NO: 414 - protein, 107 aa, Artificial Sequence
  HuMab-159_LightChain_VJ-Region
DIQMTQSPSSLSASVGDRVTITCRASQGISSWLAWYQQKPEKAPKSLIYAASSLQSGVPSRFSGSGSGTDFTLTISSLQPEDFATYYCQQYYIYPWTFGQGTKVEIK

SEQ ID NO: 415 - protein, 121 aa, Artificial Sequence
  HuMab-160_HeavyChain_VDJ-Region
QVQLVESGGGVVQPGRSLRLSCAASGFTFSSHAMHWVRQAPGKGLEWVAAISYDGSNKYYADSVKGRFTISRDNSKNTMYLQMNSLRAEDTAMCYCARGSITGSTGVFDYWGQGTLVTVSS

SEQ ID NO: 416 - protein, 107 aa, Artificial Sequence
  HuMab-160_LightChain_VJ-Region
DIQMTQSPSSLSASVGDRVTITCRASQDISSWLAWYQQKPEKAPKSLIYAASSLQSGVPSRFSGSGSGTDFTLTISSLQPEDFATYYCQQYNSYPITFGQGTRLEIK

SEQ ID NO: 417 - protein, 124 aa, Artificial Sequence
  HuMab-162_HeavyChain_VDJ-Region
EVQLWESGGGSVQPGGSLRLSCAASGFTFSSYGMSWVRQAPGKGLEWVSGISGSGYSTYYADSVKGRFTISRDNSKNTLYLQMNSLRAEDTAVYYCAKGYYHGSGSYYTSFDYWGQGTLVTVSS

SEQ ID NO: 418 - protein, 107 aa, Artificial Sequence
  HuMab-162_LightChain_VJ-Region
DIQMTQSPSSLSASVGDRVTITCRASQGISSWLAWYQQKPEKAPKSLIYAASSLQSGVPSRFSGSGSGTDFTLTISSLQPEDFATYYCQQYNSYPLTFGGGTKVEIK

SEQ ID NO: 419 - protein, 122 aa, Artificial Sequence
  HuMab-163_HeavyChain_VDJ-Region
EVQLVQSGAEVKKPGESLKISCQGSGYRFISYWIGWVRQMPGKGLEWMGRIYPGDSDTRYSPSFQGQVTISVDKSISTAYLQWSSLKASDTAMYYCARQRGDYYYFNGLDVWGQGTTVTVSS

SEQ ID NO: 420 - protein, 107 aa, Artificial Sequence
  HuMab-163_LightChain_VJ-Region
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSLTFGGGTKVEIK

SEQ ID NO: 421 - protein, 121 aa, Artificial Sequence
  HuMab-166_HeavyChain_VDJ-Region
QVQLVESGGGVVQPGRSLRLSCAASGFTFSSYAMHWVRQAPGKGLEWVAVISYDGSNEYYADSVKGRFTISRDNSKNTLYLQMNSLRAEDTAVYYCARGSIIGSTGVFDYWGQGTLVTVSS

SEQ ID NO: 422 - protein, 107 aa, Artificial Sequence
  HuMab-166_LightChain_VJ-Region
DIQMTQSPSSLSASVGDRVTITCRASQGISNWLAWYQQKPEKAPKSLIYDASSLQSGVPSRFSGSGSGTDFTLTISSLQPEDFATYYCQQYNSYPITFGQGTRLEIK

SEQ ID NO: 423 - protein, 121 aa, Artificial Sequence
  HuMab-167_HeavyChain_VDJ-Region
QVQLVESGGGVVQPGRSLRLSCAASGFTFSSYAIHWVRQAPGKGLEWVAVISYDGSNKYYADSVKGRFTISRDNSKNTLYLQMNSLRAEDTAVYYCARGSITGSTGVFDYWGQGTLVTVSS

SEQ ID NO: 424 - protein, 121 aa, Artificial Sequence
  HuMab-169_HeavyChain_VDJ-Region
QVQLVQSGAEVKKPGASVKVSCKASGYTFTNYGISWVRQAPGQGLEWMGWLSAYSGNTIYAQKLQGRVTMTTDTSTTTAYMELRSLRSDDTAVYYCARDRIVVRPDYFDYWGQGTLVTVSS

SEQ ID NO: 425 - protein, 107 aa, Artificial Sequence
  HuMab-169_LightChain_VJ-Region
EIVLTQSPATLSLSPGERATLSCRASQSVSSYLAWYQQKPGQAPRLLIYDASNRATGIPARFSGSGSGTDFTLTISSLEPEDFAVYYCQQRSNWPRTFGQGTKVEIK

SEQ ID NO: 426 - protein, 122 aa, Artificial Sequence
  HuMab-7D8_HeavyChain_VH-Region
EVQLVESGGGLVQPDRSLRLSCAASGFTFHDYAMHWVRQAPGKGLEWVSTISWNSGTIGYADSVKGRFTISRDNAKNSLYLQMNSLRAEDTALYYCAKDIQYGNYYYGMDVWGQGTTVTVSS

SEQ ID NO: 427 - protein, 122 aa, Artificial Sequence; identical to SEQ ID NO: 426
  HuMab-7D8_HeavyChain_V-Region

SEQ ID NO: 428 - protein, 107 aa, Artificial Sequence
  HuMab-7D8_LightChain_VL-Region
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIK

SEQ ID NO: 429 - protein, 107 aa, Artificial Sequence; identical to SEQ ID NO: 428
  HuMab-7D8_LightChain_V-Region

SEQ ID NO: 430 - protein, 108 aa, Artificial Sequence
  huMAb-anti-MSP10.1_LightChain_VJ-Region
EIVLTQSPDILSLSPGERATLSCRASQALTAKYLAWYQQKPGQVPRLLIYGSSTRATGIPDRFRGSGSGTDFTLTISRLEPADSAVYYCQQYEDSPWTFGQGTKLEIK

SEQ ID NO: 431 - protein, 108 aa, Artificial Sequence
  huMAb-anti-MSP10.2_LightChain_VJ-Region
EIVLTQSPDTLSLSPGETATLSCRASQTVRRNSLAWYQQKPGQAPRLLIYGASDRATGIPDRFSGSGFGTDFTLTVSGLEPEDFAVYYCQQYGTSPRTFGQGTKLEIK

SEQ ID NO: 432 - protein, 108 aa, Artificial Sequence
  HUMAB-Clone_18_VJ-Region
EIVLTQSPATLSLSPGERATLSCRASQSVSSYLAWYQQKPGQAPRLLIYDASKRATGIPARFSGSGSGTDFTLTISSLEPEDFAVYYCQQRSKWPPWTFGQGTKVESK

SEQ ID NO: 433 - protein, 108 aa, Artificial Sequence
  HUMAB-Clone_22_VJ-Region
EIVLTQSPATLSLSPGERATLSCRASQSVSSYLAWYQQKPGQAPRLLIYDASNRATGIPARFSGSGSGTDFTLTISSLEPEDFAVYYCQQRSKWPPWTFGQGTKVEIK

SEQ ID NO: 434 - protein, 144 aa, Artificial Sequence
  HuMab-L612_Chain_VDJ-Region_Precursor
MEFGLTWLFLVANLKGVQCEVQLLDSGGGLVQPGGCLRLSCAASGFTFSSCAMSWVRQAPGKGLEWVSAISGSGGSTYYADSVKGRFTISRDKSKNTLYLQMNSLRAEDTAVYYCAKGGNDILTGYYAWGQGTLVTVSSGSASA

SEQ ID NO: 435 - protein, 107 aa, Artificial Sequence
  HuMab_LC5002-002_LightChain_V-Region
DIQMTQSPSSLSASVGDRVTITCRASQGISRWVAWYQQKPEKAPKSLIYAASSLQSGVPSRFSGSGSGTDFTLTISSLQPEDFATYYCQQYNSYPWTFGQGTKVEIK

SEQ ID NO: 436 - protein, 119 aa, Artificial Sequence
  HuMab_LC5002-002_gamma1-Chain_V-Region
EVQLLESGGGLVQPGGSLRLSCAASGFTFNIYAMNWVRQAPGKGLEWVSVISGRGITTYYADSVKGRFTISRDNSKNTLYLQMNSLRADDTAVYYCAKGSSSWTDFDYWGQGTLVTVSS

SEQ ID NO: 437 - protein, 107 aa, Artificial Sequence
  HuMab_LC5002-003_LightChain_V-Region
DIQMTQSPSSLSASVGDRVTITCRASQGISSWLAWYQQKPEKAPKSLIYAASSLQSGVPSRFSGSGSGTDFTLTISSLQPEDFATYYCQQYNSYPWTFGQGTKVEIK

SEQ ID NO: 438 - protein, 119 aa, Artificial Sequence
  HuMab_LC5002-003_gamma1-Chain_V-Region
EVQLLESGGDLIQPGGSLRLSCAASGFTFNIYAMNWVRQAPGKGLEWVSVISGRGITTYYADSVKGRFTISRDNSKNTLYLQMDSLRAEDTAVYYCAKGSSYWTDFDYWGQGTLVTVSS

SEQ ID NO: 439 - protein, 107 aa, Artificial Sequence
  HuMab_LC5002-005_LightChain_V-Region
DIQMTQSPSSLSASVGDRVTITCRASQGISSWLAWYQQKPEKAPKSLIYAASSLQSGVPSRFSGSGSGTDFTLTISSLQPEDFATYYCQQYNSHPPTFGQGTKLEIK

SEQ ID NO: 440 - protein, 118 aa, Artificial Sequence
  HuMab_LC5002-005_gamma1-Chain_V-Region
EVQVLDSGGGLVQPGGSLRLSCTASGFTFRLYTMSWVRQTPGRGLEWVSGISGSGLSTYFADSVKGRFTISRDNSKNTVYLQMNSLRAEDTAVYYCAKEGDWIYFDSWGQGTLVIVSS

SEQ ID NO: 441 - protein, 107 aa, Artificial Sequence
  HuMab_LC5002-007_LightChain_V-Region
EIVLTQSPGTLSLSPGERATLSCRASQSVSSSYLAWYQQKPGQAPRLLIYGASSRAIGIPDRFSGSGSGTDFTLTISRLEPEDFAVYYCQHYGSSLTFGGGTKVEIK

SEQ ID NO: 442 - protein, 123 aa, Artificial Sequence
  HuMab_LC5002-007__gamma1-Chain_V-Region
QVQLVQSGAEVKKPGSSVKVSCKVSGGTFSSYAFSWVRQAPGQGLEWMGRIIPILGRTNYAQKFQGRVTITADKSTSTAYMEVSSLRSEDTAVYYCAREGETLDYFYYGMDVWGQGTTVTVSS

SEQ ID NO: 443 - protein, 119 aa, Artificial Sequence
  HuMab_LC5002-018_gamma1-Chain_V-Region
EVQLLESGGGLVQPGGSLRLSCAASGFTFNIYAMNWVRQAPGKGLEWVSVISGSGVTTYYADSVKGRFTISRDNSKNTLYLQMNSLRAEDTAVYYCAKGSSWYVDFDYWGQGTLVTVSS

SEQ ID NO: 444 - protein, 449 aa, Artificial Sequence
  Ibalizumab_HeavyChain1
QVQLQQSGPEVVKPGASVKMSCKASGYTFTSYVIHWVRQKPGQGLDWIGYINPYNDGTDYDEKFKGKATLTSDTSTSTAYMELSSLRSEDTAVYYCAREKDNYATGAWFAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 445 - protein, 219 aa, Artificial Sequence
  Ibalizumab_LightChain1
DIVMTQSPDSLAVSLGERVTMNCKSSQSLLYSTNQKNYLAWYQQKPGQSPKLLIYWASTRESGVPDRFSGSGSGTDFTLTISSVQAEDVAVYYCQQYYSYRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 446 - protein, 443 aa, Artificial Sequence
  Ibritumomab_tiuxetan_HeavyChain
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSAPSVYPLAPVCGDTTGSSVTLGCLVKGYFPEPVTLTWNSGSLSSGVHTFPAVLQSDLYTLSSSVTVTSSTWPSQSITCNVAHPASSTKVDKKIEPRGPTIKPCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSR

SEQ ID NO: 447 - protein, 209 aa, Artificial Sequence
  Ibritumomab_tiuxetan_LightChain
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRADAAPTVFIFPPSDEQLKSGTASVVCLLNNFYPREAKVQWKVDNALQSGNSQESVTEQDSKDSTYSLSSTLTLSKADYEKHKVYACEVTHQGLSSPVTKSFN

SEQ ID NO: 448 - protein, 456 aa, Artificial Sequence
  Icrucumab_HeavyChain1
QAQVVESGGGVVQSGRSLRLSCAASGFAFSSYGMHWVRQAPGKGLEWVAVIWYDGSNKYYADSVRGRFTISRDNSENTLYLQMNSLRAEDTAVYYCARDHYGSGVHHYFYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 449 - protein, 215 aa, Artificial Sequence
  Icrucumab_LightChain1
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 450 - protein, 225 aa, Artificial Sequence
  Idarucizumab_HeavyChain1
QVQLQESGPGLVKPSETLSLTCTVSGFSLTSYIVDWIRQPPGKGLEWIGVIWAGGSTGYNSALRSRVSITKDTSKNQFSLKLSSVTAADTAVYYCASAAYYSYYNYDGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 451 - protein, 219 aa, Artificial Sequence
  Idarucizumab_LightChain1
DVVMTQSPLSLPVTLGQPASISCKSSQSLLYTDGKTYLYWFLQRPGQSPRRLIYLVSKLDSGVPDRFSGSGSGTDFTLKISRVEAEDVGVYYCLQSTHFPHTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 452 - protein, 444 aa, Artificial Sequence
  Igatuzuab_HeavyChain1
QVQLVQSGAEVKKPGSSVKVSCKASGFTFTDYKIHWVRQAPGQGLEWGYFNPNSGYSTYAQKFQGRVTITADKSTSTAYELSSLRSEDTAVYYCARLSPGGYYVDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVHEALHNHYTQKSLSLSPG

SEQ ID NO: 453 - protein, 212 aa, Artificial Sequence
  Igatuzuab_LightChain1
DIQTQSPSSLSASVGDRVTITCRASQGINNYLNWYQQKPGKAPKRLIYNTNNLQTGVPSRFSGSGSGTEFTLTISSLQPEDFATYYCLQHNSFPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 454 - protein, 119 aa, Artificial Sequence
  IGF-IR_HUMAB-1A_HeavyChain
EVQLVQSGGGLVHPGGSLRLSCAGSGFTFRNYAMYWVRQAPGKGLEWVSAIGSGGGTYYADSVKGRFTISRDNAKNSLYLQMNSLRAEDMAVYYCARAPNWGSDAFDIWGQGTMVTVSS

SEQ ID NO: 455 - protein, 119 aa, Artificial Sequence
  IGF-IR_HUMAB-23_HeavyChain
EVQLVQSGGGLVHPGGSLRLSCAGSGFTFSNYAMYWVRQAPGKGLEWVSAIGSGGGTYYADSVKGRFTISRDNAKNSLYLQMNSLRAEDMAVYHCARAPNWGSEAFDIWGQGTMVTVSS

SEQ ID NO: 456 - protein, 107 aa, Artificial Sequence; identical to SEQ ID NO: 352
  IGF-IR_HUMAB-23_LightChain

SEQ ID NO: 457 - protein, 119 aa, Artificial Sequence
  IGF-IR_HUMAB-8_HeavyChain
EVQLVQSGGGLVHPGGSLRLSCAGSGFTFRSYAMYWVRQAPGKGLEWVSAIGSGGGTYYADSVKGRFTISRDNAKNSLYLQMNSLRAEDMAVYYCARAPNWGSDAFDIWGQGTMVTVSS

SEQ ID NO: 458 - protein, 107 aa, Artificial Sequence
  IGF-IR_HUMAB-8_LightChain
DIQMTQSPSSLSASVGDRVTITCRASQGISSWLAWYQQKPEKAPKSLIYAASSLQSGVPSRFSGSGSGTDFTLTISSLQPEDFATYYCQQYNSYPPTFGPGTKVDIK

SEQ ID NO: 459 - protein, 236 aa, Artificial Sequence
  ImAb1_LightChain
MDMRAPAQFFGILLLWFPGIRCDIKMTQSPSSMYASLGERVTITCKASQDIKSYLSWYQQKPWKSPKILIYYATSLADGVPSRISGSGSGQDYSLTISSLESDDTATYYCLQHGESPYTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 460 - protein, 227 aa, Artificial Sequence
  ImAb1_gamma1-Chain
MNFGFSLIFLVLVLKGVQCEVKLVESGGGLVKPGGSLKLSCAASGFTFSNYAMSWVRQTPEKRLEWVASISSDGDTYFPDNVKGRFTISRENAGNILFLQMSSLRSEDTAMYYCARGFMITFWGQGTLVTVSAAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVD

SEQ ID NO: 461 - protein, 448 aa, Artificial Sequence
  Imalumab_HeavyChain1
EVQLLESGGGLVQPGGSLRLSCAASGFTFSIYSMNWVRQAPGKGLEWVSSIGSSGGTTYYADSVKGRFTISRDNSKNTLYLQMNSLRAEDTAVYYCAGSQWLYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 462 - protein, 214 aa, Artificial Sequence
  Imalumab_LightChain1
DIQMTQSPSSLSASVGDRVTITCRSSQRIMTYLNWYQQKPGKAPKLLIFVASHSQSGVPSRFRGSGSETDFTLTISGLQPEDSATYYCQQSFWTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 463 - protein, 449 aa, Artificial Sequence
  Imgatuzumab_HeavyChain1
QVQLVQSGAEVKKPGSSVKVSCKASGFTFTDYKIHWVRQAPGQGLEWMGYFNPNSGYSTYAQKFQGRVTITADKSTSTAYMELSSLRSEDTAVYYCARLSPGGYYVMDAWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 464 - protein, 213 aa, Artificial Sequence
  Imgatuzumab_LightChain1
DIQMTQSPSSLSASVGDRVTITCRASQGINNYLNWYQQKPGKAPKRLIYNTNNLQTGVPSRFSGSGSGTEFTLTISSLQPEDFATYYCLQHNSFPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 465 - protein, 451 aa, Artificial Sequence
  Inclacumab_HeavyChain1
EVQLVESGGGLVRPGGSLRLSCAASGFTFSNYDMHWVRQATGKGLEWVSAITAAGDIYYPGSVKGRFTISRENAKNSLYLQMNSLRAGDTAVYYCARGRYSGSGSYYNDWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFEGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 466 - protein, 214 aa, Artificial Sequence
  Inclacumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQRSNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 467 - protein, 449 aa, Artificial Sequence
  Indatuximab_ravtansine_HeavyChain1
QVQLQQSGSELMMPGASVKISCKATGYTFSNYWIEWVKQRPGHGLEWIGEILPGTGRTIYNEKFKGKATFTADISSNTVQMQLSSLTSEDSAVYYCARRDYYGNFYYAMDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 468 - protein, 214 aa, Artificial Sequence
  Indatuximab_ravtansine_LightChain1
DIQMTQSTSSLSASLGDRVTISCSASQGINNYLNWYQQKPDGTVELLIYYTSTLQSGVPSRFSGSGSGTDYSLTISNLEPEDIGTYYCQQYSKLPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 469 - protein, 449 aa, Artificial Sequence
  Indusatumab_vedotin_HeavyChain1
QVQLQQWGAGLLKPSETLSLTCAVFGGSFSGYYWSWIRQPPGKGLEWIGEINHRGNTNDNPSLKSRVTISVDTSKNQFALKLSSVTAADTAVYYCARERGYTYGNFDHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 470 - protein, 214 aa, Artificial Sequence
  Indusatumab_vedotin_LightChain1
EIVMTQSPATLSVSPGERATLSCRASQSVSRNLAWYQQKPGQAPRLLIYGASTRATGIPARFSGSGSGTEFTLTIGSLQSEDFAVYYCQQYKTWPRTFGQGTNVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 471 - protein, 451 aa, Artificial Sequence
  Inebilizumab_HeavyChain1
EVQLVESGGGLVQPGGSLRLSCAASGFTFSSSWMNWVRQAPGKGLEWVGRIYPGDGDTNYNVKFKGRFTISRDDSKNSLYLQMNSLKTEDTAVYYCARSGFITTVRDFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 472 - protein, 218 aa, Artificial Sequence
  Inebilizumab_LightChain1
EIVLTQSPDFQSVTPKEKVTITCRASESVDTFGISFMNWFQQKPDQSPKLLIHEASNQGSGVPSRFSGSGSGTDFTLTINSLEAEDAATYYCQQSKEVPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 473 - protein, 30 aa, Artificial Sequence
  Insulin_peglispro_Fragment1
FVNQHLCGSHLVEALYLVCGERGFFYTKPT

SEQ ID NO: 474 - protein, 21 aa, Artificial Sequence
  Insulin_peglispro_Fragment2
GIVEQCCTSICSLYQLENYCN

SEQ ID NO: 475 - protein, 165 aa, Artificial Sequence
  Interferon_beta-1b_chain1
SYNLLGFLQRSSNFQSQKLLWQLNGRLEYCLKDRMNFDIPEEIKQLQQFQKEDAALTIYEMLQNIFAIFRQDSSSTGWNETIVENLLANVYHQINHLKTVLEEKLEKEDFTRGKLMSSLHLKRYYGRILHYLKAKEYSHCAWTIVRVEILRNFYFINRLTGYLRN

SEQ ID NO: 476 - protein, 449 aa, Artificial Sequence
  Intetumumab_HeavyChain1
QVQLVESGGGVVQPGRSRRLSCAASGFTFSRYTMHWVRQAPGKGLEWVAVISFDGSNKYYVDSVKGRFTISRDNSENTLYLQVNILRAEDTAVYYCAREARGSYAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 477 - protein, 215 aa, Artificial Sequence
  Intetumumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQRSNWPPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 478 - protein, 449 aa, Artificial Sequence; identical to SEQ ID NO: 336
  Iodine_(124I)_Girentuximab_HeavyChain1

SEQ ID NO: 479 - protein, 214 aa, Artificial Sequence; identical to SEQ ID NO: 337
  Iodine_(124I)_Girentuximab_LightChain1

SEQ ID NO: 480 - protein, 445 aa, Artificial Sequence
  Iodine_(131I)_derlotuxiab_biotin_HeavyChain1
QVQLKESGPGLVAPSQSLSITCTVSGFSLTDYGVRWIRQPPGKGLEWLGVIWGGGSTYYNSALKSRLSISKDNSKSQVFLKNSLQTDDTAYYCAKEKRRGYYYADYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVHEALHNHYTQKSLSLSPGK

SEQ ID NO: 481 - protein, 213 aa, Artificial Sequence
  Iodine_(131I)_derlotuxiab_biotin_LightChain1
ENVLTQSPAISASPGEKVTTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 482 - protein, 450 aa, Artificial Sequence
  Iodine_(131I)_Derlotuximab_biotin_HeavyChain1
QVQLKESGPGLVAPSQSLSITCTVSGFSLTDYGVRWIRQPPGKGLEWLGVIWGGGSTYYNSALKSRLSISKDNSKSQVFLKMNSLQTDDTAMYYCAKEKRRGYYYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 483 - protein, 215 aa, Artificial Sequence
  Iodine_(131I)_Derlotuximab_biotin_LightChain1
ENVLTQSPAIMSASPGEKVTMTCRASSSVSSSYLHWYQQKSGASPKLWIYSTSNLASGVPARFSGSGSGTSYSLTISSVEAEDAATYYCQQYSGYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 484 - protein, 448 aa, Artificial Sequence
  Ipilimumab_HeavyChain
QVQLVESGGGVVQPGRSLRLSCAASGFTFSSYTMHWVRQAPGKGLEWVTFISYDGNNKYYADSVKGRFTISRDNSKNTLYLQMNSLRAEDTAIYYCARTGWLGPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 485 - protein, 215 aa, Artificial Sequence
  Ipilimumab_LightChain
EIVLTQSPGTLSLSPGERATLSCRASQSVGSSYLAWYQQKPGQAPRLLIYGAFSRATGIPDRFSGSGSGTDFTLTISRLEPEDFAVYYCQQYGSSPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 486 - protein, 62 aa, Artificial Sequence
  Iratumumab_HeavyChain1
QVQLQQWGAGLLKPSETLSLTCAVYGGSFSAYYWSWIRQPPGKGLEWIGDYWGQGSLVTVSS

SEQ ID NO: 487 - protein, 107 aa, Artificial Sequence
  Iratumumab_LightChain1
DIQMTQSPTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIK

SEQ ID NO: 488 - protein, 450 aa, Artificial Sequence
  Isatuximab_HeavyChain1
QVQLVQSGAEVAKPGTSVKLSCKASGYTFTDYWMQWVKQRPGQGLEWIGTIYPGDGDTGYAQKFQGKATLTADKSSKTVYMHLSSLASEDSAVYYCARGDYYGSNSLDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 489 - protein, 214 aa, Artificial Sequence
  Isatuximab_LightChain1
DIVMTQSHLSMSTSLGDPVSITCKASQDVSTVVAWYQQKPGQSPRRLIYSASYRYIGVPDRFTGSGAGTDFTFTISSVQAEDLAVYYCQQHYSPPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 490 - protein, 449 aa, Artificial Sequence
  Itolizumab_HeavyChain1
EVQLVESGGGLVKPGGSLKLSCAASGFKFSRYAMSWVRQAPGKRLEWVATISSGGSYIYYPDSVKGRFTISRDNVKNTLYLQMSSLRSEDTAMYYCARRDYDLDYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 491 - protein, 214 aa, Artificial Sequence
  Itolizumab_LightChain1
DIQMTQSPSSLSASVGDRVTITCKASRDIRSYLTWYQQKPGKAPKTLIYYATSLADGVPSRFSGSGSGQDYSLTISSLESDDTATYYCLQHGESPFTLGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 492 - protein, 445 aa, Artificial Sequence
  Ixekizumab_HeavyChain1
QVQLVQSGAEVKKPGSSVKVSCKASGYSFTDYHIHWVRQAPGQGLEWMGVINPMYGTTDYNQRFKGRVTITADESTSTAYMELSSLRSEDTAVYYCARYDYFTGTGVYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 493 - protein, 219 aa, Artificial Sequence
  Ixekizumab_LightChain1
DIVMTQTPLSLSVTPGQPASISCRSSRSLVHSRGNTYLHWYLQKPGQSPQLLIYKVSNRFIGVPDRFSGSGSGTDFTLKISRVEAEDVGVYYCSQSTHLPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 494 - protein, 449 aa, Artificial Sequence
  Labetuzumab_govitecan_HeavyChain1
EVQLVESGGGVVQPGRSLRLSCSASGFDFTTYWMSWVRQAPGKGLEWIGEIHPDSSTINYAPSLKDRFTISRDNAKNTLFLQMDSLRPEDTGVYFCASLYFGFPWFAYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 495 - protein, 213 aa, Artificial Sequence
  Labetuzumab_govitecan_LightChain1
DIQLTQSPSSLSASVGDRVTITCKASQDVGTSVAWYQQKPGKAPKLLIYWTSTRHTGVPSRFSGSGSGTDFTFTISSLQPEDIATYYCQQYSLYRSFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 496 - protein, 447 aa, Artificial Sequence
  Lambrolizumab_HeavyChain1
QVQLVQSGVEVKKPGASVKVSCKASGYTFTNYYMYWVRQAPGQGLEWMGGINPSNGGTNFNEKFKNRVTLTTDSSTTTAYMELKSLQFDDTAVYYCARRDYRFDMGFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 497 - protein, 218 aa, Artificial Sequence
  Lambrolizumab_LightChain1
EIVLTQSPATLSLSPGERATLSCRASKGVSTSGYSYLHWYQQKPGQAPRLLIYLASYLESGVPARFSGSGSGTDFTLTISSLEPEDFAVYYCQHSRDLPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 498 - protein, 223 aa, Artificial Sequence
  Lampalizumab_HeavyChain1
EVQLVQSGPELKKPGASVKVSCKASGYTFTNYGMNWVRQAPGQGLEWMGWINTYTGETTYADDFKGRFVFSLDTSVSTAYLQISSLKAEDTAVYYCEREGGVNNWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHT

SEQ ID NO: 499 - protein, 214 aa, Artificial Sequence
  Lampalizumab_LightChain1
DIQVTQSPSSLSASVGDRVTITCITSTDIDDDMNWYQQKPGKVPKLLISGGNTLRPGVPSRFSGSGSGTDFTLTISSLQPEDVATYYCLQSDSLPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 500 - protein, 451 aa, Artificial Sequence
  Lanadelumab_HeavyChain1
EVQLLESGGGLVQPGGSLRLSCAASGFTFSHYIMMWVRQAPGKGLEWVSGIYSSGGITVYADSVKGRFTISRDNSKNTLYLQMNSLRAEDTAVYYCAYRRIGVPRRDEFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 501 - protein, 213 aa, Artificial Sequence
  Lanadelumab_LightChain1
DIQMTQSPSTLSASVGDRVTITCRASQSISSWLAWYQQKPGKAPKLLIYKASTLESGVPSRFSGSGSGTEFTLTISSLQPDDFATYYCQQYNTYWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 502 - protein, 439 aa, Artificial Sequence
  Landogrozumab_HeavyChain1
EVQLVESGGGLVQPGGSLRLSCAASGLTFSRYPMSWVRQAPGKGLVWVSAITSSGGSTYYSDTVKGRFTISRDNAKNTLYLQMNSLRAEDTAVYYCARLPDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 503 - protein, 215 aa, Artificial Sequence
  Landogrozumab_LightChain1
EIVLTQSPGTLSLSPGERATLSCRASSSVSSSYLHWYQQKPGQAPRLLIYSTSNLVAGIPDRFSGSGSGTDFTLTISRLEPEDFAVYYCQHHSGYHFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 504 - protein, 448 aa, Artificial Sequence
  Laprituximab_emtansine_HeavyChain1
QVQLVQSGAEVAKPGASVKLSCKASGYTFTSYWMQWVKQRPGQGLECIGTIYPGDGDTTYTQKFQGKATLTADKSSSTAYMQLSSLRSEDSAVYYCARYDAPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 505 - protein, 214 aa, Artificial Sequence
  Laprituximab_emtansine_LightChain1
DIQMTQSPSSLSASVGDRVTITCRASQDINNYLAWYQHKPGKGPKLLIHYTSTLHPGIPSRFSGSGSGRDYSFSISSLEPEDIATYYCLQYDNLLYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 506 - protein, 438 aa, Artificial Sequence
  Lealesoab_HeavyChain1
QVQLQESGPELKKPGETVKISCKASGYTFRNYGNWVKQAPGKGLKWGWINTYTGEPTYADDFKGRFAFSLETSASTAYLQINNVKNEDTATYFCARKGWDFNGSSLDYWGQGTTVTVSSAKTTPPSVYPLAPGSAAQTNSVTLGCLVKGYFPEPVTVTWNSGSLSSGVHTFPAVLQSDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIHQDWLNGKEFKCRVNSAAFPAPIEKTISKTKGRPKAPQVYTIPPPKEQAKDKVSLTCITDFFPEDITVEWQWNGQPAENYKNTQPINTNGSYFVYSKLNVQKSNWEAGNTFTCSVLHEGLHNHHTEKSLSHSPGK

SEQ ID NO: 507 - protein, 218 aa, Artificial Sequence
  Lealesoab_LightChain1
DIQLTQTPLSLPVSLGDQASISCRSSQSIVHSNGNTYLEWYLQKPGQSPNLLIYKVSNRFSGVPDRFSGSGSGTDFTLKISRVEAEDLGVYYCFQGSHVPPTFGGGTKLEIKRADAAPTVSIFPPSSEQLTSGGASVVCFLNNFYPKDINVKWKIDGSERQNGVLNSWTDQDSKDSTYSSSTLTLTKDEYERHNSYTCEATHKTSTSPIVKSFNRNEC

SEQ ID NO: 508 - protein, 445 aa, Artificial Sequence
  Lebrikizumab_HeavyChain1
QVTLRESGPALVKPTQTLTLTCTVSGFSLSAYSVNWIRQPPGKALEWLAMIWGDGKIVYNSALKSRLTISKDTSKNQVVLTMTNMDPVDTATYYCAGDGYYPYAMDNWGQGSLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 509 - protein, 218 aa, Artificial Sequence
  Lebrikizumab_LightChain1
DIVMTQSPDSLSVSLGERATINCRASKSVDSYGNSFMHWYQQKPGQPPKLLIYLASNLESGVPDRFSGSGSGTDFTLTISSLQAEDVAVYYCQQNNEDPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 510 - protein, 409 aa, Artificial Sequence
  Lenercept_chain1
LVPHLGDREKRDSVCPQGKYIHPQNNSICCTKCHKGTYLYNDCPGPGQDTDCRECESGSFTASENHLRHCLSCSKCRKEMGQVEISSCTVDRDTVCGCRKNQYRHYWSENLFQCFNCSLCLNGTVHLSCQEKQNTVCTCHAGFFLRENECVSCSNCKKSLECTKLCLPQIENVKGTEDSGTTDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 511 - protein, 449 aa, Artificial Sequence
  Lenzilumab_HeavyChain1
QVQLVQSGAEVKKPGASVKVSCKASGYSFTNYYIHWVRQAPGQRLEWMGWINAGNGNTKYSQKFQGRVTITRDTSASTAYMELSSLRSEDTAVYYCVRRQRFPYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 512 - protein, 214 aa, Artificial Sequence
  Lenzilumab_LightChain1
EIVLTQSPATLSVSPGERATLSCRASQSVGTNVAWYQQKPGQAPRVLIYSTSSRATGITDRFSGSGSGTDFTLTISRLEPEDFAVYYCQQFNKSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 513 - protein, 442 aa, Artificial Sequence
  Lerdelimumab_HeavyChain1
EVQLVESGGGVVQPGRSLRLSCAASGFTFSSYGMHWVRQAPGKGLEWVAVIWYDGSNKYYADSVKGRFTISRDNSKNTLYLQMDSLRAEDTAVYYCGRTLESSLWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 514 - protein, 215 aa, Artificial Sequence
  Lerdelimumab_LightChain1
SSELTQDPAVSVALGQTVRITCQGDSLRSYYASWYQQKPGQAPVLVIYGKNNRPSGIPDRFSGSSSGNTASLTITGAQAEDEADYYCNSRDSSSTHRGVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 515 - protein, 451 aa, Artificial Sequence
  Lexatumumab_HeavyChain1
EVQLVQSGGGVERPGGSLRLSCAASGFTFDDYGMSWVRQAPGKGLEWVSGINWNGGSTGYADSVKGRVTISRDNAKNSLYLQMNSLRAEDTAVYYCAKILGAGRGWYFDLWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 516 - protein, 451 aa, Artificial Sequence; identical to SEQ ID NO: 515
  Lexatumumab_HeavyChain

SEQ ID NO: 517 - protein, 214 aa, Artificial Sequence
  Lexatumumab_LightChain1
SSELTQDPAVSVALGQTVRITCQGDSLRSYYASWYQQKPGQAPVLVIYGKNNRPSGIPDRFSGSSSGNTASLTITGAQAEDEADYYCNSRDSSGNHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 518 - protein, 214 aa, Artificial Sequence; identical to SEQ ID NO: 517
  Lexatumumab_LightChain

SEQ ID NO: 519 - protein, 459 aa, Artificial Sequence
  Libivirumab_HeavyChain1
QVQLVESGGGVVRPGRSLRLSCAASGFAFSDYSINWVRQAPGKGLEWVAIISYDGRITYYRDSVKGRFTISRDDSKNTLYLQMNSLRTEDTAVYYCARQYYDFWSGSSVGRNYDGMDVWGLGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 520 - protein, 219 aa, Artificial Sequence
  Libivirumab_LightChain1
DIVMTQSPLSLSVTPGEPASISCRSSQSLLHRSGNNYLDWYLQKPGHSPQLLIYVGSNRASGVPDRFSGSGSGTEYTLKISRVEAEDVGVYYCMQALQTPRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 521 - protein, 450 aa, Artificial Sequence
  Lifastuzumab_HeavyChain
EVQLVESGGGLVQPGGSLRLSCAASGFSFSDFAMSWVRQAPGKGLEWVATIGRVAFHTYYPDSMKGRFTISRDNSKNTLYLQMNSLRAEDTAVYYCARHRGFDVGHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 522 - protein, 219 aa, Artificial Sequence
  Lifastuzumab_LightChain
DIQMTQSPSSLSASVGDRVTITCRSSETLVHSSGNTYLEWYQQKPGKAPKLLIYRVSNRFSGVPSRFSGSGSGTDFTLTISSLQPEDFATYYCFQGSFNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 523 - protein, 449 aa, Artificial Sequence
  Lifastuzumab_vedotin_HeavyChain1
VQLVESGGGLVQPGGSLRLSCAASGFSFSDFAMSWVRQAPGKGLEWVATIGRVAFHTYYPDSMKGRFTISRDNSKNTLYLQMNSLRAEDTAVYYCARHRGFDVGHFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 524 - protein, 219 aa, Artificial Sequence; identical to SEQ ID NO: 522
  Lifastuzumab_vedotin_LightChain1

SEQ ID NO: 525 - protein, 453 aa, Artificial Sequence
  Ligelizumab_HeavyChain1
QVQLVQSGAEVMKPGSSVKVSCKASGYTFSWYWLEWVRQAPGHGLEWMGEIDPGTFTTNYNEKFKARVTFTADTSTSTAYMELSSLRSEDTAVYYCARFSHFSGSNYDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 526 - protein, 214 aa, Artificial Sequence
  Ligelizumab_LightChain1
EIVMTQSPATLSVSPGERATLSCRASQSIGTNIHWYQQKPGQAPRLLIYYASESISGIPARFSGSGSGTEFTLTISSLQSEDFAVYYCQQSWSWPTTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 527 - protein, 443 aa, Artificial Sequence; identical to SEQ ID NO: 75
  Lilotomab_HeavyChain1

SEQ ID NO: 528 - protein, 214 aa, Artificial Sequence; identical to SEQ ID NO: 76
  Lilotomab_LightChain1

SEQ ID NO: 529 - protein, 446 aa, Artificial Sequence
  Lintuzumab_HeavyChain1
QVQLVQSGAEVKKPGSSVKVSCKASGYTFTDYNMHWVRQAPGQGLEWIGYIYPYNGGTGYNQKFKSKATITADESTNTAYMELSSLRSEDTAVYYCARGRPAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 530 - protein, 218 aa, Artificial Sequence
  Lintuzumab_LightChain1
DIQMTQSPSSLSASVGDRVTITCRASESVDNYGISFMNWFQQKPGKAPKLLIYAASNQGSGVPSRFSGSGSGTDFTLTISSLQPDDFATYYCQQSKEVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 531 - protein, 450 aa, Artificial Sequence
  Lirilumab_HeavyChain1
QVQLVQSGAEVKKPGSSVKVSCKASGGTFSFYAISWVRQAPGQGLEWMGGFIPIFGAANYAQKFQGRVTITADESTSTAYMELSSLRSDDTAVYYCARIPSGSYYYDYDMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 532 - protein, 214 aa, Artificial Sequence
  Lirilumab_LightChain1
EIVLTQSPVTLSLSPGERATLSCRASQSVSSYLAWYQQKPGQAPRLLIYDASNRATGIPARFSGSGSGTDFTLTISSLEPEDFAVYYCQQRSNWMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 533 - protein, 448 aa, Artificial Sequence
  Lodelcizumab_HeavyChain1
QVQLVQSGAEVKKPGASVKVSCKASGYTFSTMYMSWVRQAPGQGLEWMGRIDPANEHTNYAQKFQGRVTMTRDTSISTAYMELSRLTSDDTAVYYCARSYYYYNMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 534 - protein, 213 aa, Artificial Sequence
  Lodelcizumab_LightChain1
QIVLTQSPATLSVSPGERATLSCRASQSVSYMHWYQQKPGQAPRLLIYGVFRRATGIPDRFSGSGSGTDFTLTIGRLEPEDFAVYYCLQWSSDPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 535 - protein, 452 aa, Artificial Sequence
  Lokivetmab_HeavyChain1
EVQLVESGGDLVKPGGSLRLSCVASGFTFSNYGMSWVRQAPGKGLQWVATISYGGSYTYYPDNIKGRFTISRDNAKNTLYLQMNSLRAEDTAMYYCVRGYGYDTMDYWGQGTLVTVSSASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPG

SEQ ID NO: 536 - protein, 217 aa, Artificial Sequence
  Lokivetmab_LightChain1
EIVMTQSPASLSLSQEEKVTITCKASQSVSFAGTGLMHWYQQKPGQAPKLLIYRASNLEAGVPSRFSGSGSGTDFSFTISSLEPEDVAVYYCQQSREYPWTFGQGTKLEIKRNDAQPAVYLFQPSPDQLHTGSASVVCLLNSFYPKDINVKWKVDGVIQDTGIQESVTEQDKDSTYSLSSTLTMSSTEYLSHELYSCEITHKSLPSTLIKSFQRSEC

SEQ ID NO: 537 - protein, 448 aa, Artificial Sequence
  Lorvotuzumab_mertansine_HeavyChain1
QVQLVESGGGVVQPGRSLRLSCAASGFTFSSFGMHWVRQAPGKGLEWVAYISSGSFTIYYADSVKGRFTISRDNSKNTLYLQMNSLRAEDTAVYYCARMRKGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 538 - protein, 219 aa, Artificial Sequence
  Lorvotuzumab_mertansine_LightChain1
DVVMTQSPLSLPVTLGQPASISCRSSQIIIHSDGNTYLEWFQQRPGQSPRRLIYKVSNRFSGVPDRFSGSGSGTDFTLKISRVEAEDVGVYYCFQGSHVPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 539 - protein, 112 aa, Artificial Sequence
  Lpathomab_VL
DVVMTQTPLSLPVSLGDQASISCTSGQSLVHINGNTYLHWYLQKPGQSPKLLIYKVSNLFSGVPDRFSGSGSGTDFTLKISRVEAEDLGVYFCSQSTHFPFTFGTGTKLEIK

SEQ ID NO: 540 - protein, 122 aa, Artificial Sequence
  Lpathomab_gamma1-Chain_VDJ-Region
QVQLQQSGAELVRPGTSVKVSCKASGYGFINYLIEWIKQRPGQGLEWIGLINPGSDYTNYNENFKGKATLTADKSSSTAYMHLSSLTSEDSAVYFCARRFGYYGSGNYFDYWGQGTTLTVSS

SEQ ID NO: 541 - protein, 450 aa, Artificial Sequence
  Lucatumumab_HeavyChain1
QVQLVESGGGVVQPGRSLRLSCAASGFTFSSYGMHWVRQAPGKGLEWVAVISYEESNRYHADSVKGRFTISRDNSKITLYLQMNSLRTEDTAVYYCARDGGIAAPGPDYWGQGTLVTVSSASTKGPSVFPLAPASKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 542 - protein, 219 aa, Artificial Sequence
  Lucatumumab_LightChain1
DIVMTQSPLSLTVTPGEPASISCRSSQSLLYSNGYNYLDWYLQKPGQSPQVLISLGSNRASGVPDRFSGSGSGTDFTLKISRVEAEDVGVYYCMQARQTPFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 543 - protein, 108 aa, Artificial Sequence
  Lulizumab_pegol_LightChain1
DIQMTQSPSSLSASVGDRVTITCRASRPIWPFLEWYQQKPGKAPKLLIYFTSRLRHGVPSRFSGSGSGTCFTLTISSLQPEDFATYYCLQNVANPATFSQGTKVEIKR

SEQ ID NO: 544 - protein, 108 aa, Artificial Sequence; identical to SEQ ID NO: 543
  Lulizumab_pegol_LightChain

SEQ ID NO: 545 - protein, 398 aa, Artificial Sequence
  Lumiliximab_HeavyChain1
EVQLVESGGGLAKPGGSLRLSCAASGFRFTFNNYYMDWVRQAPGQGLEWVLTTGSDSWGQGVLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 546 - protein, 214 aa, Artificial Sequence
  Lumiliximab_LightChain1
DIQMTQSPSSLSASVGDRVTITCRASQDIRYYLNWYQQKPGKAPKLLIYVASSLQSGVPSRFSGSGSGTEFTLTVSSLQPEDFATYYCLQVYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 547 - protein, 449 aa, Artificial Sequence
  Lumretuzumab_HeavyChain1
QVQLVQSGAEVKKPGASVKVSCKASGYTFRSSYISWVRQAPGQGLEWMGWIYAGTGSPSYNQKLQGRVTMTTDTSTSTAYMELRSLRSDDTAVYYCARHRDYYSNSLTYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 548 - protein, 220 aa, Artificial Sequence
  Lumretuzumab_LightChain1
DIVMTQSPDSLAVSLGERATINCKSSQSVLNSGNQKNYLTWYQQKPGQPPKLLIYWASTRESGVPDRFSGSGSGTDFTLTISSLQAEDVAVYYCQSDYSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 549 - protein, 443 aa, Artificial Sequence; identical to SEQ ID NO: 75
  Lutetium_(177Lu)_lilotomab_satetraxetan_HeavyChain1

SEQ ID NO: 550 - protein, 214 aa, Artificial Sequence; identical to SEQ ID NO: 76
  Lutetium_(177Lu)_lilotomab_satetraxetan_LightChain1

SEQ ID NO: 551 - protein, 450 aa, Artificial Sequence
  Margetuximab_HeavyChain1
QVQLQQSGPELVKPGASLKLSCTASGFNIKDTYIHWVKQRPEQGLEWIGRIYPTNGYTRYDPKFQDKATITADTSSNTAYLQVSRLTSEDTAVYYCSRWGGDGFYAMDYWGQGASVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELVGGPSVFLLPPKPKDTLMISRTPEVTCVVVDVSHEDPEVKFNWYVDGVEVHNAKTKPPEEQYNSTLRVVSVLTVLHQDWLNGKEYKCKVSNKALPAPIEKTISKAKGQPREPQVYTLPPSRDELTKNQVSLTCLVKGFYPSDIAVEWESNGQPENNYKTTPLVLDSDGSFFLYSKLTVDKSRWQQGNVFSCSVMHEALHNHYTQKSLSLSPGK

SEQ ID NO: 552 - protein, 214 aa, Artificial Sequence
  Margetuximab_LightChain1
DIVMTQSHKFMSTSVGDRVSITCKASQDVNTAVAWYQQKPGHSPKLLIYSASFRYTGVPDRFTGSRSGTDFTFTISSVQAEDLAVYYCQQHYTTPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 553 - protein, 254 aa, Artificial Sequence
  Marzeptacog_alfa_HeavyChain1
IVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVVLTDHVVPLCLPERTFSERTLAFVRFSLVSGWGRLLDRGATALELQVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 554 - protein, 152 aa, Artificial Sequence
  Marzeptacog_alfa_LightChain1
ANAFLEELRPGSLERECKEEQCSFEEAREIFKDAERTKLFWISYSDGDQCASSPCQNGGSCKDQLQSYICFCLPAFEGRNCETHKDDQLICVNENGGCEQYCSDHTGTKRSCRCHEGYSLLADGVSCNATVEYPCGKIPILEKRNASKPQGR

SEQ ID NO: 555 - protein, 223 aa, Artificial Sequence
  Matuzumab_HeavyChain1_variant_3c08_H
QVQLVQSGAEVKKPGASVKVSCKASGYTFTSHWMHWVRQAPGQGLEWIGEFNPSNGRTNYNEKFKSKATMTVDTSTNTAYMELSSLRSEDTAVYYCASRDYDYDGRYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 556 - protein, 223 aa, Artificial Sequence
  Matuzumab_HeavyChain1_variant_3c09_C
QVQLVQSGAEVKKPGASVKVSCKASGYTFTSHWMHWVRQAPGQGLEWIGEFNPSNGRTNYNEKFKSKATMTVDTSTNTAYMELSSLRSEDTAVYYCASRDYDYAGRYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 557 - protein, 212 aa, Artificial Sequence
  Matuzumab_LightChain1_variant_3c08_L
DIQMTQSPSSLSASVGDRVTITCSASSSVTYMYWYQQKPGKAPKLLIYDTSNLASGVPSRFSGSGSGTDYTFTISSLQPEDIATYYCQQWSSHIFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 558 - protein, 212 aa, Artificial Sequence; identical to SEQ ID NO: 557
  Matuzumab_LightChain1_variant_3c09_B

SEQ ID NO: 559 - protein, 447 aa, Artificial Sequence
  Mavrilimumab_HeavyChain1
QVQLVQSGAEVKKPGASVKVSCKVSGYTLTELSIHWVRQAPGKGLEWMGGFDPEENEIVYAQRFQGRVTMTEDTSTDTAYMELSSLRSEDTAVYYCAIVGSFSPLTLGLWGQGTMVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 560 - protein, 217 aa, Artificial Sequence
  Mavrilimumab_LightChain1
QSVLTQPPSVSGAPGQRVTISCTGSGSNIGAPYDVSWYQQLPGTAPKLLIYHNNKRPSGVPDRFSGSKSGTSASLAITGLQAEDEADYYCATVEAGLSGSVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 561 - protein, 453 aa, Artificial Sequence
  MDX-1303_HeavyChain1
QVQLVESGGGVVQPGRSLRLSCAASGFTFSYYGMHWVRQAPGKGLEWVAVIWHDESIVYYADSVKGRFTISRDNSKNTLYLQMNSLRAEDTAVYYCTRDPGDPYYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 562 - protein, 215 aa, Artificial Sequence
  MDX-1303_LightChain1
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 563 - protein, 449 aa, Artificial Sequence
  Mepolizumab_HeavyChain1
QVTLRESGPALVKPTQTLTLTCTVSGFSLTSYSVHWVRQPPGKGLEWLGVIWASGGTDYNSALMSRLSISKDTSRNQVVLTMTNMDPVDTATYYCARDPPSSLLRLDYWGRGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 564 - protein, 220 aa, Artificial Sequence
  Mepolizumab_LightChain1
DIVMTQSPDSLAVSLGERATINCKSSQSLLNSGNQKNYLAWYQQKPGQPPKLLIYGASTRESGVPDRFSGSGSGTDFTLTISSLQAEDVAVYYCQNVHSFPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 565 - protein, 450 aa, Artificial Sequence
  Metelimumab_HeavyChain1
EVQLVESGGGVVQPGRSLRLSCAASGFTFSSYGMHWVRQAPGKELEWVAVISYDGSIKYYADSVKGRFTISRDNSKNTLYLQMNSLRAEDTAVYYCARTGEYSGYDTDPQYSWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKPTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 566 - protein, 213 aa, Artificial Sequence
  Metelimumab_LightChain1
EIVLTQSPSSLSASVGDRVTITCRASQGIGDDLGWYQQKPGKAPILLIYGTSTLQSGVPSRFSGSGSGTDFTLTINSLQPEDFATYYCLQDSNYPLTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSPVTKSFNRGEC

SEQ ID NO: 567 - protein, 450 aa, Artificial Sequence
  Milatuzumab_HeavyChain1
QVQLQQSGSELKKPGASVKVSCKASGYTFTNYGVNWIKQAPGQGLQWMGWINPNTGEPTFDDDFKGRFAFSLDTSVSTAYLQISSLKADDTAVYFCSRSRGKNEAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 568 - protein, 219 aa, Artificial Sequence
  Milatuzumab_LightChain1
DIQLTQSPLSLPVTLGQPASISCRSSQSLVHRNGNTYLHWFQQRPGQSPRLLIYTVSNRFSGVPDRFSGSGSGTDFTLKISRVEAEDVGVYFCSQSSHVPPTFGAGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 569 - protein, 447 aa, Artificial Sequence
  Mirvetuximab_HeavyChain1
QVQLVQSGAEVVKPGASVKISCKASGYTFTGYFMNWVKQSPGQSLEWIGRIHPYDGDTFYNQKFQGKATLTVDKSSNTAHMELLSLTSEDFAVYYCTRYDGSRAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 570 - protein, 218 aa, Artificial Sequence
  Mirvetuximab_LightChain1
DIVLTQSPLSLAVSLGQPAIISCKASQSVSFAGTSLMHWYHQKPGQQPRLLIYRASNLEAGVPDRFSGSGSKTDFTLTISPVEAEDAATYYCQQSREYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 571 - protein, 448 aa, Artificial Sequence
  Modotuximab_HeavyChain1
QVQLQQPGAELVEPGGSVKLSCKASGYTFTSHWMHWVKQRPGQGLEWIGEINPSSGRNNYNEKFKSKATLTVDKSSSTAYMQFSSLTSEDSAVYYCVRYYGYDEAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 572 - protein, 219 aa, Artificial Sequence
  Modotuximab_LightChain1
DIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 573 - protein, 449 aa, Artificial Sequence
  Mogamulizumab_HeavyChain1
EVQLVESGGDLVQPGRSLRLSCAASGFIFSNYGMSWVRQAPGKGLEWVATISSASTYSYYPDSVKGRFTISRDNAKNSLYLQMNSLRVEDTALYYCGRHSDGNFAFGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 574 - protein, 219 aa, Artificial Sequence
  Mogamulizumab_LightChain1
DVLMTQSPLSLPVTPGEPASISCRSSRNIVHINGDTYLEWYLQKPGQSPQLLIYKVSNRFSGVPDRFSGSGSGTDFTLKISRVEAEDVGVYYCFQGSLLPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 575 - protein, 452 aa, Artificial Sequence
  Monalizumab_HeavyChain1
QVQLVQSGAEVKKPGASVKVSCKASGYTFTSYWMNWVRQAPGQGLEWMGRIDPYDSETHYAQKLQGRVTMTTDTSTSTAYMELRSLRSDDTAVYYCARGGYDFDVGTLYWFFDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 576 - protein, 214 aa, Artificial Sequence
  Monalizumab_LightChain1
DIQMTQSPSSLSASVGDRVTITCRASENIYSYLAWYQQKPGKAPKLLIYNAKTLAEGVPSRFSGSGSGTDFTLTISSLQPEDFATYYCQHHYGTPRTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 577 - protein, 450 aa, Artificial Sequence
  Motavizumab_HeavyChain
QVTLRESGPALVKPTQTLTLTCTFSGFSLSTAGMSVGWIRQPPGKALEWLADIWWDDKKHYNPSLKDRLTISKDTSKNQVVLKVTNMDPADTATYYCARDMIFNFYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 578 - protein, 450 aa, Artificial Sequence; identical to SEQ ID NO: 577
  Motavizumab_HeavyChain_variant

SEQ ID NO: 579 - protein, 213 aa, Artificial Sequence
  Motavizumab_LightChain
DIQMTQSPSTLSASVGDRVTITCSASSRVGYMHWYQQKPGKAPKLLIYDTSKLASGVPSRFSGSGSGTEFTLTISSLQPDDFATYYCFQGSGYPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 580 - protein, 213 aa, Artificial Sequence; identical to SEQ ID NO: 579
  Motavizumab_LightChain_variant

SEQ ID NO: 581 - protein, 476 aa, Artificial Sequence
  Moxetumomab_pasudotox_HeavyChain1
MEVQLVESGGGLVKPGGSLKLSCAASGFAFSIYDMSWVRQTPEKCLEWVAYISSGGGTTYYPDTVKGRFTISRDNAKNTLYLQMSSLKSEDTAMYYCARHSGYGTHWGVLFAYWGQGTLVTVSAKASGGPEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAANGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTSLTLAAPEAAGEVERLIGHPLPLRLDAITGPEEEGGRLETILGWPLAERTVVIPSAIPTDPRNVGGDLDPSSIPDKEQAISALPDYASQPGKPPREDLK

SEQ ID NO: 582 - protein, 108 aa, Artificial Sequence
  Moxetumomab_pasudotox_LightChain1
MDIQMTQTTSSLSASLGDRVTISCRASQDISNYLNWYQQKPDGTVKLLIYYTSILHSGVPSRFSGSGSGTDYSLTISNLEQEDFATYFCQQGNTLPWTFGCGTKLEIK

SEQ ID NO: 583 - protein, 450 aa, Artificial Sequence
  Muromonab-CD3_HeavyChain
QVQLQQSGAELARPGASVKMSCKASGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSAKTTAPSVYPLAPVCGGTTGSSVTLGCLVKGYFPEPVTLTWNSGSLSSGVHTFPAVLQSDLYTLSSSVTVTSSTWPSQSITCNVAHPASSTKVDKKIEPRPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 584 - protein, 213 aa, Artificial Sequence
  Muromonab-CD3_LightChain
QIVLTQSPAIMSASPGEKVTMTCSASSSVSYMNWYQQKSGTSPKRWIYDTSKLASGVPAHFRGSGSGTSYSLTISGMEAEDAATYYCQQWSSNPFTFGSGTKLEINRADTAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 585 - protein, 449 aa, Artificial Sequence
  Namilumab_HeavyChain1
QVQLVQSGAEVKKPGASVKVSCKAFGYPFTDYLLHWVRQAPGQGLEWVGWLNPYSGDTNYAQKFQGRVTMTRDTSISTAYMELSRLRSDDTAVYYCTRTTLISVYFDYWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 586 - protein, 214 aa, Artificial Sequence
  Namilumab_LightChain1
DIQMTQSPSSVSASVGDRVTIACRASQNIRNILNWYQQRPGKAPQLLIYAASNLQSGVPSRFSGSGSGTDFTLTINSLQPEDFATYYCQQSYSMPRTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 587 - protein, 458 aa, Artificial Sequence
  Naptumomab_estafenatox_HeavyChain
EVQLQQSGPDLVKPGASVKISCKASGYSFTGYYMHWVKQSPGKGLEWIGRINPNNGVTLYNQKFKDKATLTVDKSSTTAYMELRSLTSEDSAVYYCARSTMITNYVMDYWGQGTSVTVSSAKTTPPSVYPLAPGSAAQTNSMVTLGCLVKGYFPEPVTVTWNSGSLSSGVHTFPAVLQSDLYTLSSSVTVPSSTWPSETVTCNVAHPASSTKVDKKIVPRDSGGPSEKSEEINEKDLRKKSELQGTALGNLKQIYYYNSKAITSSEKSADQFLTNTLLFKGFFTGHPWYNDLLVDLGSTAATSEYEGSSVDLYGAYYGYQCAGGTPNKTACMYGGVTLHDNNRLTEEKKVPINLWIDGKQTTVPIDKVKTSKKEVTVQELDLQARHYLHGKFGLYNSDSFGGKVQRGLIVFHSSEGSTVSYDLFDAQGQYPDTLLRIYRDNTTISSTSLSISLYLYTT

SEQ ID NO: 588 - protein, 214 aa, Artificial Sequence
  Naptumomab_estafenatox_LightChain
SIVMTQTPTSLLVSAGDRVTITCKASQSVSNDVAWYQQKPGQSPKLLISYTSSRYAGVPDRFSGSGYGTDFTLTISSVQAEDAAVYFCQQDYNSPPTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNES

SEQ ID NO: 589 - protein, 452 aa, Artificial Sequence
  Narnatumab_HeavyChain1
EVQLVESGGGLVQPGGSLRLSCAASGFTFSSYLMTWVRQAPGKGLEWVANIKQDGSEKYYVDSVKGRFTISRDNAKNSLNLQMNSLRAEDTAVYYCTRDGYSSGRHYGMDVWGQGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 590 - protein, 214 aa, Artificial Sequence
  Narnatumab_LightChain1
EIVLTQSPATLSLSPGERATLSCRASQSVSRYLAWYQQKPGQAPRLLIYDASNRATGIPARFSGSGSGTDFTLTISSLEPEDFAVYYCQQRSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 591 - protein, 450 aa, Artificial Sequence
  Natalizumab_HeavyChain1
QVQLVQSGAEVKKPGASVKVSCKASGFNIKDTYIHWVRQAPGQRLEWMGRIDPANGYTKYDPKFQGRVTITADTSASTAYMELSSLRSEDTAVYYCAREGYYGNYGVYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 592 - protein, 213 aa, Artificial Sequence
  Natalizumab_LightChain1
DIQMTQSPSSLSASVGDRVTITCKTSQDINKYMAWYQQTPGKAPRLLIHYTSALQPGIPSRFSGSGSGRDYTFTISSLQPEDIATYYCLQYDNLWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 593 - protein, 445 aa, Artificial Sequence
  Navicixizumab_HeavyChain1
QVQLVQSGAEVKKPGASVKISCKASGYSFTAYYIHWVKQAPGQGLEWIGYISNYNRATNYNQKFKGRVTFTTDTSTSTAYMELRSLRSDDTAVYYCARDYDYDVGMDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVEGFYPSDIAVEWESNGQPENNYKTTPPMLDSDGSFFLYSELTVDKSRWQQGNVFSCSVMHEALHNHYTQKSLSLSPGK

SEQ ID NO: 594 - protein, 447 aa, Artificial Sequence
  Navicixizumab_HeavyChain2
QVQLVQSGAEVKKPGASVKVSCKASGYTFTNYWMHWVRQAPGQGLEWMGDINPSNGRTSYKEKFKRRVTLSVDKSSSTAYMELSSLRSEDTAVYFCTIHYDDKYYPLMDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREKMTKNQVSLTCLVKGFYPSDIAVEWESNGQPENNYKTTPPMLKSDGSFFLYSKLTVDKSRWQQGNVFSCSVMHEALHNHYTQKSLSLSPGK

SEQ ID NO: 595 - protein, 218 aa, Artificial Sequence; identical to SEQ ID NO: 199
  Navicixizumab_LightChain1

SEQ ID NO: 596 - protein, 456 aa, Artificial Sequence
  Navivumab_HeavyChain1
QVQLVQSGAEVKKPGASVKVSCKTSGYSFSTYGVSWVRQAPGQGPEWVGWISAYTGITDYAQKFQGRVTLTTDATTATAFLDLRSLRPDDTATYFCARDKVQGRVEVGSGGRHDYWGQGTLVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 597 - protein, 215 aa, Artificial Sequence
  Navivumab_LightChain1
EVVLTQSPGTLALPPGERATLSCRASHRVGSTYIAWYQQKSGQAPRRLIYGASNRATDIPDRFSGSGSGTDFTLTIRRLEPEDSAVYYCQQFSVSPWTFGQGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 598 - protein, 724 aa, Artificial Sequence
  Ndimab-varB_HeavyChain
QVQLVESGGGVVQPGRSLRLSCAASGFIFSSYAMHWVRQAPGNGLEWVAFMSYDGSNKKYADSVKGRFTISRDNSKNTLYLQMNSLRAEDTAVYYCARDRGISAGGNYYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKGGGGSGGGGSQVQLVQSGAEVKKPGSSVKVSCKASGGTFSTYGISWVRQAPGQCLEWMGGIIPIFDTGNSAQSFQGRVTITADESTSTAYMELSSLRSEDTAVYYCARSSRIYDLNPSLTAYYDMDVWGQGTMVTVSSGGGGSGGGGSGGGGSGGGGSQSVLTQPPSVSAAPGQKVTISCSGSSSNIGNNYVSWYQQLPGTAPKLLIYDNNKRPSGIPDRFSGSKSGTSATLGITGLQTGDEADYYCGTWDSSLSAWVFGCGTKLTVL

SEQ ID NO: 599 - protein, 215 aa, Artificial Sequence
  Ndimab-varB_LightChain
EIVLTQSPATLSLSPGERATLSCRASQSVYSYLAWYQQKPGQAPRLLIYDASNRAIGIPARFSGSGSGTDFTLTISSLEPEDFAVYYCQQRSNWPPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 600 - protein, 451 aa, Artificial Sequence
  Necitumumab_HeavyChain1
QVQLQESGPGLVKPSQTLSLTCTVSGGSISSGDYYWSWIRQPPGKGLEWIGYIYYSGSTDYNPSLKSRVTMSVDTSKNQFSLKVNSVTAADTAVYYCARVSIFGVGTFDYWGQGTLVTVSSASTKGPSVLPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 601 - protein, 214 aa, Artificial Sequence
  Necitumumab_LightChain1
EIVMTQSPATLSLSPGERATLSCRASQSVSSYLAWYQQKPGQAPRLLIYDASNRATGIPARFSGSGSGTDFTLTISSLEPEDFAVYYCHQYGSTPLTFGGGTKAEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 602 - protein, 132 aa, Artificial Sequence
  Neliximab_HeavyChain_VH-Region
EVQLQQSGPELVKPGASVKMSCKASGYTFTTYVMHWVKQKPGQGLEWIGYINPYNDGTNYNEKFKGKATLTSDKSSSTAYMELSTLTSEDSAVYYCAEFITKTVGGSNWYLDVWGAGTTVTVSSAKTTPPKL

SEQ ID NO: 603 - protein, 124 aa, Artificial Sequence
  Neliximab_HeavyChain_VH-Region_variant1
QVQLKQSGPELVKPGASVKMSCKASGYTFTTYVMHWVKQKPGQGLEWIGYINPYNDGTNYNEKFKGKATLTSDKSSSTAYMELSTLTSEDSAVYYCAEFITKTVGGSNWYLDVWGAGTTVTVSS

SEQ ID NO: 604 - protein, 106 aa, Artificial Sequence
  Neliximab_LightChain_VL-Region
DIVLTQSPAIMSASPGEKVTMTCSASSSISYIHWFQQKPGTSPKRWIYDTSKLPSGVPARFSGSGSGTSYSLTISSMEAEDAATYYCHQRSSYTWTFGGGTKLEIK

SEQ ID NO: 605 - protein, 118 aa, Artificial Sequence
  Neliximab_LightChain_VL-Region_variant1
QIVLTQSPAIMSASPGEKVTMTCSASSSISYIHWFQQKPGTSPKRWIYDTSKLPSGVPARFSGSGSGTSYSLTISSMEAEDAATYYCHQRSSYTWTFGGGTKLEIKRADAAPTVSAAA

SEQ ID NO: 606 - protein, 445 aa, Artificial Sequence
  Nemolizumab_HeavyChain1
QVQLVQSGAEVKKPGASVKVSCKASGYTFTGYIMNWVRQAPGQGLEWMGLINPYNGGTDYNPQFQDRVTITADKSTSTAYMELSSLRSEDTAVYYCARDGYDDGPYTLETWGQGTLVTVSSASTKGPSVFPLAPSSKSTSGGTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSQEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESNGQPENNYKTTPPMLDSDGSFFLYSKLTVDKSRWQEGNVFSCSVMHEALHNHYTQKSLSLSP

SEQ ID NO: 607 - protein, 214 aa, Artificial Sequence
  Nemolizumab_LightChain1
DIQMTQSPSSLSASVGDRVTITCQASEDIYSFVAWYQQKPGKAPKLLIYNAQTEAQGVPSRFSGSGSGTDFTLTISSLQPEDFATYYCQHHYDSPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 608 - protein, 452 aa, Artificial Sequence
  Nesvacumab_HeavyChain1
EVQLVESGGGLVQPGGSLRLSCAASGFTFSSYDIHWVRQATGKGLEWVSAIGPAGDTYYPGSVKGRFTISRENAKNSLYLQMNSLRAGDTAVYYCARGLITFGGLIAPFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 609 - protein, 214 aa, Artificial Sequence
  Nesvacumab_LightChain1
EIVLTQSPGTLSLSPGERATLSCRASQSVSSTYLAWYQQKPGQAPRLLIYGASSRATGIPDRFSGSGSGTDFTLTISRLEPEDFAVYYCQHYDNSQTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 610 - protein, 454 aa, Artificial Sequence
  Neuradiab_HeavyChain1
EVQLQQSGPELVKPGASVKMSCKASGYTFTSYVVHWVKQNPGQGLEWIGYINPFNDGTKYNENFKCKATLTSDRSSSTAYMELSSLTSEESAVYFCARDMGREGFAYWGQGTLVTVSAAKTTPPSVYPLAPGCGDTTGSSVTLGCLVKGYFPESVTVTWNSGSLSSSVHTFPALLQSGLYTMSSSVTVPSSTWPSQIVICSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 611 - protein, 219 aa, Artificial Sequence
  Neuradiab_LightChain1
DIVMTQAAFSNPVTLGTSASISCRSSKSLLHSNGITYLYWYLQKPGQSPQLLIYQMSNLASGVPDRFSSSGSGTDFTLRISRVEAEDVGVYYCAQNLELPRTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 612 - protein, 123 aa, Artificial Sequence
  Nimotuzumab_HeavyChain1
QVQLQQSGAEVKKPGSSVKVSCKASGYTFTNYYIYWVRQAPGQGLEWIGGINPTSGGSNFNEKFKTRVTITVDESTNTAYMELSSLRSEDTAFYFCARQGLWFDSDGRGFDFWGQGSTVTVSS

SEQ ID NO: 613 - protein, 114 aa, Artificial Sequence
  Nimotuzumab_LightChain1
DIQMTQSPSSLSASVGDRVTITCRSSQNIVHSNGNTYLDWYQQTPGKAPKLLIYKVSNRFSGVPSRFSGSGSGTDFTFTISSLQPEDIATYYCFQYSHVPWTFGQGTKLQITRE

SEQ ID NO: 614 - protein, 440 aa, Artificial Sequence
  Nivolumab_HeavyChain1
QVQLVESGGGVVQPGRSLRLDCKASGITFSNSGMHWVRQAPGKGLEWVAVIWYDGSKRYYADSVKGRFTISRDNSKNTLFLQMNSLRAEDTAVYYCATNDDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 615 - protein, 214 aa, Artificial Sequence
  Nivolumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQSSNWPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 616 - protein, 449 aa, Artificial Sequence
  Obiltoxaximab_HeavyChain1
QVQLQQSGPELKKPGASVKVSCKDSGYAFSSSWMNWVRQAPGQGLEWIGRIYPGDGDTNYNGKFQGRVTITADKSSSTAYMELSSLRSEDTAVYFCARSGLLRYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 617 - protein, 214 aa, Artificial Sequence
  Obiltoxaximab_LightChain1
DIQMTQSPSSLSASVGDRVTITCRASQDIRNYLNWYQQKPGKAVKLLIYYTSRLLPGVPSRFSGSGSGTDYSLTISSQEQEDIGTYFCQQGNTLPWTFGQGTKVEIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 618 - protein, 449 aa, Artificial Sequence; identical to SEQ ID NO: 22
  Obinutuzumab_HeavyChain1

SEQ ID NO: 619 - protein, 219 aa, Artificial Sequence; identical to SEQ ID NO: 23
  Obinutuzumab_LightChain1

SEQ ID NO: 620 - protein, 450 aa, Artificial Sequence
  Ocaratuzumab_HeavyChain1
EVQLVQSGAEVKKPGESLKISCKGSGRTFTSYNMHWVRQMPGKGLEWMGAIYPLTGDTSYNQKSKLQVTISADKSISTAYLQWSSLKASDTAMYYCARSTYVGGDWQFDVWGKGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKIKDTLMISRTPEVTCVVVDVSHEDPEVKFNWYVDGVEVHNAKTKPREEQYNSTYRVVSVLTVLHQDWLNGKEYKCKVSNKALPAPIEKTISKQKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 621 - protein, 213 aa, Artificial Sequence
  Ocaratuzumab_LightChain1
EIVLTQSPGTLSLSPGERATLSCRASSSVPYIHWYQQKPGQAPRLLIYATSALASGIPDRFSGSGSGTDFTLTISRLEPEDFAVYYCQQWLSNPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 622 - protein, 452 aa, Artificial Sequence
  Ocrelizumab_HeavyChain1
EVQLVESGGGLVQPGGSLRLSCAASGYTFTSYNMHWVRQAPGKGLEWVGAIYPGNGDTSYNQKFKGRFTISVDKSKNTLYLQMNSLRAEDTAVYYCARVVYYSNSYWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 623 - protein, 213 aa, Artificial Sequence
  Ocrelizumab_LightChain1
DIQMTQSPSSLSASVGDRVTITCRASSSVSYMHWYQQKPGKAPKPLIYAPSNLASGVPSRFSGSGSGTDFTLTISSLQPEDFATYYCQQWSFNPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 624 - protein, 452 aa, Artificial Sequence
  Ofatumumab_HeavyChain1
EVQLVESGGGLVQPGRSLRLSCAASGFTFNDYAMHWVRQAPGKGLEWVSTISWNSGSIGYADSVKGRFTISRDNAKKSLYLQMNSLRAEDTALYYCAKDIQYGNYYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 625 - protein, 214 aa, Artificial Sequence
  Ofatumumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQRSNWPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 626 - protein, 457 aa, Artificial Sequence
  Olaratumab_HeavyChain1
QLQLQESGPGLVKPSETLSLTCTVSGGSINSSSYYWGWLRQSPGKGLEWIGSFFYTGSTYYNPSLRSRLTISVDTSKNQFSLMLSSVTAADTAVYYCARQSTYYYGSGNYYGWFDRWDQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 627 - protein, 214 aa, Artificial Sequence
  Olaratumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQRSNWPPAFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 628 - protein, 447 aa, Artificial Sequence
  Olizuab_HeavyChain1
EVQLVESGGGLVQPGGSLRLSCAVSGYSITSGYSWNWIRQAPGKGLEWVASITYDGSTNYNPSVKGRITISRDDSKNTFYLQNSLRAEDTAVYYCARGSHYFGHWHFAVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPGK

SEQ ID NO: 629 - protein, 217 aa, Artificial Sequence
  Olizuab_LightChain1
DIQLTQSPSSLSASVGDRVTITCRASQSVDYDGDSYNWYQQKPGKAPKLLIYAASYLESGVPSRFSGSGSGTDFTLTISSLQPEDFATYYCQQSHEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 630 - protein, 447 aa, Artificial Sequence
  Olokizumab_HeavyChain1
EVQLVESGGGLVQPGGSLRLSCAASGFNFNDYFMNWVRQAPGKGLEWVAQMRNKNYQYGTYYAESLEGRFTISRDDSKNSLYLQMNSLKTEDTAVYYCARESYYGFTSYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 631 - protein, 214 aa, Artificial Sequence
  Olokizumab_LightChain1
DIQMTQSPSSLSASVGDRVTITCQASQDIGISLSWYQQKPGKAPKLLIYNANNLADGVPSRFSGSGSGTDFTLTISSLQPEDFATYYCLQHNSAPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 632 - protein, 447 aa, Artificial Sequence
  Omalizumab_HeavyChain
EVQLVESGGGLVQPGGSLRLSCAVSGYSITSGYSWNWIRQAPGKGLEWVASITYDGSTNYADSVKGRFTISRDDSKNTFYLQMNSLRAEDTAVYYCARGSHYFGHWHFAVWGQGTLVTVSSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 633 - protein, 215 aa, Artificial Sequence
  Omalizumab_LightChain
DIQLTQSPSSLSASVGDRVTITCRASQSVDYDGDSYMNWYQQKPGKAPKLLIYAASYLESGVPSRFSGSGSGTDFTLTISSLQPEDFATYYCQQSHEDPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 634 - protein, 449 aa, Artificial Sequence
  Onartuzumab_HeavyChain1
EVQLVESGGGLVQPGGSLRLSCAASGYTFTSYWLHWVRQAPGKGLEWVGMIDPSNSDTRFNPNFKDRFTISADTSKNTAYLQMNSLRAEDTAVYYCATYRSYVTPLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 635 - protein, 227 aa, Artificial Sequence
  Onartuzumab_HeavyChain2
DKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 636 - protein, 220 aa, Artificial Sequence
  Onartuzumab_LightChain1
DIQMTQSPSSLSASVGDRVTITCKSSQSLLYTSSQKNYLAWYQQKPGKAPKLLIYWASTRESGVPSRFSGSGSGTDFTLTISSLQPEDFATYYCQQYYAYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 637 - protein, 454 aa, Artificial Sequence
  Ontuxizumab_HeavyChain1
QVQLQESGPGLVRPSQTLSLTCTASGYTFTDYVIHWVKQPPGRGLEWIGYINPYDDDTTYNQKFKGRVTMLVDTSSNTAYLRLSSVTAEDTAVYYCARRGNSYDGYFDYSMDYWGSGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGFFFLYSKLTVDKSRWQQGNVFSCSVMHEALHNHYTQKSLSLSPGK

SEQ ID NO: 638 - protein, 215 aa, Artificial Sequence
  Ontuxizumab_LightChain1
DIQMTQSPSSLSASVGDRVTITCRASQNVGTAVAWLQQTPGKAPKLLIYSASNRYTGVPSRFSGSGSGTDYTFTISSLQPEDIATYYCQQYTNYPMYTFGQGTKVQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 639 - protein, 447 aa, Artificial Sequence
  Opicinumab_HeavyChain1
EVQLLESGGGLVQPGGSLRLSCAASGFTFSAYEMKWVRQAPGKGLEWVSVIGPSGGFTFYADSVKGRFTISRDNSKNTLYLQMNSLRAEDTAVYYCATEGDNDAFDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSAYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 640 - protein, 215 aa, Artificial Sequence
  Opicinumab_LightChain1
DIQMTQSPATLSLSPGERATLSCRASQSVSSYLAWYQQKPGQAPRLLIYDASNRATGIPARFSGSGSGTDFTLTISSLEPEDFAVYYCQQRSNWPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 641 - protein, 647 aa, Artificial Sequence
  Oportuzumab_monatox_HeavyChain1
HHHHHHDIQMTQSPSSLSASVGDRVTITCRSTKSLLHSNGITYLYWYQQKPGKAPKLLIYQMSNLASGVPSRFSSSGSGTDFTLTISSLQPEDFATYYCAQNLEIPRTFGQGTKVELKRATPSHNSHQVPSAGGPTANSGTSGSEVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSEFGGAPEFPKPSTPPGSSGLEGGSLAALTAHQACHLPLETFTRHRQPRGWEQLEQCGYPVQRLVALYLAARLSWNQVDQVIRNALASPGSGGDLGEAIREQPEQARLALTLAAAESERFVRQGTGNDEAGAASADVVSLTCPVAAGECAGPADSGDALLERNYPTGAEFLGDGGDVSFSTRGTQNWTVERLLQAHRQLEERGYVFVGYHGTFLEAAQSIVFGGVRARSQDLDAIWRGFYIAGDPALAYGYAQDQEPDARGRIRNGALLRVYVPRSSLPGFYRTGLTLAAPEAAGEVERLIGHPLPLRLDAITGPEEEGGRLETILGWPLAERTVVIPSAIPTDPRNVGGDLDPSSIPDKEQAISALPDYASQPGKPPHHHHHHKDEL

SEQ ID NO: 642 - protein, 647 aa, Artificial Sequence; identical to SEQ ID NO: 641
  Oportuzumab_monatox_SingleChain_variable_fragment

SEQ ID NO: 643 - protein, 254 aa, Artificial Sequence
  Oreptacog_alfa_HeavyChain1
IVGGKVCPKGECPWQVLLLVNGAQLCGGTLINTIWVVSAAHCFDKIKNWRNLIAVLGEHDLSEHDGDEQSRRVAQVIIPSTYVPGTTNHDIALLRLHQPVNLTDHVVPLCLPERTFSERTLAFVRFSLVSGWGQLLDRGATALELMVLNVPRLMTQDCLQQSRKVGDSPNITEYMFCAGYSDGSKDSCKGDSGGPHATHYRGTWYLTGIVSWGQGCATVGHFGVYTRVSQYIEWLQKLMRSEPRPGVLLRAPFP

SEQ ID NO: 644 - protein, 152 aa, Artificial Sequence
  Oreptacog_alfa_LightChain1
ANAFLEELRQGSLERECKEEQCSFEEAREIFEDEEETKLFWISYSDGDQCASSPCQNGGSCKDQLQSYICFCLPAFEGRNCETHKDDQLICVNENGGCEQYCSDHNGTKRSCRCHEGYSLLADGVSCTPTVEYPCGKIPILEKRNASKPQGR

SEQ ID NO: 645 - protein, 451 aa, Artificial Sequence
  Orticumab_HeavyChain1
EVQLLESGGGLVQPGGSLRLSCAASGFTFSNAWMSWVRQAPGKGLEWVSSISVGGHRTYYADSVKGRSTISRDNSKNTLYLQMNSLRAEDTAVYYCARIRVGPSGGAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 646 - protein, 216 aa, Artificial Sequence
  Orticumab_LightChain1
QSVLTQPPSASGTPGQRVTISCSGSNTNIGKNYVSWYQQLPGTAPKLLIYANSNRPSGVPDRFSGSKSGTSASLAISGLRSEDEADYYCASWDASLNGWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 647 - protein, 449 aa, Artificial Sequence
  Otelixizumab_HeavyChain1
EVQLLESGGGLVQPGGSLRLSCAASGFTFSSFPMAWVRQAPGKGLEWVSTISTSGGRTYYRDSVKGRFTISRDNSKNTLYLQMNSLRAEDTAVYYCAKFRQYSGGFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 648 - protein, 216 aa, Artificial Sequence
  Otelixizumab_LightChain1
DIQLTQPNSVSTSLGSTVKLSCTLSSGNIENNYVHWYQLYEGRSPTTMIYDDDKRPDGVPDRFSGSIDRSSNSAFLTIHNVAIEDEAIYFCHSYVSSFNVFGGGTKLTVLRQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 649 - protein, 483 aa, Artificial Sequence
  Otlertuzumab_HeavyChain1
EVQLVQSGAEVKKPGESLKISCKGSGYSFTGYNMNWVRQMPGKGLEWMGNIDPYYGGTTYNRKFKGQVTISADKSISTAYLQWSSLKASDTAMYYCARSVGPFDSWGQGTLVTVSSGGGGSGGGGSGGGGSGGGGSGGGGSEIVLTQSPATLSLSPGERATLSCRASENVYSYLAWYQQKPGQAPRLLIYFAKTLAEGIPARFSGSGSGTDFTLTISSLEPEDFAVYYCQHHSDNPWTFGQGTKVEIKGDQEPKSSDKTHTSPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 650 - protein, 449 aa, Artificial Sequence
  Oxelumab_HeavyChain1
EVQLLESGGGLVQPGGSLRLSCAASGFTFNSYAMSWVRQAPGKGLEWVSIISGSGGFTYYADSVKGRFTISRDNSRTTLYLQMNSLRAEDTAVYYCAKDRLVAPGTFDYWGQGALVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 651 - protein, 214 aa, Artificial Sequence
  Oxelumab_LightChain1
DIQMTQSPSSLSASVGDRVTITCRASQGISSWLAWYQQKPEKAPKSLIYAASSLQSGVPSRFSGSGSGTDFTLTISSLQPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 652 - protein, 443 aa, Artificial Sequence
  Ozanezumab_HeavyChain1
QVQLVQSGAEVKKPGASVKVSCKASGYTFTSYWMHWVRQAPGQGLEWIGNINPSNGGTNYNEKFKSKATMTRDTSTSTAYMELSSLRSEDTAVYYCELMQGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 653 - protein, 219 aa, Artificial Sequence
  Ozanezumab_LightChain1
DIVMTQSPLSNPVTLGQPVSISCRSSKSLLYKDGKTYLNWFLQRPGQSPQLLIYLMSTRASGVPDRFSGGGSGTDFTLKISRVEAEDVGVYYCQQLVEYPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 654 - protein, 363 aa, Artificial Sequence
  Ozoralizumab_HeavyChain1
EVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVSSGGGGSGGGSEVQLVESGGGLVQPGNSLRLSCAASGFTFSSFGMSWVRQAPGKGLEWVSSISGSGSDTLYADSVKGRFTISRDNAKTTLYLQMNSLRPEDTAVYYCTIGGSLSRSSQGTLVTVSSGGGGSGGGSEVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTVSS

SEQ ID NO: 655 - protein, 450 aa, Artificial Sequence
  Palivizumab_HeavyChain
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 656 - protein, 213 aa, Artificial Sequence
  Palivizumab_LightChain
DIQMTQSPSTLSASVGDRVTITCKCQLSVGYMHWYQQKPGKAPKLLIYDTSKLASGVPSRFSGSGSGTEFTLTISSLQPDDFATYYCFQGSGYPFTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 657 - protein, 120 aa, Artificial Sequence
  Palivizumab_VH-Region
QVTLRESGPALVKPTQTLTLTCTFSGFSLSTSGMSVGWIRQPPGKALEWLADIWWDDKKDYNPSLKSRLTISKDTSKNQVVLKVTNMDPADTATYYCARSMITNWYFDVWGAGTTVTVSS

SEQ ID NO: 658 - protein, 449 aa, Artificial Sequence; identical to SEQ ID NO: 294
  Pamrevlumab_HeavyChain1

SEQ ID NO: 659 - protein, 214 aa, Artificial Sequence; identical to SEQ ID NO: 295
  Pamrevlumab_LightChain1

SEQ ID NO: 660 - protein, 435 aa, Artificial Sequence
  Panitumumab_HeavyChain1
QVQLQESGPGLVKPSETLSLTCTVSGGSVSSGDYYWTWIRQSPGKGLEWIGHIYYSGNTNYNPSLKSRLTISIDTSKTQFSLKLSSVTAADTAIYYCVRDRVTGAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDERKCCVECPAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 661 - protein, 214 aa, Artificial Sequence
  Panitumumab_LightChain1
DIQMTQSPSSLSASVGDRVTITCQASQDISNYLNWYQQKPGKAPKLLIYDASNLETGVPSRFSGSGSGTDFTFTISSLQPEDIATYFCQHFDHLPLAFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 662 - protein, 442 aa, Artificial Sequence
  Pankoab_HeavyChain1
EVQLVESGGGLVQPGGSRLSCVASGFPFSNYWNWVRQAPGKGLEWVGEIRLKSNNYTTHYAESVKGRFTISRDDSKNSLYLQNSLKTEDTAVYYCTRHYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVHEGLHNHYTQKSLSLSPGK

SEQ ID NO: 663 - protein, 217 aa, Artificial Sequence
  Pankoab_LightChain1
DIVTQSPLSNPVTPGEPASISCRSSKSLLHSNGITYFFWYLQKPGQSPQLLIYQSNLASGVPDRFSGSGSGTDFTLRISRVEAEDVGVYYCAQNLELPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 664 - protein, 217 aa, Artificial Sequence
  Pankoab_LightChain2
DIVTQSPLSNPVTPGEPASISCRSSKSLLHSNGITYFFWYLQKPGQSPQLLIYQSNLASGVPDRFSGSGSGTDFTLRISRVEAEDVGVYYCAGNLELPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 665 - protein, 117 aa, Artificial Sequence
  PankoMab_HeavyChain_VDJ-Region
EVKLVESGGGLVQPGGSMKLSCVASGFTFSNYWMNWVRQSPEKGLEWVAEIRLKSNNYTTHYAESVKGRFTISRDDSKSSVSLQMNNLRVEDTGIYYCTRHYYFDYWGQGTTLTVSS

SEQ ID NO: 666 - protein, 113 aa, Artificial Sequence
  PankoMab_LightChain_VJ-Region
DIVMTQAAFSNPVTLGTSASISCRSSKSLLHSNGITYFFWYLQKPGLSPQLLIYQMSNLASGVPDRFSSSGSGTDFTLRISRVEAEDVGVYYCAQNLELPPTFGGGTKLEIKR

SEQ ID NO: 667 - protein, 569 aa, Artificial Sequence
  Panobacumab_HeavyChain1
EEQVVESGGGFVQPGGSLRLSCAASGFTFSPYWMHWVRQAPGKGLVWVSRINSDGSTYYADSVKGRFTISRDNARNTLYLQMNSLRAEDTAVYYCARDRYYGPEMWGQGTMVTVSSGSASAPTLFPLVSCENSPSDTSSVAVGCLAQDFLPDSITFSWKYKNNSDISSTRGFPSVLRGGKYAATSQVLLPSKDVMQGTDEHVVCKVQHPNGNKEKNVPLPVIAELPPKVSVFVPPRDGFFGNPRKSKLICQATGFSPRQIQVSWLREGKQVGSGVTTDQVQAEAKESGPTTYKVTSTLTIKESDWLSQSMFTCRVDHRGLTFQQNASSMCVPDQDTAIRVFAIPPSFASIFLTKSTKLTCLVTDLTTYDSVTISWTRQNGEAVKTHTNISESHPNATFSAVGEASICEDDWNSGERFTCTVTHTDLPSPLKQTISRPKGVALHRPDVYLLPPAREQLNLRESATITCLVTGFSPADVFVQWMQRGQPLSPEKYVTSAPMPEPQAPGRYFAHSILTVSEEEWNTGETYTCVVAHEALPNRVTERTVDKSTGKPTLYNVSLVMSDTAGTCY

SEQ ID NO: 668 - protein, 219 aa, Artificial Sequence
  Panobacumab_LightChain1
DVVMTQSPLSLPVTLGQPASISCRSSQSLVYSDGNTYLNWFQQRPGQSPRRLIYKVSNRDSGVPDRFSGSGSGTDFTLKISRVEAEDVGVYYCMQGTHWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 669 - protein, 138 aa, Artificial Sequence
  Panobacumab_LightChain2
GDDEATILADNKCMCTRVTSRIIPSTEDPNEDIVERNIRIVVPLNNRENISDPTSPLRRNFVYHLSDVCKKCDPVEVELEDQVVTATQSNICNEDDGVPETCYMYDRNKCYTTMVPLRYHGETKMVQAALTPDSCYPD

SEQ ID NO: 670 - protein, 453 aa, Artificial Sequence
  Parsatuzumab_HeavyChain1
EVQLVESGGGLVQPGGSLRLSCAASGYTFIDYYMNWVRQAPGKGLEWVGDINLDNSGTHYNQKFKGRFTISRDKSKNTAYLQMNSLRAEDTAVYYCAREGVYHDYDDYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 671 - protein, 219 aa, Artificial Sequence
  Parsatuzumab_LightChain1
DIQMTQSPSSLSASVGDRVTITCRTSQSLVHINAITYLHWYQQKPGKAPKLLIYRVSNRFSGVPSRFSGSGSGTDFTLTISSLQPEDFATYYCGQSTHVPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 672 - protein, 451 aa, Artificial Sequence
  Pascolizumab_HeavyChain1
QVTLRESGPALVKPTQTLTLTCTFSGFSLSTSGMGVSWIRQPPGKGLEWLAHIYWDDDKRYNPSLKSRLTISKDTSRNQVVLTMTNMDPVDTATYYCARRETVFYWYFDVWGRGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 673 - protein, 218 aa, Artificial Sequence
  Pascolizumab_LightChain1
DIVLTQSPSSLSASVGDRVTITCKASQSVDYDGDSYMNWYQQKPGKAPKLLIYAASNLESGIPSRFSGSGSGTDFTFTISSLQPEDIATYYCQQSNEDPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 674 - protein, 504 aa, Artificial Sequence
  Pasotuxizumab_HeavyChain1
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 675 - protein, 504 aa, Artificial Sequence
  Pasotuxizumab_SingleChain
QVQLVQSGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVLHHHHHH

SEQ ID NO: 676 - protein, 447 aa, Artificial Sequence
  Pateclizumab_HeavyChain1
EVQLVESGGGLVQPGGSLRLSCAASGYTFTSYVIHWVRQAPGKGLEWVGYNNPYNAGTNYNEKFKGRFTISSDKSKNTAYLQMNSLRAEDTAVYYCSRPTMLPWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 677 - protein, 214 aa, Artificial Sequence
  Pateclizumab_LightChain1
DIQMTQSPSSLSASVGDRVTITCRASQAVSSAVAWYQQKPGKAPKLLIYSASHRYTGVPSRFSGSGSGTDFTLTISSLQPEDFATYYCQESYSTPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 678 - protein, 447 aa, Artificial Sequence
  Patritumab_HeavyChain1
QVQLQQWGAGLLKPSETLSLTCAVYGGSFSGYYWSWIRQPPGKGLEWIGEINHSGSTNYNPSLKSRVTISVETSKNQFSLKLSSVTAADTAVYYCARDKWTWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 679 - protein, 227 aa, Artificial Sequence; identical to SEQ ID NO: 635
  Patritumab_hinge-CH2-CH3

SEQ ID NO: 680 - protein, 220 aa, Artificial Sequence
  Patritumab_LightChain1
DIEMTQSPDSLAVSLGERATINCRSSQSVLYSSSNRNYLAWYQQNPGQPPKLLIYWASTRESGVPDRFSGSGSGTDFTLTISSLQAEDVAVYYCQQYYSTPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 681 - protein, 447 aa, Artificial Sequence; identical to SEQ ID NO: 496
  Pembrolizumab_HeavyChain1

SEQ ID NO: 682 - protein, 218 aa, Artificial Sequence; identical to SEQ ID NO: 497
  Pembrolizumab_LightChain1

SEQ ID NO: 683 - protein, 452 aa, Artificial Sequence
  Perakizumab_HeavyChain1
EVQLVESGGGLVQPGGSLRLSCAASGFTFSDYTMLWVRQAPGKGLEWVAIIKSGGSYSYYPDSVKGRFTISRDNAKNSLYLQMNSLRAEDTAVYYCARDGDYGSSYGAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 684 - protein, 215 aa, Artificial Sequence
  Perakizumab_LightChain1
DIQMTQSPSSLSASVGDRVTITCRASQDINSYLSWFQQKPGKAPKSLIVRANRLVDGVPSRFSGSGSGQDYSLTISSLQPEDFATYYCLQYDAFPPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 685 - protein, 444 aa, Artificial Sequence
  Pertuzuab_HeavyChain1
EVQLVESGGGLVQPGGSLRLSCAASGFTFTDYTDWVRQAPGKGLEWVADVNPNSGGSIYNQRFKGRFTLSVDRSKNTLYLQNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPGK

SEQ ID NO: 686 - protein, 213 aa, Artificial Sequence
  Pertuzuab_LightChain1
DIQTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 687 - protein, 214 aa, Artificial Sequence
  Pertuzumab_HeavyChain
DIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 688 - protein, 448 aa, Artificial Sequence
  Pertuzumab_LightChain
EVQLVESGGGLVQPGGSLRLSCAASGFTFTDYTMDWVRQAPGKGLEWVADVNPNSGGSIYNQRFKGRFTLSVDRSKNTLYLQMNSLRAEDTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 689 - protein, 250 aa, Artificial Sequence
  Pexelizumab_h5g1.1-scFv
MADIQMTQSPSSLSASVGDRVTITCGASENIYGALNWYQRKPGKAPKLLIYGATNLADGVPSRFSGSGSGTDYTLTISSLQPEDFATYYCQNVLNTPLTFGQGTKVEIKRTGGGGSGGGGSGGGGSQVQLVQSGAEVEKPGASVKKVSCKASGYIFSNYWIQWVRQAPGQGLEWMGEILPGSGSTEYAQKFQGRVTMTADTSTSTAYMELSSLRSEDTAVYYCARYFFGSSPNYWYFDVWGQGTLVTVSS

SEQ ID NO: 690 - protein, 115 aa, Artificial Sequence
  Pexelizumab_h5g1.1VHC_+_F_Heavy_Chain_V-Region
QVQLVQSGAEVKKPGASVKVSCKASGYIFSNYWIQWVRQAPGQGLEWMGEILPGSGSTEYAQKFQGRVTMTADTSTSTAYMELSSLRSEDTAVYYCARYFFGSSPNWYFVWGQGT

SEQ ID NO: 691 - protein, 106 aa, Artificial Sequence
  Pexelizumab_h5g1.1VHC_+_F_Light_Chain_V-Region
DIQMTQSPSLSASVGDRVTITCGASENIYGALNWYQRKPGKAPKLLIYGATNLADGVPSRFSGSGSGTDYTLTISSLQPEDFATYYCQNVLNTPLTFGQGTKVEIK

SEQ ID NO: 692 - protein, 442 aa, Artificial Sequence
  PF-05082566_HeavyChain1
EVQLVQSGAEVKKPGESLRISCKGSGYSFSTYWISWVRQMPGKGLEWMGKIYPGDSYTNYSPSFQGQVTISADKSISTAYLQWSSLKASDTAMYYCARGYGIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 693 - protein, 214 aa, Artificial Sequence
  PF-05082568_LightChain1
SYELTQPPSVSVSPGQTASITCSGDNIGDQYAHWYQQKPGQSPVLVIYQDKNRPSGIPERFSGSNSGNTATLTISGTQAMDEADYYCATYTGFGSLAVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 694 - protein, 447 aa, Artificial Sequence
  Pidilizumab_HeavyChain1
QVQLVQSGSELKKPGASVKISCKASGYTFTNYGMNWVRQAPGQGLQWMGWINTDSGESTYAEEFKGRFVFSLDTSVNTAYLQITSLTAEDTGMYFCVRVGYDALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 695 - protein, 213 aa, Artificial Sequence
  Pidilizumab_LightChain1
EIVLTQSPSSLSASVGDRVTITCSARSSVSYMHWFQQKPGKAPKLWIYRTSNLASGVPSRFSGSGSGTSYCLTINSLQPEDFATYYCQQRSSFPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 696 - protein, 450 aa, Artificial Sequence
  Pinatuzumab_vedotin_HeavyChain1
EVQLVESGGGLVQPGGSLRLSCAASGYEFSRSWMNWVRQAPGKGLEWVGRIYPGDGDTNYSGKFKGRFTISADTSKNTAYLQMNSLRAEDTAVYYCARDGSSWDWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 697 - protein, 219 aa, Artificial Sequence
  Pinatuzumab_vedotin_LightChain1
DIQMTQSPSSLSASVGDRVTITCRSSQSIVHSVGNTFLEWYQQKPGKAPKLLIYKVSNRFSGVPSRFSGSGSGTDFTLTISSLQPEDFATYYCFQGSQFPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 698 - protein, 341 aa, Artificial Sequence
  Placulumab_chain1
DIQMTQSPSSLSASVGDRVTITCRASQAIDSYLHWYQQKPGKAPKLLIYSASNLETGVPSRFSGSGSGTDFTLTISSLLPEDFATYYCQQVVWRPFTFGQGTKVEIKRVEPKSSDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 699 - protein, 341 aa, Artificial Sequence; identical to SEQ ID NO: 698
  Placulumab_HeavyChain1

SEQ ID NO: 700 - protein, 447 aa, Artificial Sequence
  Plozalizumab_HeavyChain1
EVQLVESGGGLVKPGGSLRLSCAASGFTFSAYAMNWVRQAPGKGLEWVGRIRTKNNNYATYYADSVKDRFTISRDDSKNTLYLQMNSLKTEDTAVYYCTTFYGNGVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 701 - protein, 219 aa, Artificial Sequence
  Plozalizumab_LightChain1
DVVMTQSPLSLPVTLGQPASISCKSSQSLLDSDGKTFLNWFQQRPGQSPRRLIYLVSKLDSGVPDRFSGSGSGTDFTLKISRVEAEDVGVYYCWQGTHFPYTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 702 - protein, 447 aa, Artificial Sequence
  Pogalizumab_HeavyChain1
EVQLVQSGAEVKKPGASVKVSCKASGYTFTDSYMSWVRQAPGQGLEWIGDMYPDNGDSSYNQKFRERVTITRDTSTSTAYLELSSLRSEDTAVYYCVLAPRWYFSVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 703 - protein, 214 aa, Artificial Sequence
  Pogalizumab_LightChain1
DIQMTQSPSSLSASVGDRVTITCRASQDISNYLNWYQQKPGKAPKLLIYYTSRLRSGVPSRFSGSGSGTDFTLTISSLQPEDFATYYCQQGHTLPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 704 - protein, 447 aa, Artificial Sequence
  Polatuzumab_vedotin_HeavyChain1
EVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 705 - protein, 218 aa, Artificial Sequence
  Polatuzumab_vedotin_LightChain1
DIQLTQSPSSLSASVGDRVTITCKASQSVDYEGDSFLNWYQQKPGKAPKLLIYAASNLESGVPSRFSGSGSGTDFTLTISSLQPEDFATYYCQQSNEDPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 706 - protein, 442 aa, Artificial Sequence
  Ponezumab_HeavyChain1
QVQLVQSGAEVKKPGASVKVSCKASGYYTEAYYIHWVRQAPGQGLEWMGRIDPATGNTKYAPRLQDRVTMTRDTSTSTVYMELSSLRSEDTAVYYCASLYSLPVYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 707 - protein, 219 aa, Artificial Sequence
  Ponezumab_LightChain1
DVVMTQSPLSLPVTLGQPASISCKSSQSLLYSDAKTYLNWFQQRPGQSPRRLIYQISRLDPGVPDRFSGSGSGTDFTLKISRVEAEDVGVYYCLQGTHYPVLFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 708 - protein, 454 aa, Artificial Sequence
  Pritoxaximab_HeavyChain1
QVQLQESGAELVRSGASVRMSCKASGYTFTSYNMHWVKQTPGQGLEWIGYIYPGNGGTNYIQKFKGKAILTADTSSSTAYMQISSLTSEDSAVYFCTRSPSHYSSDPYFDYWGQGTTLTVSSEFASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 709 - protein, 214 aa, Artificial Sequence
  Pritoxaximab_LightChain1
DIVMSQSHKFMSTSVGDRVSITCKASQDVGTAVAWYQQNPGQSPKFLIYWASTRHTGVPDRFTGSGSGTDFTLTITNVQSEDLADYFCQQYSSYPLTFGAGTSLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 710 - protein, 450 aa, Artificial Sequence
  Pritumumab_HeavyChain1
EVQLLESGGDLVQPGGSLRLSCAASGFTFSNYAMSWVRQAPGKGLEWVSAITPSGGSTNYADSVKGRFTISRDNSQNTLYLQMNSLRVEDTAVYICGRVPYRSTWYPLYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 711 - protein, 214 aa, Artificial Sequence
  Pritumumab_LightChain1
DIQMTQSPSSLSASVGDRVTITCRASQDISNYLAWFQQKPGKAPKSLIYAASSLHSKVPTQFSGSGSGTDFTLTISSLQPEDFATYYCLQYSTYPITFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 712 - protein, 447 aa, Artificial Sequence
  Quilizumab_HeavyChain1
EVQLVESGGGLVQPGGSLRLSCAASGFTFSDYGIAWVRQAPGKGLEWVAFISDLAYTIYYADTVTGRFTISRDNSKNTLYLQMNSLRAEDTAVYYCARDNWDAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 713 - protein, 219 aa, Artificial Sequence
  Quilizumab_LightChain1
DIQMTQSPSSLSASVGDRVTITCRSSQSLVHNNANTYLHWYQQKPGKAPKLLIYKVSNRFSGVPSRFSGSGSGTDFTLTISSLQPEDFATYYCSQNTLVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 714 - protein, 445 aa, Artificial Sequence
  Racotumomab_HeavyChain1
QVQLQQSGAELVKPGASVKLSCKASGYTFTSYDINWVRQRPEQGLEWIGWIFPGDGSTKYNEKFKGKATLTTDKSSSTAYMQLSRLTSEDSAVYFCAREDYYDNSYYFDYWGQGTTLTVSSAKTTPPSVYPLAPGSAAQTNSMVTLGCLVKGYFPEPVTVTWNSGSLSSGVHTFPAVLQSDLYTLSSSVTVPSSPRPSETVTCNVAHPASSTKVDKKIVPRDCGCKPCICTVPEVSSVFIFPPKPKDVLTITLTPKVTCVVVDISKDDPEVQFSWFVDDVEVHTAQTQPREEQFNSTFRSVSELPIMHQDWLNGKEFKCRVNSAAFPAPIEKTISKTKGRPKAPQVYTIPPPKEQMAKDKVSLTCMITDFFPEDITVEWQWNGQPAENYKNTQPIMNTNGSYFVYSKLNVQKSNWEAGNTFTCSVLHEGLHNHHTEKSLSHSPGK

SEQ ID NO: 715 - protein, 214 aa, Artificial Sequence
  Racotumomab_LightChain1
DIQMTQTTSSLSASLGDRVTISCRASQDISNYLNWYQQKPDGTVKLLIYYTSRLHSGVPSRFSGSGSGTDYSLTISNLEQEDIATYFCQQGNTLPWTFGGGTKLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 716 - protein, 363 aa, Artificial Sequence; identical to SEQ ID NO: 654
  Racotumomab_scVH-VH'-VH_chain

SEQ ID NO: 717 - protein, 357 aa, Artificial Sequence
  Radretumab_HeavyChain1
EVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTVSSGDGSSGGSGGASEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSGGSGGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPESSRRGGC

SEQ ID NO: 718 - protein, 138 aa, Artificial Sequence; identical to SEQ ID NO: 669
  Radretumab_j_chain

SEQ ID NO: 719 - protein, 456 aa, Artificial Sequence
  Rafivirumab_HeavyChain1
QVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 720 - protein, 456 aa, Artificial Sequence
  Rafivirumab_HeavyChain
EVQLVQSGAEVKKPGSSVKVSCKASGGTFNRYTVNWVRQAPGQGLEWMGGIIPIFGTANYAQRFQGRLTITADESTSTAYMELSSLRSDDTAVYFCARENLDNSGTYYYFSGWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 721 - protein, 218 aa, Artificial Sequence
  Rafivirumab_LightChain1
QSALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 722 - protein, 218 aa, Artificial Sequence
  Rafivirumab_LightChain
ESALTQPRSVSGSPGQSVTISCTGTSSDIGGYNFVSWYQQHPGKAPKLMIYDATKRPSGVPDRFSGSKSGNTASLTISGLQAEDEADYYCCSYAGDYTPGVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 723 - protein, 444 aa, Artificial Sequence
  Ralpancizumab_HeavyChain1
QVQLVQSGAEVKKPGASVKVSCKASGYTFTSYYMHWVRQAPGQGLEWMGEIHPSGGRTNYNEKFKSRVTMTRDTSTSTVYMELSSLRSEDTAVYYCARERPLYASDLWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 724 - protein, 214 aa, Artificial Sequence
  Ralpancizumab_LightChain1
DIQMTQSPSSLSASVGDRVTITCKASQDVHTAVAWYQQKPGKAPKLLIYHASYRYTGVPSRFSGSGSGTDFTFTISSLQPEDIATYYCQQRYSLWRTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 725 - protein, 446 aa, Artificial Sequence
  Ramucirumab_HeavyChain1
EVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCARVTDAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 726 - protein, 214 aa, Artificial Sequence
  Ramucirumab_LightChain1
DIQMTQSPSSVSASIGDRVTITCRASQGIDNWLGWYQQKPGKAPKLLIYDASNLDTGVPSRFSGSGSGTYFTLTISSLQAEDFAVYFCQQAKAFPPTFGGGTKVDIKGTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 727 - protein, 229 aa, Artificial Sequence
  Ranibiziuab_HeavyChain1
EVQLVESGGGLVQPGGSLRLSCAASGYDFTHYGNWVRQAPGKGLEWVGWINTYTGEPTYAADFKRRFTFSLDTSKSTAYLQNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 728 - protein, 214 aa, Artificial Sequence
  Ranibiziuab_LightChain1
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 729 - protein, 213 aa, Artificial Sequence
  Ranibizumab_fab_fragment
DIQLTQSPSSLSASVGDRVTITCSASQDISNYLNWYQQKPGKAPKVLIYFTSSLHSGVPSRFSGSGSGTDFTLTISSLQPEDFATYYCQQYSTVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 730 - protein, 231 aa, Artificial Sequence
  Ranibizumab_HeavyChain
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHL

SEQ ID NO: 731 - protein, 218 aa, Artificial Sequence
  Ranibizumab_LightChain
EVQLVESGGGLVQPGGSLRLSCAASGYDFTHYGMNWVRQAPGKGLEWVGWINTYTGEPTYAADFKRRFTFSLDTSKSTAYLQMNSLRAEDTAVYYCAKYPYYYGTSHWYFDVWGQGTLVTVSSASTKGPSVFPLAPSGTAALGCLVKDYFPEPVTVSWNSGALTSGVHTFPAVLQSSGLYSLSSVVTVPSSSLGTQTYICNVNHKPSNTKVDKKVEPK

SEQ ID NO: 732 - protein, 214 aa, Artificial Sequence; identical to SEQ ID NO: 728
  Ranibizumab_LightChain_variant

SEQ ID NO: 733 - protein, 456 aa, Artificial Sequence
  Refanezumab_HeavyChain1
QVQLVQSGSELKKPGASVKVSCKASGYTFTNYGMNWVRQAPGQGLEWMGWINTYTGEPTYADDFTGRFVFSLDTSVSTAYLQISSLKAEDTAVYYCARNPINYYGINYEGYVMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 734 - protein, 219 aa, Artificial Sequence
  Refanezumab_LightChain1
DIVMTQSPDSLAVSLGERATINCKSSHSVLYSSNQKNYLAWYQQKPGQPPKLLIYWASTRESGVPDRFSGSGSGTDFTLTISSLQAEDVAVYYCHQYLSSLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 735 - protein, 438 aa, Artificial Sequence
  REGN2810_HeavyChain1
EVQLLESGGVLVQPGGSLRLSCAASGFTFSNFGTWVRQAPGKGLEWVSGISGGGRDTYFADSVKGRFTISRDNSKNTLYLQNSLKGEDTAVYYCVKWGNIYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEETKNQVSLTCLVKGFYPSDIAVEWESNGQPENNYKTTPPVLDSDGSFFLYSRLTVDKSRWQEGNVFSCSVHEALHNHYTQKSLSLSLG

SEQ ID NO: 736 - protein, 213 aa, Artificial Sequence
  REGN2810_LightChain1
DIQTQSPSSLSASVGDSITITCRASLSINTFLNWYQQKPGKAPNLLIYAASSLHGGVPSRFSGSGSGTDFTLTIRTLQPEDFATYYCQQSSNTPFTFGPGTVVDFRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 737 - protein, 217 aa, Artificial Sequence
  rhuMab_HER2(9CI)_LightChain
VHSDIQMTQSPSSLSASVGDRVTITCKASQDVSIGVAWYQQKPGKAPKLLIYSASYRYTGVPSRFSGSGSGTDFTLTISSLQPEDFATYYCQQYYIYPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 738 - protein, 405 aa, Artificial Sequence
  rhuMab_HER2_HeavyChain
EVQLVESGGGLVQPGGSLRLSCAASGFTFTDYTMDWVRQAPGKGLTAVYYCARNLGPSFYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGPK

SEQ ID NO: 739 - protein, 215 aa, Artificial Sequence
  rhuMab_HER2_LightChain
SDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 740 - protein, 106 aa, Artificial Sequence
  rhuMab_HER2_LightChain_variant1
TVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 741 - protein, 214 aa, Artificial Sequence
  rhuMab_HER2_LightChain_variant2
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTCAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 742 - protein, 214 aa, Artificial Sequence
  rhuMab_HER2_LightChain_variant3
DIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 743 - protein, 215 aa, Artificial Sequence; identical to SEQ ID NO: 739
  rhuMab_HER2_LightChain_variant4

SEQ ID NO: 744 - protein, 107 aa, Artificial Sequence [sequence omitted]

SEQ ID NO: 745 - protein, 450 aa, Artificial Sequence
  rhuMab_HER2_gamma1-Chain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 746 - protein, 450 aa, Artificial Sequence
  rhuMab_HER2__gamma1-Chain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 747 - protein, 243 aa, Artificial Sequence
  rhuMab_HER2_gamma1-Chain__rhuMab_HER2_LightChain_sc4D5
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSGGGGSGGGGSGGGGSDIQMTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKR

SEQ ID NO: 748 - protein, 450 aa, Artificial Sequence; identical to SEQ ID NO: 745
  rhuMab_HER2_gamma1-Chain_variant1

SEQ ID NO: 749 - protein, 450 aa, Artificial Sequence; identical to SEQ ID NO: 746
  rhuMab_HER2_gamma1-Chain_variant2

SEQ ID NO: 750 - protein, 450 aa, Artificial Sequence
  rhuMab_HER2_gamma1-Chain_variant3
EVQLVESGGGLVQPGGSLRLSCAASGFNIKDTYIHWVRQAPGKGLEWVARIYPTNGYTRYADSVKGRFTISADTSKNTAYLQMNSLRCEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 751 - protein, 120 aa, Artificial Sequence [sequence omitted]

SEQ ID NO: 752 - protein, 453 aa, Artificial Sequence; identical to SEQ ID NO: 83
  rhuMAb-VEGF_HeavyChain1

SEQ ID NO: 753 - protein, 214 aa, Artificial Sequence; identical to SEQ ID NO: 84
  rhuMAb-VEGF_LightChain1

SEQ ID NO: 754 - protein, 214 aa, Artificial Sequence; identical to SEQ ID NO: 84
  rhuMAb-VEGF_LightChain

SEQ ID NO: 755 - protein, 107 aa, Artificial Sequence [sequence omitted]

SEQ ID NO: 756 - protein, 453 aa, Artificial Sequence; identical to SEQ ID NO: 83
  rhuMAb-VEGF_gamma1-Chain

SEQ ID NO: 757 - protein, 123 aa, Artificial Sequence [sequence omitted]

SEQ ID NO: 758 - protein, 446 aa, Artificial Sequence
  Rilotumumab_HeavyChain1
QVQLQESGPGLVKPSETLSLTCTVSGGSISIYYWSWIRQPPGKGLEWIGYVYYSGSTNYNPSLKSRVTISVDTSKNQFSLKLNSVTAADTAVYYCARGGYDFWSGYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 759 - protein, 215 aa, Artificial Sequence
  Rilotumumab_LightChain1
EIVMTQSPATLSVSPGERATLSCRASQSVDSNLAWYRQKPGQAPRLLIYGASTRATGIPARFSGSGSGTEFTLTISSLQSEDFAVYYCQQYINWPPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 760 - protein, 357 aa, Artificial Sequence; identical to SEQ ID NO: 717
  Rilotumumab_scFv-CH_chain

SEQ ID NO: 761 - protein, 449 aa, Artificial Sequence
  Rinucumab_HeavyChain1
QLQLQESGPGLVKPSETLSLTCTVSGGSITSSSYYWGWIRQPPGKGLEWIGSIYYRGSTNYNPSLKSRVTISVDSSKNQFYLKVSSVTAVDTAVYYCARQNGAARPSWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 762 - protein, 448 aa, Artificial Sequence
  Rinucumab_HeavyChain
QLQLQESGPGLVKPSETLSLTCTVSGGSITSSSYYWGWIRQPPGKGLEWIGSIYYRGSTNYNPSLKSRVTISVDSSKNQFYLKVSSVTAVDTAVYYCARQNGAARPSWFDPWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 763 - protein, 215 aa, Artificial Sequence
  Rinucumab_LightChain1
EIVLTQSPDTISLSPGERATLSCRASQSISSIYLAWYQQKPGQAPRLLIYGASSRVTGIPDRFSVSGSGTDFTLTISRLEPEDFAVYYCQHYGISPFTFGPGTKVDIRRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 764 - protein, 449 aa, Artificial Sequence
  Risankizumab_HeavyChain1
QVQLVQSGAEVKKPGSSVKVSCKASGYTFTDQTIHWMRQAPGQGLEWIGYIYPRDDSPKYNENFKGKVTITADKSTSTAYMELSSLRSEDTAVYYCAIPDRSGYAWFIYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 765 - protein, 214 aa, Artificial Sequence
  Risankizumab_LightChain1
DIQMTQSPSSLSASVGDRVTITCKASRDVAIAVAWYQQKPGKVPKLLIYWASTRHTGVPSRFSGSGSRTDFTLTISSLQPEDVADYFCHQYSSYPFTFGSGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 766 - protein, 451 aa, Artificial Sequence
  Rituximab_HeavyChain
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 767 - protein, 451 aa, Artificial Sequence
  Rituximab_HeavyChain_variant
QVQLQQPGAELVKPGASVKMSCKASGYTFTSYNMHWVKQTPGRGLEWIGAIYPGNGDTSYNQKFKGKATLTADKSSSTAYMQLSSLTSEDSAVYYCARSTYYGGDWYFNVWGAGTTVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 768 - protein, 213 aa, Artificial Sequence
  Rituximab_LightChain
QIVLSQSPAILSASPGEKVTMTCRASSSVSYIHWFQQKPGSSPKPWIYATSNLASGVPVRFSGSGSGTSYSLTISRVEAEDAATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 769 - protein, 238 aa, Artificial Sequence
  Rivabazumab_pegol_HeavyChain1
EVQLVESGGGVVQPGRSLRLSCAASGFTFSNYPMHWVRQAPGKGLEWVAVISYDGSEKWYADSVKGRFTISRDNSKNTLYLEMNSLRPEDTAVYYCARNRGDIYYDFTYAMDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSSDKTHTCPPCPA

SEQ ID NO: 770 - protein, 214 aa, Artificial Sequence
  Rivabazumab_pegol_LightChain1
DIQLTQSPSTLSASVGDSVTITCRASEGVDRWLAWYQQKPGRAPKLLIYDASTLQSGVPSRFSGSGSGTEFSLTISSLQPDDVATYYCQHFWGTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGES

SEQ ID NO: 771 - protein, 448 aa, Artificial Sequence
  Robatumumab_HeavyChain1
EVQLVQSGGGLVKPGGSLRLSCAASGFTFSSFAMHWVRQAPGKGLEWISVIDTRGATYYADSVKGRFTISRDNAKNSLYLQMNSLRAEDTAVYYCARLGNFYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 772 - protein, 214 aa, Artificial Sequence
  Robatumumab_LightChain1
EIVLTQSPGTLSVSPGERATLSCRASQSIGSSLHWYQQKPGQAPRLLIKYASQSLSGIPDRFSGSGSGTDFTLTISRLEPEDFAVYYCHQSSRLPHTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 773 - protein, 456 aa, Artificial Sequence
  Roledumab_HeavyChain1
QVQLVESGGGVVQPGRSLRLSCTASGFTFKNYAMHWVRQAPAKGLEWVATISYDGRNIQYADSVKGRFTFSRDNSQDTLYLQLNSLRPEDTAVYYCARPVRSRWLQLGLEDAFHIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 774 - protein, 214 aa, Artificial Sequence
  Roledumab_LightChain1
AIRMTQSPSSFSASTGDRVTITCRASQDIRNYVAWYQQKSGKAPKFLIYAASTLQSGVPSRFSGSGSGTDFTLTINSLQSEDFATYYCQQYYNSPPTFGQGTRVEITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 775 - protein, 213 aa, Artificial Sequence; identical to SEQ ID NO: 729
  Romosozumab_fab_fragment

SEQ ID NO: 776 - protein, 449 aa, Artificial Sequence
  Romosozumab_HeavyChain1
EVQLVQSGAEVKKPGASVKVSCKASGYTFTDYNMHWVRQAPGQGLEWMGEINPNSGGAGYNQKFKGRVTMTTDTSTSTAYMELRSLRSDDTAVYYCARLGYDDIYDDWYFDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 777 - protein, 214 aa, Artificial Sequence
  Romosozumab_LightChain1
DIQMTQSPSSLSASVGDRVTITCRASQDISNYLNWYQQKPGKAPKLLIYYTSRLLSGVPSRFSGSGSGTDFTLTISSLQPEDFATYYCQQGDTLPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 778 - protein, 442 aa, Artificial Sequence
  Rontalizuab_HeavyChain1
EVQLVESGGGLVQPGGSLRLSCATSGYTFTEYIIHWVRQAPGKGLEWVASINPDYDITNYNQRFKGRFTISLDKSKRTAYLQNSLRAEDTAVYYCASWISDFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPG

SEQ ID NO: 779 - protein, 216 aa, Artificial Sequence
  Rontalizuab_LightChain1
DIQTQSPSSLSASVGDRVTITCRASQSVSTSSYSYHWYQQKPGKAPKVLISYASNLESGVPSRFSGSGSGTDFTLTISSLQPEDFATYYCQHSWGIPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 780 - protein, 447 aa, Artificial Sequence
  Rontalizumab_HeavyChain1
EVQLVESGGGLVQPGGSLRLSCATSGYTFTEYIIHWVRQAPGKGLEWVASINPDYDITNYNQRFKGRFTISLDKSKRTAYLQMNSLRAEDTAVYYCASWISDFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 781 - protein, 218 aa, Artificial Sequence
  Rontalizumab_LightChain1
DIQMTQSPSSLSASVGDRVTITCRASQSVSTSSYSYMHWYQQKPGKAPKVLISYASNLESGVPSRFSGSGSGTDFTLTISSLQPEDFATYYCQHSWGIPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 782 - protein, 447 aa, Artificial Sequence
  Rovalpituzumab_tesirine_HeavyChain1
QVQLVQSGAEVKKPGASVKVSCKASGYTFTNYGMNWVRQAPGQGLEWMGWINTYTGEPTYADDFKGRVTMTTDTSTSTAYMELRSLRSDDTAVYYCARIGDSSPSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 783 - protein, 214 aa, Artificial Sequence
  Rovalpituzumab_tesirine_LightChain1
EIVMTQSPATLSVSPGERATLSCKASQSVSNDVVWYQQKPGQAPRLLIYYASNRYTGIPARFSGSGSGTEFTLTISSLQSEDFAVYYCQQDYTSPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 784 - protein, 447 aa, Artificial Sequence
  Rovelizumab_HeavyChain1
QVQLVQSGAEVKKPGASVKVSCKASGYTFTNNWMQWVRQAPGQGLEWMGAIFPGDDETRYTQKFRGKATITADTSTSTAYMELSSLRSEDTAVYYCGRGGKLRPFALDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 785 - protein, 218 aa, Artificial Sequence
  Rovelizumab_LightChain1
DIQMTQSPSSLSASVGDRVTITCRASESVESYGNNFMYWYQQKPGKAPKLLIYLASNLESGVPSRFSGSGSGTDFTLTISSLQPEDFATYYCHQDNEDPPTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 786 - protein, 447 aa, Artificial Sequence
  Ruplizumab_HeavyChain1
QVQLVQSGAEVVKPGASVKLSCKASGYIFTSYYMYWVKQAPGQGLEWIGEINPSNGDTNFNEKFKSKATLTVDKSASTAYMELSSLRSEDTAVYYCTRSDGRNDMDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 787 - protein, 218 aa, Artificial Sequence
  Ruplizumab_LightChain1
DIVLTQSPATLSVSPGERATISCRASQRVSSSTYSYMHWYQQKPGQPPKLLIKYASNLESGVPARFSGSGSGTDFTLTISSVEPEDFATYYCQHSWEIPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 788 - protein, 451 aa, Artificial Sequence
  Sacituzumab_govitecan_HeavyChain1
QVQLQQSGSELKKPGASVKVSCKASGYTFTNYGMNWVKQAPGQGLKWMGWINTYTGEPTYTDDFKGRFAFSLDTSVSTAYLQISSLKADDTAVYFCARGGFGSSYWYFDVWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 789 - protein, 214 aa, Artificial Sequence
  Sacituzumab_govitecan_LightChain1
DIQLTQSPSSLSASVGDRVSITCKASQDVSIAVAWYQQKPGKAPKLLIYSASYRYTGVPDRFSGSGSGTDFTLTISSLQPEDFAVYYCQQHYITPLTFGAGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 790 - protein, 442 aa, Artificial Sequence
  Samalizumab_HeavyChain1
QVQLQQSGSELKKPGASVKISCKASGYSFTDYIILWVRQNPGKGLEWIGHIDPYYGSSNYNLKFKGRVTITADQSTTTAYMELSSLRSEDTAVYYCGRSKRDYFDYWGQGTTLTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 791 - protein, 214 aa, Artificial Sequence
  Samalizumab_LightChain1
DIQMTQSPSSLSASIGDRVTITCKASQDINSYLSWFQQKPGKAPKLLIYRANRLVDGVPSRFSGSGSGTDYTLTISSLQPEDFAVYYCLQYDEFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 792 - protein, 446 aa, Artificial Sequence
  Sarilumab_HeavyChain1
EVQLVESGGGLVQPGRSLRLSCAASRFTFDDYAMHWVRQAPGKGLEWVSGISWNSGRIGYADSVKGRFTISRDNAENSLFLQMNGLRAEDTALYYCAKGRDSFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 793 - protein, 214 aa, Artificial Sequence
  Sarilumab_LightChain1
DIQMTQSPSSVSASVGDRVTITCRASQGISSWLAWYQQKPGKAPKLLIYGASSLESGVPSRFSGSGSGTDFTLTISSLQPEDFASYYCQQANSFPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 794 - protein, 432 aa, Artificial Sequence
  Satumomab_pendetide_HeavyChain
QVQLQQSDAELVKPGASVKISCKASGYTFTDHAIHWAKQKPEQGLEWIGYISPGNDDIKYNEKFKGKATLTADKSSSTAYMQLNSLTSEDSAVYFCKRSYYGHWGQGTTLTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVCPPCKCPAPNLLGGPSVFIFPPKIKDVLMISLSPIVTCVVVDVSEDDPDVQISWFVNNVEVHTAQTQTHREDYNSTLRVVSALPIQHQDWMSGKEFKCKVNNKDLPAPIERTISKPKGSVRAPQVYVLPPPEEEMTKKQVTLTCMVTDFMPEDIYVEWTNNGKTELNYKNTEPVLDSDGSYFMYSKLRVEKKNWVERNSYSCSVVHEGLHNHHTTKSFSR

SEQ ID NO: 795 - protein, 210 aa, Artificial Sequence
  Satumomab_pendetide_LightChain
DIQMTQSPASLSVSVGETVTITCRASENIYSNLAWYQQKQGKSPQLLVYAATNLADGVPSRFSGSGSGTQYSLKINSLQSEDFGSYYCQHFWGTPYTFGGGTRLEIKRADAAPTVFIFPPSDEQLKSGTASVVCLLNNFYPREAKVQWKVDNALQSGNSQESVTEQDSKDSTYSLSSTLTLSKADYEKHKVYACEVTHQGLSSPVTKSFN

SEQ ID NO: 796 - protein, 457 aa, Artificial Sequence
  Secukinumab_HeavyChain1
EVQLVESGGGLVQPGGSLRLSCAASGFTFSNYWMNWVRQAPGKGLEWVAAINQDGSEKYYVGSVKGRFTISRDNAKNSLYLQMNSLRVEDTAVYYCVRDYYDILTDYYIHYWYFDLWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 797 - protein, 215 aa, Artificial Sequence
  Secukinumab_LightChain1
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSPCTFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 798 - protein, 445 aa, Artificial Sequence
  Seribantumab_HeavyChain1
EVQLLESGGGLVQPGGSLRLSCAASGFTFSHYVMAWVRQAPGKGLEWVSSISSSGGWTLYADSVKGRFTISRDNSKNTLYLQMNSLRAEDTAVYYCTRGLKMATIFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 799 - protein, 217 aa, Artificial Sequence
  Seribantumab_LightChain1
QSALTQPASVSGSPGQSITISCTGTSSDVGSYNVVSWYQQHPGKAPKLIIYEVSQRPSGVSNRFSGSKSGNTASLTISGLQTEDEADYYCCSYAGSSIFVIFGGGTKVTVLGQPKAAPSVTLFPPSSEELQANKATLVCLVSDFYPGAVTVAWKADGSPVKVGVETTKPSKQSNNKYAASSYLSLTPEQWKSHRSYSCRVTHEGSTVEKTVAPAECS

SEQ ID NO: 800 - protein, 451 aa, Artificial Sequence
  Setoxaximab_HeavyChain1
EVQLQQPGPELEKPGASVKLSCKASGYSFTDYNMNWVKQNNGESLEWIGKIDPYYGGPSYNQKFKDKATLTVDKSSSTAYMQLKSLTSEDSAVYYCTRGGNRDWYFDVWGAGTTLTVSAEFASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 801 - protein, 220 aa, Artificial Sequence
  Setoxaximab_LightChain1
DIVLSQSPSSLVVSVGEKVTMSCKSSQSLLYSRNQKNYLAWYQQKPGQSPKVLIYWASTRESGVPDRLTGSGSGTDFTLTISSVKAEDLAVYYCQQYYSYPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 802 - protein, 446 aa, Artificial Sequence
  Sifalimumab_HeavyChain1
QVQLVQSGAEVKKPGASVKVSCKASGYTFTSYSISWVRQAPGQGLEWMGWISVYNGNTNYAQKFQGRVTMTTDTSTSTAYLELRSLRSDDTAVYYCARDPIAAGYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 803 - protein, 215 aa, Artificial Sequence
  Sifalimumab_LightChain1
EIVLTQSPGTLSLSPGERATLSCRASQSVSSTYLAWYQQKPGQAPRLLIYGASSRATGIPDRFSGSGSGTDFTLTISRLEPEDFAVYYCQQYGSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 804 - protein, 449 aa, Artificial Sequence
  Siltuximab_HeavyChain1
EVQLVESGGKLLKPGGSLKLSCAASGFTFSSFAMSWFRQSPEKRLEWVAEISSGGSYTYYPDTVTGRFTISRDNAKNTLYLEMSSLRSEDTAMYYCARGLWGYYALDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 805 - protein, 213 aa, Artificial Sequence
  Siltuximab_LightChain1
QIVLIQSPAIMSASPGEKVTMTCSASSSVSYMYWYQQKPGSSPRLLIYDTSNLASGVPVRFSGSGSGTSYSLTISRMEAEDAATYYCQQWSGYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 806 - protein, 443 aa, Artificial Sequence
  Simtuzumab_HeavyChain1
QVQLVQSGAEVKKPGASVKVSCKASGYAFTYYLIEWVRQAPGQGLEWIGVINPGSGGTNYNEKFKGRATITADKSTSTAYMELSSLRSEDTAVYFCARNWMNFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 807 - protein, 219 aa, Artificial Sequence
  Simtuzumab_LightChain1
DIVMTQTPLSLSVTPGQPASISCRSSKSLLHSNGNTYLYWFLQKPGQSPQFLIYRMSNLASGVPDRFSGSGSGTDFTLKISRVEAEDVGVYYCMQHLEYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 808 - protein, 449 aa, Artificial Sequence
  Sirukumab_HeavyChain1
EVQLVESGGGLVQPGGSLRLSCAASGFTFSPFAMSWVRQAPGKGLEWVAKISPGGSWTYYSDTVTGRFTISRDNAKNSLYLQMNSLRAEDTAVYYCARQLWGYYALDIWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 809 - protein, 213 aa, Artificial Sequence
  Sirukumab_LightChain1
EIVLTQSPATLSLSPGERATLSCSASISVSYMYWYQQKPGQAPRLLIYDMSNLASGIPARFSGSGSGTDFTLTISSLEPEDFAVYYCMQWSGYPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 810 - protein, 446 aa, Artificial Sequence
  Sofituzumab_vedotin_HeavyChain1
EVQLVESGGGLVQPGGSLRLSCAASGYSITNDYAWNWVRQAPGKGLEWVGYISYSGYTTYNPSLKSRFTISRDTSKNTLYLQMNSLRAEDTAVYYCARWTSGLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 811 - protein, 214 aa, Artificial Sequence
  Sofituzumab_vedotin_LightChain1
DIQMTQSPSSLSASVGDRVTITCKASDLIHNWLAWYQQKPGKAPKLLIYGATSLETGVPSRFSGSGSGTDFTLTISSLQPEDFATYYCQQYWTTPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 812 - protein, 441 aa, Artificial Sequence
  Solanezumab_HeavyChain1
EVQLVESGGGLVQPGGSLRLSCAASGFTFSRYSMSWVRQAPGKGLELVAQINSVGNSTYYPDTVKGRFTISRDNAKNTLYLQMNSLRAEDTAVYYCASGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 813 - protein, 442 aa, Artificial Sequence
  Solanezumab_HeavyChain
EVQLVESGGGLVQPGGSLRLSCAASGFTFSRYSMSWVRQAPGKGLELVAQINSVGNSTYYPDTVKGRFTISRDNAKNTLYLQMNSLRAEDTAVYYCASGDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 814 - protein, 219 aa, Artificial Sequence
  Solanezumab_LightChain1
DVVMTQSPLSLPVTLGQPASISCRSSQSLIYSDGNAYLHWFLQKPGQSPRLLIYKVSNRFSGVPDRFSGSGSGTDFTLKISRVEAEDVGVYYCSQSTHVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 815 - protein, 502 aa, Artificial Sequence
  Solitomab_HeavyChain1
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIKHHHHHH

SEQ ID NO: 816 - protein, 502 aa, Artificial Sequence; identical to SEQ ID NO: 815
  Solitomab_SingleChain

SEQ ID NO: 817 - protein, 234 aa, Artificial Sequence
  Sonepcizumab_LightChain_Precursor
MSVPTQVLGLLLLWLTDARCETTVTQSPSFLSASVGDRVTITCITTTDIDDDMNWFQQEPGKAPKLLISEGNILRPGVPSRFSSSGYGTDFTLTISKLQPEDFATYYCLQSDNLPFTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 818 - protein, 455 aa, Artificial Sequence
  Sonepcizumab_gamma1-Chain_Precursor
MEWSWVFLFFLSVTTGVHSEVQLVQSGAEVKKPGESLKISCQSFGYIFIDHTIHWMRQMPGQGLEWMGAISPRHDITKYNEMFRGQVTISADKSSSTAYLQWSSLKASDTAMYFCARGGFYGSTIWFDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 819 - protein, 446 aa, Artificial Sequence
  Stamulumab_HeavyChain1
VQLVQSGAEVKKPGASVKVSCKASGYTFTSYYMHWVRQAPGQGLEWMGIINPSGGSTSYAQKFQGRVTMTRDTSTSTVYMELSSLRSEDTAVYYCARDENWGFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 820 - protein, 211 aa, Artificial Sequence
  Stamulumab_LightChain1
SYELTQPPSVSVSPGQTASITCSGHALGDKFVSWYQQKPGQSPVLVIYDDTQRPSGIPERFSGSNSGNTATLTISGTQAMDEADYYCQAWDSSFVFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 821 - protein, 452 aa, Artificial Sequence
  Suptavumab_HeavyChain1
EVQLVESGGDLVQPGRSLRLSCVASGFTFDDYAMHWVRQAPGKGLEWVSGVSWSGSTVGYADSVKGRFTVSRDNAQKSLYLQMNSLRAEDTALYYCVKDAYKFNYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 822 - protein, 214 aa, Artificial Sequence
  Suptavumab_LightChain1
EIVMTQSPATLSVSPGERATLSCRASQTILSNLAWYLQKPGQAPRLLIYGASTRATGLPARFSGSGSGTEFTLTISSLQSEDFAVYYCQQYNNWPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 823 - protein, 448 aa, Artificial Sequence
  Suvizumab_HeavyChain1
QVQLVQSGAEVKKPGASVKVSCKASGYTFTNSWIGWFRQAPGQGLEWIGDIYPGGGYTNYNEIFKGKATMTADTSTNTAYMELSSLRSEDTAVYYCSRGIPGYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 824 - protein, 220 aa, Artificial Sequence
  Suvizumab_LightChain1
DIQMTQRPDSLSASVGDRVTMSCKSSQSLLNSGDQKNYLTWYQQKPGQPPKLLIYWASTGESGVPDRFSGSGSGTDFTFTISSLQPEDIATYYCQNDYSYPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 825 - protein, 450 aa, Artificial Sequence
  Tabalumab_HeavyChain1
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARGYYDILTGYYYYFDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 826 - protein, 214 aa, Artificial Sequence
  Tabalumab_LightChain1
EIVLTQSPATLSLSPGERATLSCRASQSVSRYLAWYQQKPGQAPRLLIYDASNRATGIPARFSGSGSGTDSTLTISSLEPEDFAVYYCQQRSNWPRTFGQGTKVEIKRTVAAPSVFIFPPSDEQLKSGTASVVCLLNNFYPREAKVQWKVDNALQSGNSQESVTEQDSKDSTYSLSNTLTLSKADYEKHKVYACEVTHQGLSSPVTKSFNRGEC

SEQ ID NO: 827 - protein, 444 aa, Artificial Sequence
  Tacatuzuab_HeavyChain1
QVQLQQSGAEVKKPGSSVKVSCKASGYAFTSYVIHWVRQAPGQGLYWIGYIHPYNGGTKYNEKFKGKATITADESTNTAYELSSLRSEDTAFYFCARSGGGDPFAYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPGK

SEQ ID NO: 828 - protein, 212 aa, Artificial Sequence
  Tacatuzuab_LightChain1
DIQLTQSPSSLSASVGDRVTITCKASQDINKYIGWYQQKPGKAPKLLHYTSALLPGIPSRFSGSGSGRDYTFTISSLQPEDIATYYCLQYDDLWTFGGGTKLQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 829 - protein, 226 aa, Artificial Sequence
  Tadocizumab_fab_fragment_HeavyChain
QVQLVQSGAEVKKPGSSVKVSCKASGYAFTNYLIEWVRQAPGQGLEWIGVIYPGSGGTNYNEKFKGRVTLTVDESTNTAYMELSSLRSEDTAVYFCARRDGNYGWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTH

SEQ ID NO: 830 - protein, 194 aa, Artificial Sequence
  Tadocizumab_fab_fragment_LightChain
DIQMTQTPSTLSASVGDRVTISCRASQDINNYLNWYQQKPGKAPKLLIYYTSTLHSGVPSRFSGSGSGTDYTLTISSLQPDDFATYFCQQGNTLPWTFGQGTKVEVKRTVAAPSVFIFPPSDEQLKSGTASVVCLLNNFYESVTEQDSKDSTYSLSSTLTLSKADYEKHKVYACEVTHQGLSSPVTKSFNRGEC

SEQ ID NO: 831 - protein, 453 aa, Artificial Sequence
  Talizumab_HeavyChain1
QVQLVQSGAEVKKPGASVKVSCKASGYTFSMYWLEWVRQAPGHGLEWVGEISPGTFTTNYNEKFKARATFTADTSTNTAYMELSSLRSEDTAVYYCARFSHFSGSNYDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 832 - protein, 214 aa, Artificial Sequence
  Talizumab_LightChain1
DILLTQSPGTLSLSPGERATLSCRASQSIGTNIHWYQQKPGQAPRLLIKYASESISGIPSRFSGSGSGTDFTLTISRLEPEDFAMYYCQQSDSWPTTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 833 - protein, 456 aa, Artificial Sequence
  Tamtuvetmab_HeavyChain1
EVKLLESGGGLVQPGGSMRLSCAGSGFTFTDFYMNWIRQPAGKAPEWLGFIRDKAKGYTTEYNPSVKGRFTISRDNTQNMLYLQMNTLRAEDTATYYCAREGHTAAPFDYWGQGTLVTVSSASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVDLDPEDPEVQISWFVDGKQMQTAKTQPREEQFNGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQKSLSHSPGK

SEQ ID NO: 834 - protein, 213 aa, Artificial Sequence
  Tamtuvetmab_LightChain1
DIKMTQSPSFLSASVGDRVTLNCKASQNIDKYLNWYQQKLGESPKLLIYNTNNLQTGIPSRFSGSGSGTDFTLTISSLQPEDVATYFCLQHISRPRTFGGGTHLTVLGQPKASPSVTLFPPSSEELGANKATLVCLISDFYPSGVTVAWKADGSPITQGVETTKPSKQSNNKYAASSYLSLTPDKWKSHSSFSCLVTHEGSTVEKKVAPAECS

SEQ ID NO: 835 - protein, 120 aa, Artificial Sequence
  Tanezumab_HeavyChain
QVQLQESGPGLVKPSETLSLTCTVSGFSLIGYDLNWIRQPPGKGLEWIGIIWGDGTTDYNSAVKSRVTISKDTSKNQFSLKLSSVTAADTAVYYCARGGYWYATSYYFDYWGQGTLVTVS

SEQ ID NO: 836 - protein, 109 aa, Artificial Sequence
  Tanezumab_LightChain
DIQMTQSPSSLSASVGDRVTITCRASQSISNNLNWYQQKPGKAPKLLIYYTSRFHSGVPSRFSGSGSGTDFTFTISSLQPEDIATYYCQQEHTLPYTFGQGTKLEIKRT

SEQ ID NO: 837 - protein, 441 aa, Artificial Sequence
  Tarextumab_HeavyChain1
EVQLVESGGGLVQPGGSLRLSCAASGFTFSSSGMSWVRQAPGKGLEWVSVIASSGSNTYYADSVKGRFTISRDNSKNTLYLQMNSLRAEDTAVYYCARSIFYTTWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 838 - protein, 215 aa, Artificial Sequence
  Tarextumab_LightChain1
DIVLTQSPATLSLSPGERATLSCRASQSVRSNYLAWYQQKPGQAPRLLIYGASSRATGVPARFSGSGSGTDFTLTISSLEPEDFAVYYCQQYSNFPITFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 839 - protein, 121 aa, Artificial Sequence
  Tefibazumab_HeavyChain1
QVQLKESGPGLVKPSQTLSITCTISGFSLSRYSVHWVRQPPGKGLEWLGMIWGGGNTDYNSALKSRLSISKDNSKNQVFLKMNSLTAADTAVYYCARKGEFYYGYDGFVYWGQGTLVTVSS

SEQ ID NO: 840 - protein, 112 aa, Artificial Sequence
  Tefibazumab_LightChain1
DIVMTQSPDSLAVSLGERVTMNCKSSQSVLYSSNQKNYLAWYQQKPGQSPKLLIYWASTRESGVPDRFSGSGSGTDFTLTISSVQAEDLAVYYCHQYLSSYTFGGGTKLEIK

SEQ ID NO: 841 - protein, 456 aa, Artificial Sequence
  Tenatumomab_HeavyChain1
EIQLQQSGPELVKPGASVKVSCKASGYAFTSYNMYWVKQSHGKSLEWIGYIDPYNGVTSYNQKFKGKATLTVDKSSSTAYMHLNSLTSEDSAVYYCARGGGSIYYAMDYWGQGTSVTVSSAKTTPPSVYPLAPGCGDTTGSSVTLGCLVKGYFPESVTVTWNSGSLSSSVHTFPALLQSGLYTMSSSVTVPSSTWPSQTVTCSVAHPASSTTVDKKLEPSGPISTINPCPPCKECHKCPAPNLEGGPSVFIFPPNIKDVLMISLTPKVTCVVVDVSEDDPDVQISWFVNNVEVHTAQTQTHREDYNSTIRVVSTLPIQHQDWMSGKEFKCKVNNKDLPSPIERTISKIKGLVRAPQVYILPPPAEQLSRKDVSLTCLVVGFNPGDISVEWTSNGHTEENYKDTAPVLDSDGSYFIYSKLNMKTSKWEKTDSFSCNVRHEGLKNYYLKKTISRSPGK

SEQ ID NO: 842 - protein, 219 aa, Artificial Sequence
  Tenatumomab_LightChain1
DIVMTQAAPSVPVTPGESVSISCRSSKSLLHSNGNTYLYWFLQRPGQSPQLLIYRMSNLASGVPDRFSGSGSGTAFTLRISRVEAEDVGVYYCMQHLEYPLTFGAGTKLELKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNRNEC

SEQ ID NO: 843 - protein, 452 aa, Artificial Sequence
  Teneliximab_HeavyChain1
QIQLVQSGPELKKPGETVRISCKASGYAFTTTGMQWVQEMPGKGLKWIGWINTHSGVPKYVEDFKGRFAFSLETSANTAYLQISNLKNEDTATYFCVRSGNGNYDLAYFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 844 - protein, 214 aa, Artificial Sequence
  Teneliximab_LightChain1
DIVLTQSPATLSVTPGDRVSLSCRASQSISDYLHWYQQKSHESPRLLIKYASHSISGIPSRFSGSGSGSDFTLSINSVEPEDVGIYYCQHGHSFPWTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 845 - protein, 449 aa, Artificial Sequence
  Teplizumab_HeavyChain1
QVQLVQSGGGVVQPGRSLRLSCKASGYTFTRYTMHWVRQAPGKGLEWIGYINPSRGYTNYNQKVKDRFTISRDNSKNTAFLQMDSLRPEDTGVYFCARYYDDHYCLDYWGQGTPVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 846 - protein, 213 aa, Artificial Sequence
  Teplizumab_LightChain1
DIQMTQSPSSLSASVGDRVTITCSASSSVSYMNWYQQTPGKAPKRWIYDTSKLASGVPSRFSGSGSGTDYTFTISSLQPEDIATYYCQQWSSNPFTFGQGTKLQITRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 847 - protein, 448 aa, Artificial Sequence
  Teprotumumab_HeavyChain1
QVELVESGGGVVQPGRSQRLSCAASGFTFSSYGMHWVRQAPGKGLEWVAIIWFDGSSTYYADSVRGRFTISRDNSKNTLYLQMNSLRAEDTAVYFCARELGRRYFDLWGRGTLVSVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 848 - protein, 215 aa, Artificial Sequence
  Teprotumumab_LightChain1
EIVLTQSPATLSLSPGERATLSCRASQSVSSYLAWYQQKPGQAPRLLIYDASKRATGIPARFSGSGSGTDFTLTISSLEPEDFAVYYCQQRSKWPPWTFGQGTKVESKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 849 - protein, 446 aa, Artificial Sequence
  Tesidolumab_HeavyChain1
EVQLVQSGAEVKKPGSSVKVSCKASGGTFSSYAISWVRQAPGQGLEWMGGIGPFFGTANYAQKFQGRVTITADESTSTAYMELSSLRSEDTAVYYCARDTPYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 850 - protein, 214 aa, Artificial Sequence
  Tesidolumab_LightChain1
SYELTQPLSVSVALGQTARITCSGDSIPNYYVYWYQQKPGQAPVLVIYDDSNRPSGIPERFSGSNSGNTATLTISRAQAGDEADYYCQSFDSSLNAEVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 851 - protein, 448 aa, Artificial Sequence
  Tezepelumab_HeavyChain1
QMQLVESGGGVVQPGRSLRLSCAASGFTFRTYGMHWVRQAPGKGLEWVAVIWYDGSNKHYADSVKGRFTITRDNSKNTLNLQMNSLRAEDTAVYYCARAPQWELVHEAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 852 - protein, 214 aa, Artificial Sequence
  Tezepelumab_LightChain1
SYVLTQPPSVSVAPGQTARITCGGNNLGSKSVHWYQQKPGQAPVLVVYDDSDRPSWIPERFSGSNSGNTATLTISRGEAGDEADYYCQVWDSSSDHVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 853 - protein, 446 aa, Artificial Sequence
  ThioMAb-chMA79b-HC(A118C)_HeavyChain
EVQLQQSGAELMKPGASVKISCKATGYTFSSYWIEWVKQRPGHGLEWIGEILPGGGDTNYNEIFKGKATFTADTSSNTAYMQLSSLTSEDSAVYYCTRRVPVYFDYWGQGTSVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 854 - protein, 449 aa, Artificial Sequence
  ThioMab-hu10A8.v1-HC(A118C)_HeavyChain
EVQLVESGGGLVQPGGSLRLSCAASGFTFSSYAVSWVRQAPGKGLEWVATISSGGSLTFYLDSVRGRFTISRDNSKNTLYLQMNSLRAEDTAVYYCARPIPDYYALDYWGQGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 855 - protein, 449 aa, Artificial Sequence
  ThioMab-hu10A8.v1-HC(V205C)_HeavyChain
EVQLVESGGGLVQPGGSLRLSCAASGFTFSSYAVSWVRQAPGKGLEWVATISSGGSLTFYLDSVRGRFTISRDNSKNTLYLQMNSLRAEDTAVYYCARPIPDYYALDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 856 - protein, 214 aa, Artificial Sequence
  ThioMab-hu10A8.v1-LC(A118C)_LightChain
DIQMTQSPSSLSASVGDRVTITCKASQDVSTAVAWYQQKPGKAPKLLIYSASYRYTGVPSRFSGSGSGTDFTLTISSLQPEDFATYYCQQHFSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 857 - protein, 214 aa, Artificial Sequence
  ThioMab-hu10A8.v1-LC(V205C)_LightChain
DIQMTQSPSSLSASVGDRVTITCKASQDVSTAVAWYQQKPGKAPKLLIYSASYRYTGVPSRFSGSGSGTDFTLTISSLQPEDFATYYCQQHFSSPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPCTKSFNRGEC

SEQ ID NO: 858 - protein, 446 aa, Artificial Sequence
  ThioMAb-huMA79b.v17-HC(A118C)_HeavyChain
EVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPVYFDYWGQGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 859 - protein, 218 aa, Artificial Sequence
  ThioMAb-huMA79b.v17-HC(A118C)_LightChain
DIQLTQSPSSLSASVGDRVTITCKASQSVDYDGDSFLNWYQQKPGKAPKLLIYAASNLESGVPSRFSGSGSGTDFTLTISSLQPEDFATYYCQQSNEDPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 860 - protein, 446 aa, Artificial Sequence
  ThioMAb-huMA79b.v18-HC(A118C)_HeavyChain
EVQLVESGGGLVQPGGSLRLSCAASGYTFSSYWIEWVRQAPGKGLEWIGEILPGGGDTNYNEIFKGRATFSADTSKNTAYLQMNSLRAEDTAVYYCTRRVPIRLDYWGQGTLVTVSSCSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 861 - protein, 218 aa, Artificial Sequence; identical to SEQ ID NO: 705
  ThioMAb-huMA79b.v28-HC(A118C)_LightChain

SEQ ID NO: 862 - protein, 218 aa, Artificial Sequence
  ThioMAb-huMA79b.v28-LC(V205C)_LightChain
DIVLTQSPASLAVSLGQRATISCKASQSVDYDGDSFLNWYQQKPGQPPKLFIYAASNLESGIPARFSGSGSGTDFTLNIHPVEEEDAATYYCQQSNEDPLTFGAGTELELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPCTKSFNRGEC

SEQ ID NO: 863 - protein, 444 aa, Artificial Sequence
  Ticiliuab_HeavyChain1
QVQLVESGGGVVQPGRSLRLSCAASGFTFSSYGHWVRQAPGKGLEWVAVIWYDGSNKYYADSVKGRFTISRDNSKNTLYLQNSLRAEDTAVYYCARDPRGATLYYYYYGDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREETKNQVSLTCLVKGFYPSDIAVEWESNGQPENNYKTTPPLDSDGSFFLYSKLTVDKSRWQQGNVFSCSVHEALHNHYTQKSLSLSPGK

SEQ ID NO: 864 - protein, 213 aa, Artificial Sequence
  Ticiliuab_LightChain1
DIQTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 865 - protein, 449 aa, Artificial Sequence
  Tigatuzumab_HeavyChain1
EVQLVESGGGLVQPGGSLRLSCAASGFTFSSYVMSWVRQAPGKGLEWVATISSGGSYTYYPDSVKGRFTISRDNAKNTLYLQMNSLRAEDTAVYYCARRGDSMITTDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 866 - protein, 449 aa, Artificial Sequence; identical to SEQ ID NO: 865
  Tigatuzumab_HeavyChain

SEQ ID NO: 867 - protein, 213 aa, Artificial Sequence
  Tigatuzumab_LightChain1
DIQMTQSPSSLSASVGDRVTITCKASQDVGTAVAWYQQKPGKAPKLLIYWASTRHTGVPSRFSGSGSGTDFTLTISSLQPEDFATYYCQQYSSYRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 868 - protein, 213 aa, Artificial Sequence; identical to SEQ ID NO: 867
  Tigatuzumab_LightChain

SEQ ID NO: 869 - protein, 446 aa, Artificial Sequence
  Tildrakizumab_HeavyChain1
QVQLVQSGAEVKKPGASVKVSCKASGYIFITYWMTWVRQAPGQGLEWMGQIFPASGSADYNEKFEGRVTMTTDTSTSTAYMELRSLRSDDTAVYYCARGGGGFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 870 - protein, 214 aa, Artificial Sequence
  Tildrakizumab_LightChain1
DIQMTQSPSSLSASVGDRVTITCRTSENIYSYLAWYQQKPGKAPKLLIYNAKTLAEGVPSRFSGSGSGTDFTLTISSLQPEDFATYYCQHHYGIPFTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 871 - protein, 448 aa, Artificial Sequence
  Tisotumab_vedotin_HeavyChain1
EVQLLESGGGLVQPGGSLRLSCAASGFTFSNYAMSWVRQAPGKGLEWVSSISGSGDYTYYTDSVKGRFTISRDNSKNTLYLQMNSLRAEDTAVYYCARSPWGYYLDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 872 - protein, 214 aa, Artificial Sequence
  Tisotumab_vedotin_LightChain1
DIQMTQSPPSLSASAGDRVTITCRASQGISSRLAWYQQKPEKAPKSLIYAASSLQSGVPSRFSGSGSGTDFTLTISSLQPEDFATYYCQQYNSYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 873 - protein, 447 aa, Artificial Sequence
  Tocilizumab_HeavyChain1
VQLQESGPGLVRPSQTLSLTCTVSGYSITSDHAWSWVRQPPGRGLEWIGYISYSGITTYNPSLKSRVTMLRDTSKNQFSLRLSSVTAADTAVYYCARSLARTTAMDYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 874 - protein, 214 aa, Artificial Sequence [sequence omitted]

SEQ ID NO: 875 - protein, 451 aa, Artificial Sequence
  Tosatoxumab_HeavyChain1
EVQMVQSGAEVKKPGEPLKISCKGSGYKFGTHWIGWVRQRPGKGLEWMGIIHPADSETKYSPSFQGQVSFSADKSSNTAYLHWSTLRASDTAMYYCARRSGSSSWYALDFWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 876 - protein, 217 aa, Artificial Sequence
  Tosatoxumab_LightChain1
QSVLTQSPSASGTPGQRVTISCSGGSSNIGSNTVNWYQQFPGAAPKLLIYTNNQRPSGVPDRFSGSKSGTSASLAISGLQSEDEADYYCATWDDSLNGLYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 877 - protein, 447 aa, Artificial Sequence
  Tositumomab_HeavyChain
QAYLQQSGAELVRPGASVKMSCKASGYTFTSYNMHWVKQTPRQGLEWIGAIYPGNGDTSYNQKFKGKATLTVDKSSSTAYMQLSSLTSEDSAVYFCARVVYYSNSYWYFDVWGTGTTVTVSGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKAEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 878 - protein, 210 aa, Artificial Sequence
  Tositumomab_LightChain
QIVLSQSPAILSASPGEKVTMTCRASSSVSYMHWYQQKPGSSPKPWIYAPSNLASGVPARFSGSGSGTSYSLTISRVEAEDAATYYCQQWSFNPPTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 879 - protein, 446 aa, Artificial Sequence
  Tovetumab_HeavyChain1
QVQLVESGGGLVKPGGSLRLSCAASGFTFSDYYMNWIRQAPGKGLEWVSYISSSGSIIYYADSVKGRFTISRDNAKNSLYLQMNSLRAEDTAVYYCAREGRIAARGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 880 - protein, 215 aa, Artificial Sequence
  Tovetumab_LightChain1
DIQMTQSPSSLSASVGDRVSITCRPSQSFSRYINWYQQKPGKAPKLLIHAASSLVGGVPSRFSGSGSGTDFTLTISSLQPEDFATYYCQQTYSNPPITFGQGTRLEMKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 881 - protein, 449 aa, Artificial Sequence
  Tralokinumab_HeavyChain1
QVQLVQSGAEVKKPGASVKVSCKASGYTFTNYGLSWVRQAPGQGLEWMGWISANNGDTNYGQEFQGRVTMTTDTSTSTAYMELRSLRSDDTAVYYCARDSSSSWARWFFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 882 - protein, 214 aa, Artificial Sequence
  Tralokinumab_LightChain1
SYVLTQPPSVSVAPGKTARITCGGNIIGSKLVHWYQQKPGQAPVLVIYDDGDRPSGIPERFSGSNSGNTATLTISRVEAGDEADYYCQVWDTGSDPVVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 883 - protein, 444 aa, Artificial Sequence
  Trastuzuab_HeavyChain1
EVQLVESGGGLVQPGGSLRLSCAASGFNIKDTYIHWVRQAPGKGLEWVARIYPTNGYTRYADSVKGRFTISADTSKNTAYLQNSLRAEDTAVYYCSRWGGDGFYADYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPG

SEQ ID NO: 884 - protein, 213 aa, Artificial Sequence
  Trastuzuab_LightChain1
DIQTQSPSSLSASVGDRVTITCRASQDVNTAVAWYQQKPGKAPKLLIYSASFLYSGVPSRFSGSRSGTDFTLTISSLQPEDFATYYCQQHYTTPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 885 - protein, 449 aa, Artificial Sequence
  Trastuzumab_emtansine_HeavyChain1
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 886 - protein, 214 aa, Artificial Sequence; identical to SEQ ID NO: 742
  Trastuzumab_emtansine_LightChain1

SEQ ID NO: 887 - protein, 449 aa, Artificial Sequence; identical to SEQ ID NO: 885
  Trastuzumab_HeavyChain1

SEQ ID NO: 888 - protein, 451 aa, Artificial Sequence
  Trastuzumab_HeavyChain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 889 - protein, 220 aa, Artificial Sequence
  Trastuzumab_HeavyChain_variant_1n8z_B
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 890 - protein, 15 aa, Artificial Sequence
  Trastuzumab_HeavyChain_variant_7637_H
EPKSCDKTHTCPPCP

SEQ ID NO: 891 - protein, 214 aa, Artificial Sequence; identical to SEQ ID NO: 742
  Trastuzumab_LightChain1

SEQ ID NO: 892 - protein, 214 aa, Artificial Sequence; identical to SEQ ID NO: 742
  Trastuzumab_LightChain_variant_1n8z_A

SEQ ID NO: 893 - protein, 214 aa, Artificial Sequence; identical to SEQ ID NO: 742
  Trastuzumab_LightChain_variant_7637_L

SEQ ID NO: 894 - protein, 448 aa, Artificial Sequence
  TRC-105_HeavyChain1
EVKLEESGGGLVQPGGSMKLSCAASGFTFSDAWMDWVRQSPEKGLEWVAEIRSKASNHATYYAESVKGRFTISRDDSKSSVYLQMNSLRAEDTGIYYCTRWRRFFDSWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 895 - protein, 213 aa, Artificial Sequence
  TRC-105_LightChain1
QIVLSQSPAILSASPGEKVTMTCRASSSVSYMHWYQQKPGSSPKPWIYATSNLASGVPVRFSGSGSGTSYSLTISRVEAEDAATYYCQQWSSNPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 896 - protein, 454 aa, Artificial Sequence
  Tregalizumab_HeavyChain1
EEQLVESGGGLVKPGGSLRLSCAASGFSFSDCRMYWLRQAPGKGLEWIGVISVKSENYGANYAESVRGRFTISRDDSKNTVYLQMNSLKTEDTAVYYCSASYYRYDVGAWFAYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 897 - protein, 218 aa, Artificial Sequence
  Tregalizumab_LightChain1
DIVMTQSPDSLAVSLGERATINCRASKSVSTSGYSYIYWYQQKPGQPPKLLIYLASILESGVPDRFSGSGSGTDFTLTISSLQAEDVAVYYCQHSRELPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 898 - protein, 451 aa, Artificial Sequence
  Tremelimumab_HeavyChain1
QVQLVESGGGVVQPGRSLRLSCAASGFTFSSYGMHWVRQAPGKGLEWVAVIWYDGSNKYYADSVKGRFTISRDNSKNTLYLQMNSLRAEDTAVYYCARDPRGATLYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 899 - protein, 214 aa, Artificial Sequence
  Tremelimumab_LightChain1
DIQMTQSPSSLSASVGDRVTITCRASQSINSYLDWYQQKPGKAPKLLIYAASSLQSGVPSRFSGSGSGTDFTLTISSLQPEDFATYYCQQYYSTPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 900 - protein, 447 aa, Artificial Sequence
  Trevogrumab_HeavyChain1
EVQVLESGGDLVQPGGSLRLSCAASGFTFSAYAMTWVRQAPGKGLEWVSAISGSGGSAYYADSVKGRFTISRDNSKNTVYLQMNSLRAEDTAVYYCAKDGAWKMSGLDVWGQGTTVIVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 901 - protein, 214 aa, Artificial Sequence
  Trevogrumab_LightChain1
DIQMTQSPASLSASVGDRVTITCRASQDISDYLAWYQQKPGKIPRLLIYTTSTLQSGVPSRFRGSGSGTDFTLTISSLQPEDVATYYCQKYDSAPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 902 - protein, 579 aa, Artificial Sequence
  Tucotuzumab_celmoleukin_HeavyChain1
QIQLVQSGAEVKKPGETVKISCKASGYTFTNYGMNWVKQTPGKGLKWMGWINTYTGEPTYADDFKGRFAFSLETSTSTAFLQINNLRSEDTATYFCVRFISKGDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGKAPTSSSTKKTQLQLEHLLLDLQMILNGINNYKNPKLTRMLTFKFYMPKKATELKHLQCLEEELKPLEEVLNLAQSKNFHLRPRDLISNINVIVLELKGSETTFMCEYADETATIVEFLNRWITFCQSIISTLT

SEQ ID NO: 903 - protein, 213 aa, Artificial Sequence
  Tucotuzumab_celmoleukin_LightChain1
EIVLTQSPATLSLSPGERVTLTCSASSSVSYMLWYQQKPGSSPKPWIFDTSNLASGFPARFSGSGSGTSYSLIISSMEAEDAATYYCHQRSGYPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 904 - protein, 448 aa, Artificial Sequence
  Ublituximab_HeavyChain1
QAYLQQSGAELVRPGASVKMSCKASGYTFTSYNMHWVKQTPRQGLEWIGGIYPGNGDTSYNQKFKGKATLTVGKSSSTAYMQLSSLTSEDSAVYFCARYDYNYAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 905 - protein, 213 aa, Artificial Sequence
  Ublituximab_LightChain1
QIVLSQSPAILSASPGEKVTMTCRASSSVSYMHWYQQKPGSSPKPWIYATSNLASGVPARFSGSGSGTSYSFTISRVEAEDAATYYCQQWTFNPPTFGGGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 906 - protein, 451 aa, Artificial Sequence
  Ulocuplumab_HeavyChain1
EVQLVESGGGLVQPGGSLRLSCAAAGFTFSSYSMNWVRQAPGKGLEWVSYISSRSRTIYYADSVKGRFTISRDNAKNSLYLQMNSLRDEDTAVYYCARDYGGQPPYYYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLG

SEQ ID NO: 907 - protein, 214 aa, Artificial Sequence
  Ulocuplumab_LightChain1
DIQMTQSPSSLSASVGDRVTITCRASQGISSWLAWYQQKPEKAPKSLIYAASSLQSGVPSRFSGSGSGTDFTLTISSLQPEDFVTYYCQQYNSYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 908 - protein, 448 aa, Artificial Sequence
  Urelumab_HeavyChain1
QVQLQQWGAGLLKPSETLSLTCAVYGGSFSGYYWSWIRQSPEKGLEWIGEINHGGYVTYNPSLESRVTISVDTSKNQFSLKLSSVTAADTAVYYCARDYGPGNYDWYFDLWGRGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 909 - protein, 216 aa, Artificial Sequence
  Urelumab_LightChain1
EIVLTQSPATLSLSPGERATLSCRASQSVSSYLAWYQQKPGQAPRLLIYDASNRATGIPARFSGSGSGTDFTLTISSLEPEDFAVYYCQQRSNWPPALTFCGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 910 - protein, 449 aa, Artificial Sequence
  Urtoxazumab_HeavyChain1
EVQLVESGGGLVQPGGSLRLSCAASGFTFSSYGMSWVRQAPGKGLEWVATISTGGSYTYYPDSVKGRFTISRDNAKNTLYLQMNSLRAEDTAVYYCARRGDAWGNLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 911 - protein, 214 aa, Artificial Sequence
  Urtoxazumab_LightChain1
EIVLTQSPATLSVSPGERATLSCRASQTISNNLHWYQQKPGQAPRLLIKSASQSISGIPARFSGSGSGTDFTLTISSLESEDFAVYYCQQSYSWPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 912 - protein, 449 aa, Artificial Sequence
  Ustekinumab_HeavyChain1
EVQLVQSGAEVKKPGESLKISCKGSGYSFTTYWLGWVRQMPGKGLDWIGIMSPVDSDIRYSPSFQGQVTMSVDKSITTAYLQWNSLKASDTAMYYCARRRPGQGYFDFWGQGTLVTVSSSSTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 913 - protein, 214 aa, Artificial Sequence
  Ustekinumab_LightChain1
DIQMTQSPSSLSASVGDRVTITCRASQGISSWLAWYQQKPEKAPKSLIYAASSLQSGVPSRFSGSGSGTDFTLTISSLQPEDFATYYCQQYNIYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 914 - protein, 447 aa, Artificial Sequence
  Vadastuximab_talirine_HeavyChain1
QVQLVQSGAEVKKPGASVKVSCKASGYTFTNYDINWVRQAPGQGLEWIGWIYPGDGSTKYNEKFKAKATLTADTSTSTAYMELRSLRSDDTAVYYCASGYEDAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPCVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 915 - protein, 214 aa, Artificial Sequence
  Vadastuximab_talirine_LightChain1
DIQMTQSPSSLSASVGDRVTINCKASQDINSYLSWFQQKPGKAPKTLIYRANRLVDGVPSRFSGSGSGQDYTLTISSLQPEDFATYYCLQYDEFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 916 - protein, 454 aa, Artificial Sequence
  Vandortuzumab_vedotin_HeavyChain1
EVQLVESGGGLVQPGGSLRLSCAVSGYSITSDYAWNWVRQAPGKGLEWVGYISNSGSTSYNPSLKSRFTISRDTSKNTLYLQMNSLRAEDTAVYYCARERNYDYDDYYYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 917 - protein, 220 aa, Artificial Sequence
  Vandortuzumab_vedotin_LightChain1
DIQMTQSPSSLSASVGDRVTITCKSSQSLLYRSNQKNYLAWYQQKPGKAPKLLIYWASTRESGVPSRFSGSGSGTDFTLTISSLQPEDFATYYCQQYYNYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 918 - protein, 443 aa, Artificial Sequence
  Vantictumab_HeavyChain1
EVQLVESGGGLVQPGGSLRLSCAASGFTFSHYTLSWVRQAPGKGLEWVSVISGDGSYTYYADSVKGRFTISSDNSKNTLYLQMNSLRAEDTAVYYCARNFIKYVFANWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPG

SEQ ID NO: 919 - protein, 213 aa, Artificial Sequence
  Vantictumab_LightChain1
DIELTQPPSVSVAPGQTARISCSGDNIGSFYVHWYQQKPGQAPVLVIYDKSNRPSGIPERFSGSNSGNTATLTISGTQAEDEADYYCQSYANTLSLVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 920 - protein, 463 aa, Artificial Sequence
  Vanucizumab_HeavyChain1
QVQLVQSGAEVKKPGASVKVSCKASGYTFTGYYMHWVRQAPGQGLEWMGWINPNSGGTNYAQKFQGRVTMTRDTSISTAYMELSRLRSDDTAVYYCARSPNPYYYDSSGYYYPGAFDIWGQGTMVTVSSASVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGECDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVCTLPPSRDELTKNQVSLSCAVKGFYPSDIAVEWESNGQPENNYKTTPPVLDSDGSFFLVSKLTVDKSRWQQGNVFSCSVMHEALHNHYTQKSLSLSPGK

SEQ ID NO: 921 - protein, 453 aa, Artificial Sequence
  Vanucizumab_HeavyChain2
EVQLVESGGGLVQPGGSLRLSCAASGYTFTNYGMNWVRQAPGKGLEWVGWINTYTGEPTYAADFKRRFTFSLDTSKSTAYLQMNSLRAEDTAVYYCAKYPHYYGSSHWYFDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPCRDELTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 922 - protein, 213 aa, Artificial Sequence
  Vanucizumab_LightChain1
QPGLTQPPSVSVAPGQTARITCGGNNIGSKSVHWYQQKPGQAPVLVVYDDSDRPSGIPERFSGSNSGNTATLTISRVEAGDEADYYCQVWDSSSDHYVFGTGTKVTVLSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 923 - protein, 214 aa, Artificial Sequence; identical to SEQ ID NO: 84
  Vanucizumab_LightChain2

SEQ ID NO: 924 - protein, 452 aa, Artificial Sequence
  Varlilumab_HeavyChain1
QVQLVESGGGVVQPGRSLRLSCAASGFTFSSYDMHWVRQAPGKGLEWVAVIWYDGSNKYYADSVKGRFTISRDNSKNTLYLQMNSLRAEDTAVYYCARGSGNWGFFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGKGSS

SEQ ID NO: 925 - protein, 214 aa, Artificial Sequence
  Varlilumab_LightChain1
DIQMTQSPSSLSASVGDRVTITCRASQGISRWLAWYQQKPEKAPKSLIYAASSLQSGVPSRFSGSGSGTDFTLTISSLQPEDFATYYCQQYNTYPRTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 926 - protein, 446 aa, Artificial Sequence
  Vatelizumab_HeavyChain1
QVQLQESGPGLVKPSETLSLTCTVSGFSLTNYGIHWIRQPPGKGLEWLGVIWARGFTNYNSALMSRLTISKDNSKNQVSLKLSSVTAADTAVYYCARANDGVYYAMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 927 - protein, 213 aa, Artificial Sequence
  Vatelizumab_LightChain1
DFVMTQSPAFLSVTPGEKVTITCSAQSSVNYIHWYQQKPDQAPKKLIYDTSKLASGVPSRFSGSGSGTDYTFTISSLEAEDAATYYCQQWTTNPLTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 928 - protein, 451 aa, Artificial Sequence
  Vedolizumab_HeavyChain1
QVQLVQSGAEVKKPGASVKVSCKGSGYTFTSYWMHWVRQAPGQRLEWIGEIDPSESNTNYNQKFKGRVTLTVDISASTAYMELSSLRSEDTAVYYCARGGYDGWDYAIDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELAGAPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 929 - protein, 219 aa, Artificial Sequence
  Vedolizumab_LightChain1
DVVMTQSPLSLPVTPGEPASISCRSSQSLAKSYGNTYLSWYLQKPGQSPQLLIYGISNRFSGVPDRFSGSGSGTDFTLKISRVEAEDVGVYYCLQGTHQPYTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 930 - protein, 451 aa, Artificial Sequence
  Veltuzumab_HeavyChain1
QVQLQQSGAEVKKPGSSVKVSCKASGYTFTSYNMHWVKQAPGQGLEWIGAIYPGMGDTSYNQKFKGKATLTADESTNTAYMELSSLRSEDTAFYYCARSTYYGGDWYFDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 931 - protein, 213 aa, Artificial Sequence
  Veltuzumab_LightChain1
DIQLTQSPSSLSASVGDRVTMTCRASSSVSYIHWFQQKPGKAPKPWIYATSNLASGVPVRFSGSGSGTDYTFTISSLQPEDIATYYCQQWTSNPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 932 - protein, 453 aa, Artificial Sequence
  Vesencumab_HeavyChain1
EVQLVESGGGLVQPGGSLRLSCAASGFTFSSYAMSWVRQAPGKGLEWVSQISPAGGYTNYADSVKGRFTISADTSKNTAYLQMNSLRAEDTAVYYCARGELPYYRMSKVMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 933 - protein, 214 aa, Artificial Sequence
  Vesencumab_LightChain1
DIQMTQSPSSLSASVGDRVTITCRASQYFSSYLAWYQQKPGKAPKLLIYGASSRASGVPSRFSGSGSGTDFTLTISSLQPEDFATYYCQQYLGSPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 934 - protein, 446 aa, Artificial Sequence
  Visilizumab_HeavyChain1
QVQLVQSGAEVKKPGASVKVSCKASGYTFISYTMHWVRQAPGQGLEWMGYINPRSGYTHYNQKLKDKATLTADKSASTAYMELSSLRSEDTAVYYCARSAYYDYDGFAYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPAAAPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPSK

SEQ ID NO: 935 - protein, 213 aa, Artificial Sequence
  Visilizumab_LightChain1
DIQMTQSPSSLSASVGDRVTITCSASSSVSYMNWYQQKPGKAPKRLIYDTSKLASGVPSRFSGSGSGTDFTLTISSLQPEDFATYYCQQWSSNPPTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 936 - protein, 451 aa, Artificial Sequence
  Volociximab_HeavyChain
QVQLKESGPGLVAPSQSLSITCTISGFSLTDYGVHWVRQPPGKGLEWLVVIWSDGSSTYNSALKSRMTIRKDNSKSQVFLIMNSLQTDDSAMYYCARHGTYYGMTTTGDALDYWGQGTSVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPSCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 937 - protein, 215 aa, Artificial Sequence
  Volociximab_LightChain
QIVLTQSPAIMSASLGERVTMTCTASSSVSSNYLHWYQQKPGSAPNLWIYSTSNLASGVPARFSGSGSGTSYSLTISSMEAEDAATYYCHQYLRSPPTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 938 - protein, 448 aa, Artificial Sequence
  Vorsetuzumab_HeavyChain1
QVQLVQSGAEVKKPGASVKVSCKASGYTFTNYGMNWVRQAPGQGLKWMGWINTYTGEPTYADAFKGRVTMTRDTSISTAYMELSRLRSDDTAVYYCARDYGDYGMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 939 - protein, 218 aa, Artificial Sequence
  Vorsetuzumab_LightChain1
DIVMTQSPDSLAVSLGERATINCRASKSVSTSGYSFMHWYQQKPGQPPKLLIYLASNLESGVPDRFSGSGSGTDFTLTISSLQAEDVAVYYCQHSREVPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 940 - protein, 448 aa, Artificial Sequence; identical to SEQ ID NO: 938
  Vorsetuzumab_mafodotin_HeavyChain1

SEQ ID NO: 941 - protein, 218 aa, Artificial Sequence; identical to SEQ ID NO: 939
  Vorsetuzumab_mafodotin_LightChain1

SEQ ID NO: 942 - protein, 449 aa, Artificial Sequence; identical to SEQ ID NO: 164
  Yttrium_(90Y)_clivatuzumab_tetraxetan_HeavyChain1

SEQ ID NO: 943 - protein, 215 aa, Artificial Sequence; identical to SEQ ID NO: 165
  Yttrium_(90Y)_clivatuzumab_tetraxetan_LightChain1

SEQ ID NO: 944 - protein, 446 aa, Artificial Sequence
  Yttrium_Y_90_epratuzumab_tetraxetan_HeavyChain1
QVQLVQSGAEVKKPGSSVKVSCKASGYTFTSYWLHWVRQAPGQGLEWIGYINPRNDYTEYNQNFKDKATITADESTNTAYMELSSLRSEDTAFYFCARRDITTFYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 945 - protein, 219 aa, Artificial Sequence
  Yttrium_Y_90_epratuzumab_tetraxetan_LightChain1
DIQLTQSPSSLSASVGDRVTMSCKSSQSVLYSANHKNYLAWYQQKPGKAPKLLIYWASTRESGVPSRFSGSGSGTDFTFTISSLQPEDIATYYCHQYLSSWTFGGGTKVQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 946 - protein, 442 aa, Artificial Sequence
  Yttrium_Y_90_epratuzumab_HeavyChain1
QVQLVQSGAEVKKPGSSVKVSCKASGYTFTSYWLHWVRQAPGQGLEWIGYINPRNDYTEYNQNFKDKATITADESTNTAYELSSLRSEDTAFYFCARRDITTFYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREETKNQVSLTCLVKGFYPSDIAVEWESNGQPENNYKTTPPVLDSDGSFFLYSKLTVDKSRWQQGNVFSCSVHEALHNHYTQKSLSLSPGK

SEQ ID NO: 947 - protein, 218 aa, Artificial Sequence
  Yttrium_Y_90_epratuzumab_LightChain1
DIQLTQSPSSLSASVGDRVTSCKSSQSVLYSANHKNYLAWYQQKPGKAPKLLIYWASTRESGVPSRFSGSGSGTDFTFTISSLQPEDIATYYCHQYLSSWTFGGGTKVQIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 948 - protein, 455 aa, Artificial Sequence
  Zalutumumab_HeavyChain1
QVQLVESGGGVVQPGRSLRLSCAASGFTFSTYGMHWVRQAPGKGLEWVAVIWDDGSYKYYGDSVKGRFTISRDNSKNTLYLQMNSLRAEDTAVYYCARDGITMVRGVMKDYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 949 - protein, 214 aa, Artificial Sequence
  Zalutumumab_LightChain1
AIQLTQSPSSLSASVGDRVTITCRASQDISSALVWYQQKPGKAPKLLIYDASSLESGVPSRFSGSESGTDFTLTISSLQPEDFATYYCQQFNSYPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 950 - protein, 444 aa, Artificial Sequence
  Zanolimumab_H0_HeavyChain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARVINWFDPWGQGTLVTVSSASTKGPSVFPLAPSSKSTSGGTAALGCLVKDYFPEPVTVSWNSGALTSGVHTFPAVLQSSGLYSLSSWTVPSSSLGTQTYICNVNFIKPSNTKVDKKVEPKSCDKTHTCPPCPAPELLGGPSVFLFPPKPKDTLMISRTPEVTCVWDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 951 - protein, 214 aa, Artificial Sequence
  Zanolimumab_L0_LightChain
DIQMTQSPSSVSASVGDRVTITCRASQDISSWLAVVYQHKPGKAPKLLIYAASSLQSGVPSRFSGSGSGTDFTLTISSLQPEDFATYYCQQANSFPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKFNRGEC

SEQ ID NO: 952 - protein, 448 aa, Artificial Sequence; identical to SEQ ID NO: 571
  Zatuximab_HeavyChain1

SEQ ID NO: 953 - protein, 219 aa, Artificial Sequence; identical to SEQ ID NO: 572
  Zatuximab_LightChain1

SEQ ID NO: 954 - protein, 452 aa, Artificial Sequence
  Actoxumab_HeavyChain
QVQLVESGGGVVQPGRSLRLSCAASGFSFSNYGMHWVRQAPGKGLEWVALIWYDGSNEDYTDSVKGRFTISRDNSKNTLYLQMNSLRAEDTAVYYCARWGMVRGVIDVFDIWGQGTVVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 955 - protein, 214 aa, Artificial Sequence
  Actoxumab_LightChain
DIQMTQSPSSVSASVGDRVTITCRASQGISSWLAWYQHKPGKAPKLLIYAASSLQSGVPSRFSGSGSGTDFTLTISSLQPEDFATYYCQQANSFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 956 - protein, 442 aa, Artificial Sequence
  Andecaliximab_HeavyChain
QVQLQESGPGLVKPSETLSLTCTVSGFSLLSYGVHWVRQPPGKGLEWLGVIWTGGTTNYNSALMSRFTISKDDSKNTVYLKMNSLKTEDTAIYYCARYYYGMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 957 - protein, 214 aa, Artificial Sequence
  Andecaliximab_LightChain
DIQMTQSPSSLSASVGDRVTITCKASQDVRNTVAWYQQKPGKAPKLLIYSSSYRNTGVPDRFSGSGSGTDFTLTISSLQAEDVAVYYCQQHYITPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 958 - protein, 451 aa, Artificial Sequence
  Aprutumab_HeavyChain
EVQLLESGGGLVQPGGSLRLSCAASGFTFSSYAMSWVRQAPGKGLEWVSAISGSGTSTYYADSVKGRFTISRDNSKNTLYLQMNSLRAEDTAVYYCARVRYNWNHGDWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 959 - protein, 216 aa, Artificial Sequence
  Aprutumab_LightChain
QSVLTQPPSASGTPGQRVTISCSGSSSNIGNNYVSWYQQLPGTAPKLLIYENYNRPAGVPDRFSGSKSGTSASLAISGLRSEDEADYYCSSWDDSLNYWVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 960 - protein, 447 aa, Artificial Sequence
  Azintuxizumab_HeavyChain
EVQLVESGGGLVQPGGSLRLSCAASGFTFSDYYMAWVRQAPGKGLEWVASINYDGSSTYYVDSVKGRFTISRDNAKNSLYLQMNSLRAEDTAVYYCARDRGYYFDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 961 - protein, 220 aa, Artificial Sequence
  Azintuxizumab_LightChain
DVVMTQTPLSLSVTPGQPASISCRSSQSLVHSNGNTYLHWYLQKPGQSPQLLIYKVSNRFSGVPDRFSGSGSGTDFTLKISRVEAEDVGVYFCSQSTHVPPFTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 962 - protein, 122 aa, Artificial Sequence
  Blinatumomab_HeavyChain1
QVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTV

SEQ ID NO: 963 - protein, 121 aa, Artificial Sequence
  Blinatumomab_HeavyChain2
DIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVE

SEQ ID NO: 964 - protein, 498 aa, Artificial Sequence
  Blinatumomab_LightChain_HeavyChain_HeavyChain_LightChain
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIKGGGGSGGGGSGGGGSQVQLQQSGAELVRPGSSVKISCKASGYAFSSYWMNWVKQRPGQGLEWIGQIWPGDGDTNYNGKFKGKATLTADESSSTAYMQLSSLASEDSAVYFCARRETTTVGRYYYAMDYWGQGTTVTVSSGGGGSDIKLQQSGAELARPGASVKMSCKTSGYTFTRYTMHWVKQRPGQGLEWIGYINPSRGYTNYNQKFKDKATLTTDKSSSTAYMQLSSLTSEDSAVYYCARYYDDHYCLDYWGQGTTLTVSSVEGGSGGSGGSGGSGGVDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 965 - protein, 111 aa, Artificial Sequence
  Blinatumomab_LightChain1
DIQLTQSPASLAVSLGQRATISCKASQSVDYDGDSYLNWYQQIPGQPPKLLIYDASNLVSGIPPRFSGSGSGTDFTLNIHPVEKVDAATYHCQQSTEDPWTFGGGTKLEIK

SEQ ID NO: 966 - protein, 108 aa, Artificial Sequence
  Blinatumomab_LightChain2
VDDIQLTQSPAIMSASPGEKVTMTCRASSSVSYMNWYQQKSGTSPKRWIYDTSKVASGVPYRFSGSGSGTSYSLTISSMEAEDAATYYCQQWSSNPLTFGAGTKLELK

SEQ ID NO: 967 - protein, 450 aa, Artificial Sequence
  Brazikumab_HeavyChain
QVQLVESGGGVVQPGRSLRLSCAASGFTFSSYGMHWVRQAPGKGLEWVAVIWYDGSNEYYADSVKGRFTISRDNSKNTLYLQMNSLRAEDTAVYYCARDRGYTSSWYPDAFDIWGQGTMVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 968 - protein, 217 aa, Artificial Sequence
  Brazikumab_LightChain
QSVLTQPPSVSGAPGQRVTISCTGSSSNTGAGYDVHWYQQVPGTAPKLLIYGSGNRPSGVPDRFSGSKSGTSASLAITGLQAEDEADYYCQSYDSSLSGWVFGGGTRLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 969 - protein, 121 aa, Artificial Sequence
  Brolucizumab_HeavyChain
SEVQLVESGGGLVQPGGSLRLSCTASGFSLTDYYYMTWVRQAPGKGLEWVGFIDPDDDPYYATWAKGRFTISRDNSKNTLYLQMNSLRAEDTAVYYCAGGDHNSGWGLDIWGQGTLVTVSS

SEQ ID NO: 970 - protein, 111 aa, Artificial Sequence
  Brolucizumab_LightChain
MEIVMTQSPSTLSASVGDRVIITCQASEIIHSWLAWYQQKPGKAPKLLIYLASTLASGVPSRFSGSGSGAEFTLTISSLQPDDFATYYCQNVYLASTNGANFGQGTKLTVL

SEQ ID NO: 971 - protein, 449 aa, Artificial Sequence
  Cabiralizumab_HeavyChain
QVQLVQSGAEVKKPGSSVKVSCKASGYTFTDNYMIWVRQAPGQGLEWMGDINPYNGGTTFNQKFKGRVTITADKSTSTAYMELSSLRSEDTAVYYCARESPYFSNLYVMDYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 972 - protein, 218 aa, Artificial Sequence
  Cabiralizumab_LightChain
EIVLTQSPATLSLSPGERATLSCKASQSVDYDGDNYMNWYQQKPGQAPRLLIYAASNLESGIPARFSGSGSGTDFTLTISSLEPEDFAVYYCHLSNEDLSTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 973 - protein, 443 aa, Artificial Sequence
  Camrelizumab_HeavyChain
EVQLVESGGGLVQPGGSLRLSCAASGFTFSSYMMSWVRQAPGKGLEWVATISGGGANTYYPDSVKGRFTISRDNAKNSLYLQMNSLRAEDTAVYYCARQLYYFDYWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 974 - protein, 214 aa, Artificial Sequence
  Camrelizumab_LightChain
DIQMTQSPSSLSASVGDRVTITCLASQTIGTWLTWYQQKPGKAPKLLIYTATSLADGVPSRFSGSGSGTDFTLTISSLQPEDFATYYCQQVYSIPWTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 975 - protein, 259 aa, Artificial Sequence; identical to SEQ ID NO: 142
  Caplacizumab_HeavyChain

SEQ ID NO: 976 - protein, 219 aa, Artificial Sequence
  Citatuzumab_bogatox_HeavyChain
EVQLVQSGPGLVQPGGSVRISCAASGYTFTNYGMNWVKQAPGKGLEWMGWINTYTGESTYADSFKGRFTFSLDTSASAAYLQINSLRAEDTAVYYCARFAIKGDYWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 977 - protein, 452 aa, Artificial Sequence
  Cosfroviximab_HeavyChain
DVKLLESGGGLVQPGGSLKLSCAASGFSLSTSGVGVGWFRQPSGKGLEWLALIWWDDDKYYNPSLKSQLSISKDFSRNQVFLKISNVDIADTATYYCARRDPFGYDNAMGYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 978 - protein, 213 aa, Artificial Sequence
  Cosfroviximab_LightChain
DIVMTQSPLSLSTSVGDRVSLTCKASQNVGTAVAWYQQKPGQSPKLLIYSASNRYTGVPDRFTGSGSGTDFTLTISNMQSEDLADYFCQQYSSYPLTFGAGTKLELRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 979 - protein, 448 aa, Artificial Sequence
  Crizanlizumab_HeavyChain
QVQLVQSGAEVKKPGASVKVSCKVSGYTFTSYDINWVRQAPGKGLEWMGWIYPGDGSIKYNEKFKGRVTMTVDKSTDTAYMELSSLRSEDTAVYYCARRGEYGNYEGAMDYWGQGTLVTVSSASTKGPSVFPLAPCSRSTSESTAALGCLVKDYFPEPVTVSWNSGALTSGVHTFPAVLQSSGLYSLSSVVTVTSSNFGTQTYTCNVDHKPSNTKVDKTVERKCCVECPPCPAPPVAGPSVFLFPPKPKDTLMISRTPEVTCVVVDVSHEDPEVQFNWYVDGMEVHNAKTKPREEQFNSTFRVVSVLTVVHQDWLNGKEYKCAVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 980 - protein, 218 aa, Artificial Sequence
  Crizanlizumab_LightChain
DIQMTQSPSSLSASVGDRVTITCKASQSVDYDGHSYMNWYQQKPGKAPKLLIYAASNLESGVPSRFSGSGSGTDFTLTISSLQPEDFATYYCQQSDENPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 981 - protein, 455 aa, Artificial Sequence
  Crotedumab_HeavyChain
EVQLVESGGGLVQPGGSLRLSCAASGFTFSNYLMNWVRQAPGKGLEWLANIQEDGIEKYYVDSVKGRFTISRDNAKNSLYLQMNSLRAEDTAVYYCAREPSHYDILTGYDYYYGMDVWGQGTTVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 982 - protein, 214 aa, Artificial Sequence
  Crotedumab_LightChain
DIQMTQSPSSLSASVGDRVTITCRASQGIRNDLGWYQQKPGKAPKRLIYAASSLQSGVPSRFSGSGSGTEFILTVSSLQPEDFATYYCLQYNSNPFTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 983 - protein, 452 aa, Artificial Sequence
  Dezamizumab_HeavyChain
QVQLVQSGAEVKKPGSSVKVSCKASGFTFATYNMHWVRQAPGQGLEWMGYIYPGDGNANYNQQFKGRVTITADKSTSTAYMELSSLRSEDTAVYYCARGDFDYDGGYYFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 984 - protein, 214 aa, Artificial Sequence
  Dezamizumab_LightChain
DIQMTQSPSSLSASVGDRVTITCRASENIYSYLAWYQQKPGKAPKLLIHNAKTLAEGVPSRFSGSGSGTDFTLTISSLQPEDFATYYCQHHYGAPLTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 985 - protein, 502 aa, Artificial Sequence
  Duvortuxizumab_Chain1_scFv
ENVLTQSPATLSVTPGEKATITCRASQSVSYMHWYQQKPGQAPRLLIYDASNRASGVPSRFSGSGSGTDHTLTISSLEAEDAATYYCFQGSVYPFTFGQGTKLEIKGGGSGGGGEVQLVESGGGLVQPGGSLRLSCAASGFTFSTYAMNWVRQAPGKGLEWVGRIRSKYNNYATYYADSVKGRFTISRDDSKNSLYLQMNSLKTEDTAVYYCVRHGNFGNSYVSWFAYWGQGTLVTVSSASTKGEVAACEKEVAALEKEVAALEKEVAALEKGGGDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLWCLVKGFYPSDIAVEWESNGQPENNYKTTPPVLDSDGSFFLYSKLTVDKSRWQQGNVFSCSVMHEALHNHYTQKSLSLSPGK

SEQ ID NO: 986 - protein, 271 aa, Artificial Sequence
  Duvortuxizumab_Chain2_scFv
QAVVTQEPSLTVSPGGTVTLTCRSSTGAVTTSNYANWVQQKPGQAPRGLIGGTNKRAPWTPARFSGSLLGGKAALTITGAQAEDEADYYCALWYSNLWVFGGGTKLTVLGGGGSGGGGQVTLRESGPALVKPTQTLTLTCTFSGFSLSTSGMGVGWIRQPPGKALEWLAHIWWDDDKRYNPALKSRLTISKDTSKNQVFLTMTNMDPVDTATYYCARMELWSYYFDYWGQGTTVTVSSASTKGKVAACKEKVAALKEKVAALKEKVAALKE

SEQ ID NO: 987 - protein, 227 aa, Artificial Sequence
  Duvortuxizumab_Chain3_h-CH2-CH3
DKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLSCAVKGFYPSDIAVEWESNGQPENNYKTTPPVLDSDGSFFLVSKLTVDKSRWQQGNVFSCSVMHEALHNRYTQKSLSLSPGK

SEQ ID NO: 988 - protein, 120 aa, Artificial Sequence
  Efungumab_HeavyChain
MAEVQLVESGAEVKKPGESLRISCKGSGCIISSYWISWVRQMPGKGLEWMGKIDPGDSYINYSPSFQGHVTISADKSINTAYLQWNSLKASDTAMYYCARGGRDFGDSFDYWGQGTLVTV

SEQ ID NO: 989 - protein, 250 aa, Artificial Sequence
  Efungumab_HeavyChain_LightChain
MAEVQLVESGAEVKKPGESLRISCKGSGCIISSYWISWVRQMPGKGLEWMGKIDPGDSYINYSPSFQGHVTISADKSINTAYLQWNSLKASDTAMYYCARGGRDFGDSFDYWGQGTLVTVSSGGGGSGGGGSGGGGSDVVMTQSPSFLSAFVGDRITITCRASSGISRYLAWYQQAPGKAPKLLIYAASTLQTGVPSRFSGSGSGTEFTLTINSLQPEDFATYYCQHLNSYPLTFGGGTKVDIKRAAALE

SEQ ID NO: 990 - protein, 113 aa, Artificial Sequence
  Efungumab_LightChain
DVVMTQSPSFLSAFVGDRITITCRASSGISRYLAWYQQAPGKAPKLLIYAASTLQTGVPSRFSGSGSGTEFTLTINSLQPEDFATYYCQHLNSYPLTFGGGTKVDIKRAAALE

SEQ ID NO: 991 - protein, 450 aa, Artificial Sequence
  Elezanumab_HeavyChain
EVQLVQSGAEVKKPGASVKVSCKASGYTFTSHGISWVRQAPGQGLDWMGWISPYSGNTNYAQKLQGRVTMTTDTSTSTAYMELSSLRSEDTAVYYCARVGSGPYYYMDVWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDQLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVLHEALHNHYTQKSLSLSPGK

SEQ ID NO: 992 - protein, 215 aa, Artificial Sequence
  Elezanumab_LightChain
QSALTQPRSVSGSPGQSVTISCTGTSSSVGDSIYVSWYQQHPGKAPKLMLYDVTKRPSGVPDRFSGSKSGNTASLTISGLQAEDEADYYCYSYAGTDTLFGGGTKVTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 993 - protein, 453 aa, Artificial Sequence
  Emapalumab_HeavyChain
EVQLLESGGGLVQPGGSLRLSCAASGFTFSSYAMSWVRQAPGKGLEWVSAISGSGGSTYYADSVKGRFTISRDNSKNTLYLQMNSLRAEDTAVYYCAKDGSSGWYVPHWFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 994 - protein, 217 aa, Artificial Sequence
  Emapalumab_LightChain
NFMLTQPHSVSESPGKTVTISCTRSSGSIASNYVQWYQQRPGSSPTTVIYEDNQRPSGVPDRFSGSIDSSSNSASLTISGLKTEDEADYYCQSYDGSNRWMFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 995 - protein, 447 aa, Artificial Sequence
  Enoblituzumab_HeavyChain
QVELVESGGGLVQPGGSLRLSCAASGFTFTSYWMSWVRQAPGKGLELVSSITSYGSFTYYADSVKGRFTISRDNSKNTLYLQMNSLRAEDTAVYYCARNMYTHFDSWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 996 - protein, 216 aa, Artificial Sequence
  Enoblituzumab_LightChain
DIVLTQPPSVSGAPGQRVTISCSGSSSNIGSNSVSWYQQLPGTAPKLLIYDNSKRPSGVPDRFSGSKSGTSASLAITGLQSEDEADYYCQSRDTYGYYWVFGGGTKLTVLGQPKAAPSVTLFPPSSEELQANKATLVCLISDFYPGAVTVAWKGDSSPVKAGVETTTPSKQSNNKYAASSYLSLTPEQWKSHRSYSCQVTHEGSTVEKTVAPTECS

SEQ ID NO: 997 - protein, 441 aa, Artificial Sequence
  Eptinezumab_HeavyChain
EVQLVESGGGLVQPGGSLRLSCAVSGIDLSGYYMNWVRQAPGKGLEWVGVIGINGATYYASWAKGRFTISRDNSKTTVYLQMNSLRAEDTAVYFCARGDIWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDARVEPKSCDKTHTCPPCPAPELLGGPSVTLFPPKPKDTLMISRTPEVTCVVVDVSHEDPEVKFNWYVDGVEVHNAKTKPREEQYASTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 998 - protein, 219 aa, Artificial Sequence
  Eptinezumab_LightChain
QVLTQSPSSLSASVGDRVTINCQASQSVYHNTYLAWYQQKPGKVPKQLIYDASTLASGVPSRFSGSGSGTDFTLTISSLQPEDVATYYCLGSYDCTNGDCFVFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 999 - protein, 456 aa, Artificial Sequence
  Erenumab_HeavyChain
QVQLVESGGGVVQPGRSLRLSCAASGFTFSSFGMHWVRQAPGKGLEWVAVISFDGSIKYSVDSVKGRFTISRDNSKNTLFLQMNSLRAEDTAVYYCARDRLNYYDSSGYYHYKYYGMAVWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1000 - protein, 216 aa, Artificial Sequence
  Erenumab_LightChain
QSVLTQPPSVSAAPGQKVTISCSGSSSNIGNNYVSWYQQLPGTAPKLLIYDNNKRPSGIPDRFSGSKSGTSTTLGITGLQTGDEADYYCGTWDSRLSAVVFGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 1001 - protein, 448 aa, Artificial Sequence
  Fremanezumab_HeavyChain
EVQLVESGGGLVQPGGSLRLSCAASGFTFSNYWISWVRQAPGKGLEWVAEIRSESDASATHYAEAVKGRFTISRDNAKNSLYLQMNSLRAEDTAVYYCLAYFDYGLAIQNYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1002 - protein, 214 aa, Artificial Sequence
  Fremanezumab_LightChain
EIVLTQSPATLSLSPGERATLSCKASKRVTTYVSWYQQKPGQAPRLLIYGASNRYLGIPARFSGSGSGTDFTLTISSLEPEDFAVYYCSQSYNYPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1003 - protein, 457 aa, Artificial Sequence
  Frunevetmab_HeavyChain
QVQLVESGAELVQPGESLRLTCAASGFSLTNNNVNWVRQAPGKGLEWMGGVWAGGATDYNSALKSRLTITRDTSKNTVFLQMHSLQSEDTATYYCARDGGYSSSTLYAMDAWGQGTTVTVSAASTTAPSVFPLAPSCGTTSGATVALACLVLGYFPEPVTVSWNSGALTSGVHTFPAVLQASGLYSLSSMVTVPSSRWLSDTFTCNVAHPPSNTKVDKTVRKTDHPPGPKPCDCPKCPPPEMLGGPSIFIFPPKPKDTLSISRTPEVTCLVVDLGPDDSDVQITWFVDNTQVYTAKTSPREEQFNSTYRVVSVLPILHQDWLKGKEFKCKVNSKSLPSPIERTISKAKGQPHEPQVYVLPPAQEELSRNKVSVTCLIKSFHPPDIAVEWEITGQPEPENNYRTTPPQLDSDGTYFVYSKLSVDRSHWQRGNTYTCSVSHEALHSHHTQKSLTQSPGK

SEQ ID NO: 1004 - protein, 217 aa, Artificial Sequence
  Frunevetmab_LightChain
DIEMTQSPLSLSVTPGESVSISCRASEDIYNALAWYLQKPGRSPRLLIYNTDTLHTGVPDRFSGSGSGTDFTLKISRVQTEDVGVYFCQHYFHYPRTFGQGTKLELKRSDAQPSVFLFQPSLDELHTGSASIVCILNDFYPKEVNVKWKVDGVVQNKGIQESTTEQNSKDSTYSLSSTLTMSSTEYQSHEKFSCEVTHKSLASTLVKSFNRSECQRE

SEQ ID NO: 1005 - protein, 447 aa, Artificial Sequence
  Gatipotuzumab_HeavyChain
EVQLVESGGGLVQPGGSMRLSCVASGFPFSNYWMNWVRQAPGKGLEWVGEIRLKSNNYTTHYAESVKGRFTISRDDSKNSLYLQMNSLKTEDTAVYYCTRHYYFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 1006 - protein, 219 aa, Artificial Sequence
  Gatipotuzumab_LightChain
DIVMTQSPLSNPVTPGEPASISCRSSKSLLHSNGITYFFWYLQKPGQSPQLLIYQMSNLASGVPDRFSGSGSGTDFTLRISRVEAEDVGVYYCAQNLELPPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1007 - protein, 455 aa, Artificial Sequence
  Gedivumab_HeavyChain
EVQLVESGGGVVQPGKSLRLSCAASGLTFSSYAVHWVRQAPGKGLEWVTLISYDGANQYYADSVKGRFTISRDNSKNTVYLQMNSLRPEDTAVYYCAVPGPVFGIFPPWSYFDNWGQGILVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1008 - protein, 216 aa, Artificial Sequence
  Gedivumab_LightChain
EIVLTQSPATLSVSPGERATLSCRASQVISHNLAWYQQKPGQAPRLLIYGASTRASGIPARFSGSGSGTDYTLTITSLQSEDFAVYYCQHYSNWPPRLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1009 - protein, 443 aa, Artificial Sequence
  Gemetuzumab_HeavyChain
EVQLVQSGAEVKKPGSSVKVSCKASGYTITDSNIHWVRQAPGQSLEWIGYIYPYNGGTDYNQKFKNRATLTVDNPTNTAYMELSSLRSEDTAFYYCVNGNPWLAYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1010 - protein, 218 aa, Artificial Sequence
  Gemetuzumab_LightChain
DIQLTQSPSTLSASVGDRVTITCRASESLDNYGIRFLTWFQQKPGKAPKLLMYAASNQGSGVPSRFSGSGSGTEFTLTISSLQPDDFATYYCQQTKEVPWSFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1011 - protein, 455 aa, Artificial Sequence
  Gilvetmab_HeavyChain
EVQLVQSGGDLVKPGGSVRLSCVASGFNIKNTYMHWVRQAPGKGLQWIGRIAPANVDTKYAPKFQGKATISADTAKNTAYMQLNSLRAEDTAVYYCVLIYYDYDGDIDVWGQGTLVTVSSASTTAPSVFPLAPSCGSTSGSTVALACLVSGYFPEPVTVSWNSGSLTSGVHTFPSVLQSSGLYSLSSMVTVPSSRWPSETFTCNVAHPASKTKVDKPVPKRENGRVPRPPDCPKCPAPEMLGGPSVFIFPPKPKDTLLIARTPEVTCVVVALDPEDPEVQISWFVDGKQMQTAKTQPREEQFAGTYRVVSVLPIGHQDWLKGKQFTCKVNNKALPSPIERTISKARGQAHQPSVYVLPPSREELSKNTVSLTCLIKDFFPPDIDVEWQSNGQQEPESKYRTTPPQLDEDGSYFLYSKLSVDKSRWQRGDTFICAVMHEALHNHYTQESLSHSPGK

SEQ ID NO: 1012 - protein, 218 aa, Artificial Sequence
  Gilvetmab_LightChain
DIVMTQTPLSLSVSLGEPASISCHASQNINVWLSWYRQKPGQIPQLLIYKASHLHTGVPDRFSGSGSGTDFTLRISRVEADDAGVYYCQQGQSWPLTFGQGTKVEIKRNDAQPAVYLFQPSPDQLHTGSASVVCLLNSFYPKDINVKWKVDGVIQDTGIQESVTEQDSKDSTYSLSSTLTMSSTEYLSHELYSCEITHKSLPSTLIKSFQRSECQRVD

SEQ ID NO: 1013 - protein, 448 aa, Artificial Sequence; identical to SEQ ID NO: 296
  Ifabotuzumab_HeavyChain

SEQ ID NO: 1014 - protein, 214 aa, Artificial Sequence; identical to SEQ ID NO: 297
  Ifabotuzumab_LightChain

SEQ ID NO: 1015 - protein, 441 aa, Artificial Sequence
  Iratumumab_HeavyChain
QVQLQQWGAGLLKPSETLSLTCAVYGGSFSAYYWSWIRQPPGKGLEWIGDINHGGGTNYNPSLKSRVTISVDTSKNQFSLKLNSVTAADTAVYYCASLTAYWGQGSLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHTQKSLSLSPGK

SEQ ID NO: 1016 - protein, 214 aa, Artificial Sequence
  Iratumumab_LightChain
DIQMTQSPTSLSASVGDRVTITCRASQGISSWLTWYQQKPEKAPKSLIYAASSLQSGVPSRFSGSGSGTDFTLTISSLQPEDFATYYCQQYDSYPITFGQGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1017 - protein, 448 aa, Artificial Sequence
  Lacnotuzumab_HeavyChain
QVQLQESGPGLVKPSQTLSLTCTVSDYSITSDYAWNWIRQFPGKGLEWMGYISYSGSTSYNPSLKSRITISRDTSKNQFSLQLNSVTAADTAVYYCASFDYAHAMDYWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1018 - protein, 214 aa, Artificial Sequence
  Lacnotuzumab_LightChain
DIVLTQSPAFLSVTPGEKVTFTCQASQSIGTSIHWYQQKTDQAPKLLIKYASESISGIPSRFSGSGSGTDFTLTISSVEAEDAADYYCQQINSWPTTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1019 - protein, 449 aa, Artificial Sequence
  Larcaviximab_HeavyChain
EVQLQESGPELEMPGASVKISCKASGSSFTGFSMNWVKQSNGKSLEWIGNIDTYYGGTTYNQKFKGKATLTVDKSSSTAYMQLKSLTSEDSAVYYCARSAYYGSTFAYWGQGTLVTVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1020 - protein, 214 aa, Artificial Sequence
  Larcaviximab_LightChain
DIQMTQSPASLSASVGETVTITCRASENIYSYLAWYQQKQGKSPQLLVYNAKTLIEGVPSRFSGSGSGTQFSLKINSLQPEDFGSYFCQHHFGTPFTFGSGTELEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1021 - protein, 446 aa, Artificial Sequence
  Lendalizumab_HeavyChain
QVQLVQSGAEVKKPGASVKVSCKASGYTFTDYSMDWVRQAPGQGLEWMGAIHLNTGYTNYNQKFKGRVTMTRDTSTSTVYMELSSLRSEDTAVYYCARGFYDGYSPMDYWGQGTTVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1022 - protein, 218 aa, Artificial Sequence
  Lendalizumab_LightChain
DIQMTQSPSSLSASVGDRVTITCRASESVDSYGNSFMHWYQQKPGKAPKLLIYRASNLESGVPSRFSGSGSGTDFTLTISSLQPEDFATYYCQQSNEDPYTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1023 - protein, 453 aa, Artificial Sequence
  Lesofavumab_HeavyChain
EVQLVQSGAEVKKPGESLKISCKVSGYSFTSQWIGWVRQMPGKGLEWIGMMYPGESETIYSPSFQGQVTISADNSISTAYLQWSSLKASDTAIYYCASGPGYSGYHYGWFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1024 - protein, 219 aa, Artificial Sequence
  Lesofavumab_LightChain
DIVMTQSPLSLPVTPGEPASISCRSSQSLLRSNGYNYLDWYLQKPGQSPQLLIYLGSNRASGVPDRFSGSGSGTDFTLKISRVEAEDVGVYYCMQALQTPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1025 - protein, 353 aa, Artificial Sequence
  Letolizumab_HeavyChain
EVQLLESGGGLVQPGGSLRLSCAASGFTFNWELMGWARQAPGKGLEWVSGIEGPGDVTYYADSVKGRFTISRDNSKNTLYLQMNSLRAEDTAVYYCVKVGKDAKSDYRGQGTLVTVSSASTEPKSSDKTHTSPPSPAPELLGGSSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1026 - protein, 446 aa, Artificial Sequence
  Losatuxizumab_HeavyChain
EVQLQESGPGLVKPSQTLSLTCTVSGYSISRDFAWNWIRQPPGKGLEWMGYISYNGNTRYQPSLKSRITISRDTSKNQFFLKLNSVTAADTATYYCVTASRGFPYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1027 - protein, 214 aa, Artificial Sequence; identical to SEQ ID NO: 205
  Losatuxizumab_LightChain

SEQ ID NO: 1028 - protein, 446 aa, Artificial Sequence
  Lupartumab_HeavyChain
EVQLLESGGGLVQPGGSLRLSCAASGFTFSNAWMSWVRQAPGKGLEWVSYISSSGSTIYYADSVKGRFTISRDNSKNTLYLQMNSLRAEDTAVYYCAREGLWAFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1029 - protein, 217 aa, Artificial Sequence
  Lupartumab_LightChain
ESVLTQPPSVSGAPGQRVTISCTGSSSNIGAGYVVHWYQQLPGTAPKLLIYDNNKRPSGVPDRFSGSKSGTSASLAISGLRSEDEADYYCAAWDDRLNGPVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1030 - protein, 577 aa, Artificial Sequence
  Lutikizumab_HeavyChain
EVQLVESGGGVVQPGRSLRLSCSASGFIFSRYDMSWVRQAPGKGLEWVAYISHGGAGTYYPDSVKGRFTISRDNSKNTLFLQMDSLRPEDTGVYFCARGGVTKGYFDVWGQGTPVTVSSASTKGPQVQLVESGGGVVQPGRSLRLSCTASGFTFSMFGVHWVRQAPGKGLEWVAAVSYDGSNKYYAESVKGRFTISRDNSKNILFLQMDSLRLEDTAVYYCARGRPKVVIPAPLAHWGQGTLVTFSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPEAAGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1031 - protein, 327 aa, Artificial Sequence
  Lutikizumab_LightChain
DIQMTQSPSSLSASVGDRVTITCRASGNIHNYLTWYQQTPGKAPKLLIYNAKTLADGVPSRFSGSGSGTDYTFTISSLQPEDIATYYCQHFWSIPYTFGQGTKLQITRTVAAPDIQMTQSPSSVSASVGDRVTITCRASQGISSWLAWYQQKPGKAPKLLIYEASNLETGVPSRFSGSGSGSDFTLTISSLQPEDFATYYCQQTSSFLLSFGGGTKVEHKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1032 - protein, 447 aa, Artificial Sequence
  Oleclumab_HeavyChain
EVQLLESGGGLVQPGGSLRLSCAASGFTFSSYAYSWVRQAPGKGLEWVSAISGSGGRTYYADSVKGRFTISRDNSKNTLYLQMNSLRAEDTAVYYCARLGYGRVDEWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPEFEGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPASIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1033 - protein, 216 aa, Artificial Sequence
  Oleclumab_LightChain
QSVLTQPPSASGTPGQRVTISCSGSLSNIGRNPVNWYQQLPGTAPKLLIYLDNLRLSGVPDRFSGSKSGTSASLAISGLQSEDEADYYCATWDDSHPGWTFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1034 - protein, 483 aa, Artificial Sequence; identical to SEQ ID NO: 649
  Otlertuzumab_HeavyChain

SEQ ID NO: 1035 - protein, 113 aa, Artificial Sequence
  Ozoralizumab_HeavyChain
EVQLVESGGGLVQPGGSLRLSCAASGFTFSDYWMYWVRQAPGKGLEWVSEINTNGLITKYPDSVKGRFTISRDNAKNTLYLQMNSLRPEDTAVYYCARSPSGFNRGQGTLVTV

SEQ ID NO: 1036 - protein, 363 aa, Artificial Sequence; identical to SEQ ID NO: 654
  Ozoralizumab_HeavyChain_HeavyChain_HeavyChain

SEQ ID NO: 1037 - protein, 498 aa, Artificial Sequence
  Pasotuxizumab_HeavyChain_LightChain_HeavyChain_LightChain
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTVSSGGGGSGGGGSGGGGSDIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIKSGGGGSEVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTVSSGGGGSGGGGSGGGGSQTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1038 - protein, 119 aa, Artificial Sequence
  Pasotuxizumab_HeavyChain1
QVQLVESGGGLVKPGESLRLSCAASGFTFSDYYMYWVRQAPGKGLEWVAIISDGGYYTYYSDIIKGRFTISRDNAKNSLYLQMNSLKAEDTAVYYCARGFPLLRHGAMDYWGQGTLVTV

SEQ ID NO: 1039 - protein, 123 aa, Artificial Sequence
  Pasotuxizumab_HeavyChain2
EVQLVESGGGLVQPGGSLKLSCAASGFTFNKYAMNWVRQAPGKGLEWVARIRSKYNNYATYYADSVKDRFTISRDDSKNTAYLQMNNLKTEDTAVYYCVRHGNFGNSYISYWAYWGQGTLVTV

SEQ ID NO: 1040 - protein, 107 aa, Artificial Sequence
  Pasotuxizumab_LightChain1
DIQMTQSPSSLSASVGDRVTITCKASQNVDTNVAWYQQKPGQAPKSLIYSASYRYSDVPSRFSGSASGTDFTLTISSVQSEDFATYYCQQYDSYPYTFGGGTKLEIK

SEQ ID NO: 1041 - protein, 109 aa, Artificial Sequence
  Pasotuxizumab_LightChain2
QTVVTQEPSLTVSPGGTVTLTCGSSTGAVTSGNYPNWVQQKPGQAPRGLIGGTKFLAPGTPARFSGSLLGGKAALTLSGVQPEDEAEYYCVLWYSNRWVFGGGTKLTVL

SEQ ID NO: 1042 - protein, 341 aa, Artificial Sequence; identical to SEQ ID NO: 698
  Placulumab_HeavyChain

SEQ ID NO: 1043 - protein, 451 aa, Artificial Sequence
  Porgaviximab_HeavyChain
EVQLQESGGGLMQPGGSMKLSCVASGFTFSNYWMNWVRQSPEKGLEWVAEIRLKSNNYATHYAESVKGRFTISRDDSKRSVYLQMNTLRAEDTGIYYCTRGNGNYRAMDYWGQGTSVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1044 - protein, 214 aa, Artificial Sequence
  Porgaviximab_LightChain
DIQMTQSPASLSVSVGETVSITCRASENIYSSLAWYQQKQGKSPQLLVYSATILADGVPSRFSGSGSGTQYSLKINSLQSEDFGTYYCQHFWGTPYTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1045 - protein, 447 aa, Artificial Sequence
  Prezalumab_HeavyChain
EVQLVESGGGLVQPGGSLRLSCAASGFTFSSYWMSWVRQAPGKGLEWVAYIKQDGNEKYYVDSVKGRFTISRDNAKNSLYLQMNSLRAEDTAVYYCAREGILWFGDLPTFWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1046 - protein, 214 aa, Artificial Sequence [sequence omitted]

SEQ ID NO: 1047 - protein, 114 aa, Artificial Sequence
  Radretumab_HeavyChain
EVQLLESGGGLVQPGGSLRLSCAASGFTFSSFSMSWVRQAPGKGLEWVSSISGSSGTTYYADSVKGRFTISRDNSKNTLYLQMNSLRAEDTAVYYCAKPFPYFDYWGQGTLVTV

SEQ ID NO: 1048 - protein, 357 aa, Artificial Sequence; identical to SEQ ID NO: 717
  Radretumab_HeavyChain_LightChain

SEQ ID NO: 1049 - protein, 231 aa, Artificial Sequence
  Radretumab_LightChain
ASEIVLTQSPGTLSLSPGERATLSCRASQSVSSSFLAWYQQKPGQAPRLLIYYASSRATGIPDRFSGSGSGTDFTLTISRLEPEDFAVYYCQQTGRIPPTFGQGTKVEIKSGGSGGPRAAPEVYAFATPEWPGSRDKRTLACLIQNFMPEDISVQWLHNEVQLPDARHSTTQPRKTKGSGFFVFSRLEVTRAEWEQKDEFICRAVHEAASPSQTVQRAVSVNPESSRRGGC

SEQ ID NO: 1050 - protein, 453 aa, Artificial Sequence
  Ranevetmab_HeavyChain1
EVQLVESGGGLVQPGGSLRLSCVASGFSLTNNNVNWVRQAPGKGLEWVGGVWAGGATDYNSALKSRFTISRDNAKNTVFLQMHSLRSEDTAVYYCARDGGYSSSTLYAMDAWGQGTSVTVSSASTTAPSVFPLAPSCGSTSGSTVALACLVSGYFPEPVTVSWNSGSLTSGVHTFPSVLQSSGLHSLSSMVTVPSSRWPSETFTCNVVHPASNTKVDKPVFNECRCTDTPPCPVPEPLGGPSVLIFPPKPKDILRITRTPEVTCVVLDLGREDPEVQISWFVDGKEVITAKTQSREQQFNGTYQVVSVLPIEHQDWLTGKEFKCRVNHIDLPSPIERTISKARGRAHKPSVYVLPPSPKELSSSDTVSITCLIKDFYPPDIDVEWQSVGQQEPERKHRMTPPQLDEDGSYFLYSKLSVDKSRWQQGDPFTCAVMHETLQNHYTDLSLSHSPGK

SEQ ID NO: 1051 - protein, 453 aa, Artificial Sequence
  Ranevetmab_HeavyChain2
EVQLVESGGGLVQPGGSLRLSCVASGFSLTNNNVNWVRQAPGKGLEWVGGVWAGGATDYNSALKSRFTISRDNAKNTVFLQMHSLRSEDTAVYYCARDGGYSSSTLYAMDAWGQGTSVTVSSASTTAPSVFPLAPSCGSTSGSTVALACLVSGYFPEPVTVSWNSGSLTSGVHTFPSVLQSSGLHSLSSMVTVPSSRWPSETFTCNVVHPASNTKVDKPVFNECRCTDTPPCPVPEPLGGPSVLIFPPKPKDILRITRTPEVTCVVLDLGREDPEVQISWFVDGKEVLTAKTQSREQQFNGTYQVVSVLPIEHQDWLTGKEFKCRVNHIDLPSPIERTISKARGRAHKPSVYVLPPSPKELSSSDTVSITCLIKDFYPPDIDVEWQSVGQQEPERKHRMTPPQLDEDGSYFLYSKLSVDKSRWQQGDPFTCAVMHETLQNHYTDLSLSHSPGK

SEQ ID NO: 1052 - protein, 217 aa, Artificial Sequence
  Ranevetmab_LightChain
DIVMTQSPASLSLSQGETVTITCRASEDIYNALAWYQQKPGQAPKLLIYNTDTLHTGVPSRFSGSGSGTDFSLTISSLEPEDVAVYYCQHYFHYPRTFGQGTKVELKRNDAQPAVYLFQPSPDQLHTGSASVVCLLNSFYPKDINVKWKVDGVIQDTGIQESVTEQDKDSTYSLSSTLTMSSTEYLSHELYSCEITHKSLPSTLIKSFQRSECQRVD

SEQ ID NO: 1053 - protein, 587 aa, Artificial Sequence
  Remtolumab_HeavyChain
EVQLVESGGGLVQPGRSLRLSCAASGFTFDDYAMHWVRQAPGKGLEWVSAITWNSGHIDYADSVEGRFTISRDNAKNSLYLQMNSLRAEDTAVYYCAKVSYLSTASSLDYWGQGTLVTVSSGGGGSGGGGSEVQLVQSGAEVKKPGSSVKVSCKASGGSFGGYGIGWVRQAPGQGLEWMGGITPFFGFADYAQKFQGRVTITADESTTTAYMELSGLTSDDTAVYYCARDPNEFWNGYYSTHDFDSWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1054 - protein, 331 aa, Artificial Sequence
  Remtolumab_LightChain
DIQMTQSPSSLSASVGDRVTITCRASQGIRNYLAWYQQKPGKAPKLLIYAASTLQSGVPSRFSGSGSGTDFTLTISSLQPEDVATYYCQRYNRAPYTFGQGTKVEIKRGGSGGGGSGEIVLTQSPDFQSVTPKEKVTITCRASQDIGSELHWYQQKPDQPPKLLIKYASHSTSGVPSRFSGSGSGTDFTLTINGLEAEDAGTYYCHQTDSLPYTFGPGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1055 - protein, 447 aa, Artificial Sequence
  Rosmantuzumab_HeavyChain
QVQLVQSGAEVKKPGASVKVSCKASGYTFTDYSIHWVRQAPGQGLEWIGYIYPSNGDSGYNQKFKNRVTMTRDTSTSTAYMELSRLRSEDTAVYYCATYFANNFDYWGQGTTLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1056 - protein, 218 aa, Artificial Sequence
  Rosmantuzumab_LightChain
DIQMTQSPSSLSASVGDRVTITCKASQSVDYDGDSYMNWYQQKPGKAPKLLIYAASNLESGVPSRFSGSGSGTDFTLTISPVQAEDFATYYCQQSNEDPLTFGAGTKLELKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1057 - protein, 444 aa, Artificial Sequence
  Rozanolixizumab_HeavyChain
EVPLVESGGGLVQPGGSLRLSCAVSGFTFSNYGMVWVRQAPGKGLEWVAYIDSDGDNTYYRDSVKGRFTISRDNAKSSLYLQMNSLRAEDTAVYYCTTGIVRPFLYWGQGTLVTVSSASTKGPSVFPLAPCSRSTSESTAALGCLVKDYFPEPVTVSWNSGALTSGVHTFPAVLQSSGLYSLSSVVTVPSSSLGTKTYTCNVDHKPSNTKVDKRVESKYGPPCPPCPAPEFLGGPSVFLFPPKPKDTLMISRTPEVTCVVVDVSQEDPEVQFNWYVDGVEVHNAKTKPREEQFNSTYRVVSVLTVLHQDWLNGKEYKCKVSNKGLPSSIEKTISKAKGQPREPQVYTLPPSQEEMTKNQVSLTCLVKGFYPSDIAVEWESNGQPENNYKTTPPVLDSDGSFFLYSRLTVDKSRWQEGNVFSCSVMHEALHNHYTQKSLSLSLGK

SEQ ID NO: 1058 - protein, 219 aa, Artificial Sequence
  Rozanolixizumab_LightChain
DIQMTQSPSSLSASVGDRVTITCKSSQSLVGASGKTYLYWLFQKPGKAPKRLIYLVSTLDSGIPSRFSGSGSGTEFTLTISSLQPEDFATYYCLQGTHFPHTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1059 - protein, 443 aa, Artificial Sequence
  Sapelizumab_HeavyChain
QVQLQESGPGLVKPSETLSLTCAVSGHSISHDHAWSWVRQPPGEGLEWIGFISYSGITNYNPSLQGRVTISRDNSKNTLYLQMNSLRAEDTAVYYCARSLARTTAMDYWGEGTLVTVSSASTKGPSVFPLAPSSKSTSGGTAALGCLVKDYFPEPVTVSWNSGALTSGVHTFPAVLQSSGLYSLSSVVTVPSSNFGTQTYTCNVDHKPSNTKVDKTVERKSCVECPPCPAPPVAGPSVFLFPPKPKDTLMISRTPEVTCVVVDVSQEDPEVQFNWYVDGVEVHNAKTKPREEQFNSTFRVVSVLTVVHQDWLNGKEYKCKVSNKGLPAPIEKTISKTKGQPREPQVYTLPPSQEEMTKNQVSLTCLVKGFYPSDIAVEWESNGQPENNYKTTPPMLDSDGSFFLYSKLTVDKSRWQEGNVFSCSVMHEALHAHYTQKSLSLSP

SEQ ID NO: 1060 - protein, 214 aa, Artificial Sequence
  Sapelizumab_LightChain
DIQMTQSPSSLSASVGDSVTITCQASTDISSHLNWYQQKPGKAPELLIYYGSHLLSGVPSRFSGSGSGTDFTFTISSLEAEDAATYYCGQGNRLPYTFGQGTKVEIERTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1061 - protein, 452 aa, Artificial Sequence
  Selicrelumab_HeavyChain
QVQLVQSGAEVKKPGASVKVSCKASGYTFTGYYMHWVRQAPGQGLEWMGWINPDSGGTNYAQKFQGRVTMTRDTSISTAYMELNRLRSDDTAVYYCARDQPLGYCTNGVCSYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPAPIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1062 - protein, 214 aa, Artificial Sequence
  Selicrelumab_LightChain
DIQMTQSPSSVSASVGDRVTITCRASQGIYSWLAWYQQKPGKAPNLLIYTASTLQSGVPSRFSGSGSGTDFTLTISSLQPEDFATYYCQQANIFPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1063 - protein, 118 aa, Artificial Sequence
  Solitomab_HeavyChain1
EVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTV

SEQ ID NO: 1064 - protein, 125 aa, Artificial Sequence
  Solitomab_HeavyChain2
DVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTST

SEQ ID NO: 1065 - protein, 496 aa, Artificial Sequence
  Solitomab_LightChain_HeavyChain_HeavyChain_LightChain
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIKGGGGSGGGGSGGGGSEVQLLEQSGAELVRPGTSVKISCKASGYAFTNYWLGWVKQRPGHGLEWIGDIFPGSGNIHYNEKFKGKATLTADKSSSTAYMQLSSLTFEDSAVYFCARLRNWDEPMDYWGQGTTVTVSSGGGGSDVQLVQSGAEVKKPGASVKVSCKASGYTFTRYTMHWVRQAPGQGLEWIGYINPSRGYTNYADSVKGRFTITTDKSTSTAYMELSSLRSEDTATYYCARYYDDHYCLDYWGQGTTVTVSSGEGTSTGSGGSGGSGGADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 1066 - protein, 113 aa, Artificial Sequence
  Solitomab_LightChain1
ELVMTQSPSSLTVTAGEKVTMSCKSSQSLLNSGNQKNYLTWYQQKPGQPPKLLIYWASTRESGVPDRFTGSGSGTDFTLTISSVQAEDLAVYYCQNDYSYPLTFGAGTKLEIK

SEQ ID NO: 1067 - protein, 108 aa, Artificial Sequence
  Solitomab_LightChain2
ADDIVLTQSPATLSLSPGERATLSCRASQSVSYMNWYQQKPGKAPKRWIYDTSKVASGVPARFSGSGSGTDYSLTINSLEAEDAATYYCQQWSSNPLTFGGGTKVEIK

SEQ ID NO: 1068 - protein, 453 aa, Artificial Sequence
  Suptavumab_HeavyChain2
EVQLVESGGDLVQPGRSLRLSCVASGFTFDDYAMHWVRQAPGKGLEWVSGVSWSGSTVGYADSVKGRFTVSRDNAQKSLYLQMNSLRAEDTALYYCVKDAYKFNYYYYGLDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1069 - protein, 452 aa, Artificial Sequence
  Suvratoxumab_HeavyChain
EVQLVESGGGLVQPGGSLRLSCAASGFTFSSHDMHWVRQATGKGLEWVSGIGTAGDTYYPDSVKGRFTISRENAKNSLYLQMNSLRAGDTAVYYCARDRYSPTGHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLYITREPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1070 - protein, 213 aa, Artificial Sequence
  Suvratoxumab_LightChain
DIQMTQSPSTLSASVGDRVTITCRASQSISSWLAWYQQKPGKAPKLLIYKASSLESGVPSRFSGSGSGTEFTLTISSLQPDDFATYYCKQYADYWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1071 - protein, 214 aa, Artificial Sequence
  Tadocizumab_LightChain
DIQMTQTPSTLSASVGDRVTISCRASQDINNYLNWYQQKPGKAPKLLIYYTSTLHSGVPSRFSGSGSGTDYTLTISSLQPDDFATYFCQQGNTLPWTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1072 - protein, 447 aa, Artificial Sequence
  Tanezumab_HeavyChain
QVQLQESGPGLVKPSETLSLTCTVSGFSLIGYDLNWIRQPPGKGLEWIGIIWGDGTTDYNSAVKSRVTISKDTSKNQFSLKLSSVTAADTAVYYCARGGYWYATSYYFDYWGQGTLVTVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVERKCCVECPPCPAPPVAGPSVFLFPPKPKDTLMISRTPEVTCVVVDVSHEDPEVQFNWYVDGVEVHNAKTKPREEQFNSTFRVVSVLTVVHQDWLNGKEYKCKVSNKGLPSSIEKTISKTKGQPREPQVYTLPPSREEMTKNQVSLTCLVKGFYPSDIAVEWESNGQPENNYKTTPPMLDSDGSFFLYSKLTVDKSRWQQGNVFSCSVMHEALHNHYTQKSLSLSPGK

SEQ ID NO: 1073 - protein, 214 aa, Artificial Sequence
  Tanezumab_LightChain
DIQMTQSPSSLSASVGDRVTITCRASQSISNNLNWYQQKPGKAPKLLIYYTSRFHSGVPSRFSGSGSGTDFTFTISSLQPEDIATYYCQQEHTLPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1074 - protein, 451 aa, Artificial Sequence
  Tavolixizumab_HeavyChain
QVQLQESGPGLVKPSQTLSLTCAVYGGSFSSGYWNWIRKHPGKGLEYIGYISYNGITYHNPSLKSRITINRDTSKNQYSLQLNSVTPEDTAVYYCARYKYDYDGGHAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHTCPPCPAPELLGGPSVFLFPPKPKDTLMISRTPEVTCVVVDVSHEDPEVKFNWYVDGVEVHNAKTKPQEEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1075 - protein, 214 aa, Artificial Sequence
  Tavolixizumab_LightChain
DIQMTQSPSSLSASVGDRVTITCRASQDISNYLNWYQQKPGKAPKLLIYYTSKLHSGVPSRFSGSGSGTDYTLTISSLQPEDFATYYCQQGSALPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1076 - protein, 445 aa, Artificial Sequence
  Telisotuzumab_HeavyChain
QVQLVQSGAEVKKPGASVKVSCKASGYIFTAYTMHWVRQAPGQGLEWMGWIKPNNGLANYAQKFQGRVTMTRDTSISTAYMELSRLRSDDTAVYYCARSEITTEFDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDCHCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPG

SEQ ID NO: 1077 - protein, 218 aa, Artificial Sequence
  Telisotuzumab_LightChain
DIVMTQSPDSLAVSLGERATINCKSSESVDSYANSFLHWYQQKPGQPPKLLIYRASTRESGVPDRFSGSGSGTDFTLTISSLQAEDVAVYYCQQSKEDPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1078 - protein, 445 aa, Artificial Sequence; identical to SEQ ID NO: 1076
  Telisotuzumab_vedotin_HeavyChain

SEQ ID NO: 1079 - protein, 218 aa, Artificial Sequence; identical to SEQ ID NO: 1077
  Telisotuzumab_vedotin_LightChain

SEQ ID NO: 1080 - protein, 450 aa, Artificial Sequence
  Timigutuzumab_HeavyChain
EVQLVESGGGLVQPGGSLRLSCAASGFNIKDTYIHWVRQAPGKGLEWVARIYPTNGYTRYADSVKGRFTISADTSKNTAYLQMNSLRAEDTAVYYCSRWGGDGFYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 1081 - protein, 214 aa, Artificial Sequence; identical to SEQ ID NO: 742
  Timigutuzumab_LightChain

SEQ ID NO: 1082 - protein, 444 aa, Artificial Sequence; identical to SEQ ID NO: 126
  Timolumab_HeavyChain

SEQ ID NO: 1083 - protein, 214 aa, Artificial Sequence; identical to SEQ ID NO: 127
  Timolumab_LightChain

SEQ ID NO: 1084 - protein, 449 aa, Artificial Sequence
  Tomuzotuximab_HeavyChain
QVQLKQSGPGLVQPSQSLSITCTVSGFSLTNYGVHWVRQSPGKGLEWLGVIWSGGNTDYNTPFTSRLSINKDNSKSQVFFKMNSLQSNDTAIYYCARALTYYDYEFAYWGQGTLVTVSTASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEGLHNHYTQKSLSLSPGK

SEQ ID NO: 1085 - protein, 214 aa, Artificial Sequence; identical to SEQ ID NO: 157
  Tomuzotuximab_LightChain

SEQ ID NO: 1086 - protein, 449 aa, Artificial Sequence; identical to SEQ ID NO: 885
  Trastuzumab_duocarmazine_HeavyChain

SEQ ID NO: 1087 - protein, 214 aa, Artificial Sequence; identical to SEQ ID NO: 742
  Trastuzumab_duocarmazine_LightChain

SEQ ID NO: 1088 - protein, 456 aa, Artificial Sequence
  Varisacumab_HeavyChain
QVQLVQSGAEVKKPGASVKVSCKASGGTFSSYAISWVRQAPGQGLEWMGGFDPEDGETIYAQKFQGRVTMTEDTSTDTAYMELSSLRSEDTAVYYCATGRSMVRGVIIPFNGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSRDELTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1089 - protein, 214 aa, Artificial Sequence
  Varisacumab_LightChain
DIRMTQSPSSLSASVGDRVTITCRASQSISSYLNWYQQKPGKAPKLLIYAASSLQSGVPSRFSGSGSGTDFTLTISSLQPEDFATYYCQQSYSTPLTFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1090 - protein, 453 aa, Artificial Sequence
  Vunakizumab_HeavyChain
EVQLVQSGAEVKKPGASVKVSCKASGYTFTDYEVHWVRQAPGQGLEWMGVIDPGTGGVAYNQKFEGRVTMTADTSTSTAYMELRSLRSDDTAVYYCTRYSLFYGSSPYAMDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKTHTCPPCPAPELLGGPSVFLFPPKPKDTLMISRTPEVTCVVVDVSHEDPEVKFNWYVDGVEVHNAKTKPREEQYNSTYRVVSVLTVLHQDWLNGKEYKCKVSNKALPAPIEKTISKAKGQPREPQVYTLPPSREEMTKNQVSLTCLVKGFYPSDIAVEWESNGQPENNYKTTPPVLDSDGSFFLYSKLTVDKSRWQQGNVFSCSVMHEALHNHYTQKSLSLSPGK

SEQ ID NO: 1091 - protein, 213 aa, Artificial Sequence
  Vunakizumab_LightChain
EIVLTQSPDFQSVTPKEKVTITCSASSSVNYMHWFQQKPDQSPKLWIYRTSNLASGVPSRFSGSGSGTDYTLTINSLEAEDAATYYCQQRSSYPWTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1092 - protein, 447 aa, Artificial Sequence; identical to SEQ ID NO: 995
  Xentuzumab_HeavyChain

SEQ ID NO: 1093 - protein, 216 aa, Artificial Sequence; identical to SEQ ID NO: 996
  Xentuzumab_LightChain

SEQ ID NO: 1094 - protein, 242 aa, Artificial Sequence [sequence omitted]

SEQ ID NO: 1095 - protein, 476 aa, Artificial Sequence [sequence omitted]

SEQ ID NO: 1096 - protein, 232 aa, Artificial Sequence [sequence omitted]

SEQ ID NO: 1097 - protein, 518 aa, Artificial Sequence [sequence omitted]

SEQ ID NO: 1098 - protein, 234 aa, Artificial Sequence [sequence omitted]

SEQ ID NO: 1099 - protein, 474 aa, Artificial Sequence [sequence omitted]

SEQ ID NO: 1100 - protein, 107 aa, Artificial Sequence
  anti-rabies_LightChain
VMTQSPATLSLSPGERATLSCRASQSVRNYLAWYQQKPGQAPRLLIYGASNRATGIPARFSGSGSGTDFTLTISSLEPEDFAVYYCQQRSDWPLSFGQGTKLEIKRT

SEQ ID NO: 1101 - protein, 111 aa, Artificial Sequence
  anti-rabies_HeavyChain
GPAWEVPETLPVQPLDSPSVAMACTGVRQAPGKGLEWVAVISYDGSNKYYADSVKGRFTISRDNSKNTLYLQMNSLRAEDTAVYYCAKDSNSGSYYAHDLGYWGQGTLVTV

SEQ ID NO: 1102 - protein, 114 aa, Artificial Sequence
  anti-rabies_LightChain
ELVMTQSPLSLPVTLGQPASISCRSSQSLIHSNGNTYLNWFQQRPGQSPRRLIYKVSDRDSGVPDRFSGSGSGTDFTLKISRVEAEDVGVYYCLQGTHWPRTFGQGTKLEIKRT

SEQ ID NO: 1103 - protein, 117 aa, Artificial Sequence
  anti-rabies_HeavyChain
VVQPGRSLRLSCAASGFTFSSYAMHWVRQAPGKGLEWVAVISYDGSNKYYADSVKGRFTISRDNSKNTLYLQMNSLRAEDTAVYYCARDKALAARRGYYYYYGTDVWGQGTLVTVSS

SEQ ID NO: 1104 - protein, 216 aa, Artificial Sequence
  anti-RSV_5ITB_LightChain
SDIQMTQSPSTLSASVGDRVTITCRASQSISSWLAWYQQKPGKAPKLLIYDASSLESGVPSRFSGSGSGTEFTLTISSLQPDDFATYYCQQYNTYSWWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1105 - protein, 220 aa, Artificial Sequence
  anti-RSV_5ITB_HeavyChain
VESGGGLIQPGGSLRLSCAVSGFTVSSKYMTWVRQAPGKGLEWVSVIYGGGSTYYADSVVGRFTISRDNSKNTLYLQMNSLRAEDTAVYYCASRLGVRATTGDLDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 1106 - protein, 213 aa, Artificial Sequence; identical to SEQ ID NO: 1070
  anti-alpha-toxin_4U6V_LightChain

SEQ ID NO: 1107 - protein, 225 aa, Artificial Sequence
  anti-alpha-toxin_4U6V_HeavyChain
EVQLVESGGGLVQPGGSLRLSCAASGFTFSSHDMHWVRQATGKGLEWVSGIGTAGDTYYPDSVKGRFTISRENAKNSLYLQMNSLRAGDTAVYYCARDRYSPTGHYYGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 1108 - protein, 293 aa, Artificial Sequence
  anti-alpha-toxin_4U6V_Chain-A
ADSDINIKTGTTDIGSNTTVKTGDLVTYDKENGMHKKVFYSFIDDKNHNKKLLVIRTKGTIAGQYRVYSEEGANKSGLAWPSAFKVQLQLPDNEVAQISDYYPRNSIDTKEYMSTLTYGFNGNVTGDDTGKIGGLIGANVSIGHTLKYVQPDFKTILESPTDKKVGWKVIFNNMVNQNWGPYDRDSWNPVYGNQLFMKTRNGSMKAADNFLDPNKASSLLSSGFSPDFATVITMDRKASKQQTNIDVIYERVRDDYQLHWTSTNWKGTNTKDKWIDRSSERYKIDWEKEEMTN

SEQ ID NO: 1109 - protein, 293 aa, Artificial Sequence; identical to SEQ ID NO: 1108
  anti-alpha-toxin_4U6V_Chain-B

SEQ ID NO: 1110 - protein, 214 aa, Artificial Sequence
  anti-IsdB_5D1Q_Chain-A
DIQLTQSPSSVSASVGDRITITCRASQDISNWVAWYQQKPGKAPKLLIYSASSLQSGVPSRFSGSGSGTDFTLTISSLQPEDFATYYCQQANTFPWTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1111 - protein, 261 aa, Artificial Sequence
  anti-IsdB_5D1Q_Chain-B
QVQLVQSGAEVKKPASSVKVSCQASGGSFSTRTISWLRQAPGQGLEWMGGISPIFGAANYAQRFQGRVTITADKSTSTAYMELTSLTSEDTAVYYCARDRPPGAQFDTWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGSGHHHHHHHHHHGGDYKDHDGDYKDHDIDYKDDDDK

SEQ ID NO: 1112 - protein, 274 aa, Artificial Sequence
  anti-IsdB_5D1Q_Chain-C
EVQLVESGGGLVQPGGSLTLSCAASGLIFSDSTMHWVRQASGRGLEWVARIRSKANNYATSSDKSATAYLASVKGRFTISRDDSKDTTFLEMSSLKIEDTAVYYCIASSTTGWYVREDFDYWGHGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGSGHHHHHHHHHHGGDYKDHDGDYKDHDIDYKDDDDK

SEQ ID NO: 1113 - protein, 216 aa, Artificial Sequence
  anti-IsdB_5D1Q_Chain-D
EIVLTQSPGTLSLSPGERATLSCRASQSVSSSYLAWYQQKPGQAPRLLIYGASSRATGIPDRFSGSGSGTDFTLSISRLEPEDFAVYYCLHYGTSPMYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1114 - protein, 120 aa, Artificial Sequence
  anti-IsdB_5D1Q_Chain-E
PGKMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKAN

SEQ ID NO: 1115 - protein, 219 aa, Artificial Sequence
  anti-IsdB_5D1X_Chain-A
DIVMTQSPLSLPVTLGQPASISCSSAQSLVHSDGDSYLTWFHQRPGQSPRRLIYKVSIRDAGVPDRFSGSGSGTDFTLKISRVEAEDVGVYYCMQATHWPYTFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1116 - protein, 259 aa, Artificial Sequence
  anti-IsdB_5D1X_Chain-B
QVQLVQSGSEVKKPGSSVTLSCKASGDTFNTHTYSWVRQAPGQRLEWIGGIMPIFAASKSAPHLQDRLTITANKATRTAYMELTSLTSDDSGVYYCARDGRGALQYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGSGHHHHHHHHHHGGDYKDHDGDYKDHDIDYKDDDDK

SEQ ID NO: 1117 - protein, 274 aa, Artificial Sequence; identical to SEQ ID NO: 1112
  anti-IsdB_5D1X_Chain-C

SEQ ID NO: 1118 - protein, 216 aa, Artificial Sequence
  anti-IsdB_5D1X_Chain-D
EIVLTQTPATLSLTPGERATLTCRASQSVSSSYLAWYQQKPGQAPRLLIYGASSRATGIPDRFSGSGSGTDFTLSISRLEPEDFAVYYCLHYGTSPMYFFGRGTVLDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1119 - protein, 118 aa, Artificial Sequence
  anti-IsdB_5D1X_Chain-E
KMTDLQDTKYVVYESVENNESMMDTFVKHPIKTGMLNGKKYMVMETTNDDYWKDFMVEGQRVRTISKDAKNNTRTIIFPYVEGKTLYDAIVKVHVKTIDYDGQYHVRIVDKEAFTKAN

SEQ ID NO: 1120 - protein, 264 aa, Artificial Sequence
  anti-IsdB_5D1Z_Chain-B
AEVQLVESGGGVVQPGGSLRLSCAASGFTFNKFWMNWVRQAPGKGLEWVADIQVDGSEKNYVDSVKGRFTISRDNGKNSLYLQMNSLRAEDTGVYYCARGRYDYWSGYLSPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGSGHHHHHHHHHHGGDYKDHDGDYKDHDIDYKDDDDK

SEQ ID NO: 1121 - protein, 214 aa, Artificial Sequence
  anti-IsdB_5D1Z_Chain-C
DIQLTQSPSFLSASVADRVTITCRASQAVRSSLAWYQQKPGKAPQLLIYSASTLENGVSSRFSGSGPGTEFTLTISSLQPEDVGTYYCQQLNTYPFTFGPGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1122 - protein, 270 aa, Artificial Sequence
  anti-IsdB_5D1Z_Chain-D
QVQLQESGPGLVKPSETLSLICTVSGGSISSSSYYWGWIRQTPERNLEWIGIIYFSGTTYYNPSLQSRVSMSLDRSTNRFSLRLSSVTAADTAIYYCAKPKSRDRGGPGDDYFGMDVWGQGIMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCGGGSGHHHHHHHHHHGGDYKDHDGDYKDHDIDYKDDDDK

SEQ ID NO: 1123 - protein, 270 aa, Artificial Sequence; identical to SEQ ID NO: 1122
  anti-IsdB_5D1Z_Chain-F

SEQ ID NO: 1124 - protein, 264 aa, Artificial Sequence; identical to SEQ ID NO: 1120
  anti-IsdB_5D1Z_Chain-G

SEQ ID NO: 1125 - protein, 214 aa, Artificial Sequence
  anti-IsdB_5D1Z_HeavyChain
DIQMTQSPSFLSASVGDRVTITCRASQGITTYLGWYQQRPGKAPQLLIYAASSLQSGVPPRFSGSGSGTEFTLTISSLQPEDFATYYCQQLNTYPYTFGPGTRLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1126 - protein, 157 aa, Artificial Sequence
  anti-IsdB_5D1Z_Chain-I
GPAKATNNTYPILNQELREAIKNPAIKDKDHSAPNSRPIDFEMKKKDGTQQFYHYASSVKPARVIFTDSKPEIELGLQSGQFWRKFEVYEGDKKLPIKLVSYDTVKDYAYIRFSVSNGTKAVKIVSSTHFNNKEEKYDYTLMEFAQPIYNSADKFKT

SEQ ID NO: 1127 - protein, 108 aa, Artificial Sequence
  anti-HIV_b12_LightChain
EIVLTQSPGTLSLSPGERATFSCRSSHSIRSRRVAWYQHKPGQAPRLVIHGVSNRASGISDRFSGSGSGTDFTLTITRVEPEDFALYYCQVYGASSYTFGQGTKLERK

SEQ ID NO: 1128 - protein, 127 aa, Artificial Sequence
  anti-HIV_b12_HeavyChain
QVQLEQSGAEVKKPGASVKVSCQASGYRFSHFTVHWVRQAPGQRFEWMGWINPYNGNKEFSAKFQDRVTFTADTSANTAYMELRSLRSADTAVYYCARVGEWGWDDSPYDNYYMDVWGKGTTVIVSS

SEQ ID NO: 1129 - protein, 211 aa, Artificial Sequence
  anti-HIV_2G12_LightChain
VVMTQSPSTLSASVGDTITITCRASQSIETWLAWYQQKPGKAPKLLIYKASTLKTGVPSRFSGSGSGTEFTLTISGLQFDDFATYHCQHYAGYSATFGQGTRVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRG

SEQ ID NO: 1130 - protein, 224 aa, Artificial Sequence
  anti-HIV_2G12_HeavyChain
EVQLVESGGGLVKAGGSLILSCGVSNFRISAHTMNWVRRVPGGGLEWVASISTSSTYRDYADAVKGRFTVSRDDLEDFVYLQMHKMRVEDTAIYYCARKGSDRLSDNDPFDAWGPGTVVTVSPASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 1131 - protein, 214 aa, Artificial Sequence
  anti-HIV_4E10_LightChain
EIVLTQSPGTQSLSPGERATLSCRASQSVGNNKLAWYQQRPGQAPRLLIYGASSRPSGVADRFSGSGSGTDFTLTISRLEPEDFAVYYCQQYGQSLSTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGE

SEQ ID NO: 1132 - protein, 228 aa, Artificial Sequence
  anti-HIV_4E10_HeavyChain
QVQLVQSGAEVKRPGSSVTVSCKASGGSFSTYALSWVRQAPGRGLEWMGGVIPLLTITNYAPRFQGRITITADRSTSTAYLELNSLRPEDTAVYYCAREGTTGWGWLGKPIGAFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 1133 - protein, 104 aa, Artificial Sequence
  anti-HIV_VRC01_LightChain
EIVLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIKR

SEQ ID NO: 1134 - protein, 121 aa, Artificial Sequence
  anti-HIV_VRC01_HeavyChain
QVQLVQSGGQMKKPGESMRISCRASGYEFIDCTLNWIRLAPGKRPEWMGWLKPRGGAVNYARPLQGRVTMTRDVYSDTAFLELRSLTVDDTAVYFCTRGKNCDYNWDFEHWGRGTPVIVSS

SEQ ID NO: 1135 - protein, 110 aa, Artificial Sequence
  anti-HIV_PG9_LightChain
QSALTQPASVSGSPGQSITISCNGTSNDVGGYESVSWYQQHPGKAPKVVIYDVSKRPSGVSNRFSGSKSGNTASLTISGLQAEDEGDYYCKSLTSTRRRVFGTGTKLTVL

SEQ ID NO: 1136 - protein, 136 aa, Artificial Sequence
  anti-HIV_PG9_HeavyChain
QRLVESGGGVVQPGSSLRLSCAASGFDFSRQGMHWVRQAPGQGLEWVAFIKYDGSEKYHADSVWGRLSISRDNSKDTLYLQMNSLRVEDTATYFCVREAGGPDYRNGYNYYDFYDGYYNYHYMDVWGKGTTVTVSS

SEQ ID NO: 1137 - protein, 210 aa, Artificial Sequence
  anti-HIV_VRC07_LightChain
EIVLTQSPGTLSLSPGETAIISCRTSQYGSLAWYQQRPGQAPRLVIYSGSTRAAGIPDRFSGSRWGPDYTLTISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNRGEC

SEQ ID NO: 1138 - protein, 125 aa, Artificial Sequence
  anti-HIV_VRC07_HeavyChain
QVQLVQSGGQMKKPGESMRISCRASGYEFIDCTLNWIRLAPGKRPEWMGWLKPRGGAVNYARPLQGRVTMTRDVYSDTAFLELRSLTSDDTAVYFCTRGKYCTARDYYNWDFEHWGQGTPVIVSS

SEQ ID NO: 1139 - protein, 105 aa, Artificial Sequence
  anti-HIV_3BNC117_LightChain
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAP

SEQ ID NO: 1140 - protein, 129 aa, Artificial Sequence
  anti-HIV_3BNC117_HeavyChain
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSSASTKGP

SEQ ID NO: 1141 - protein, 108 aa, Artificial Sequence
  anti-HIV_10-1074_LightChain
SYVRPLSVALGETARISCGRQALGSRAVQWYQHRPGQAPILLIYNNQDRPSGIPERFSGTPDINFGTRATLTISGVEAGDEADYYCHMWDSRSGFSWSFGGATRLTVL

SEQ ID NO: 1142 - protein, 132 aa, Artificial Sequence
  anti-HIV_10-1074_HeavyChain
QVQLQESGPGLVKPSETLSVTCSVSGDSMNNYYWTWIRQSPGKGLEWIGYISDRESATYNPSLNSRVVISRDTSKNQLSLKLNSVTPADTAVYYCATARRGQRIYGVVSFGEFFYYYSMDVWGKGTTVTVSS

SEQ ID NO: 1143 - protein, 211 aa, Artificial Sequence
  anti-HIV_PGT121_LightChain
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTECS

SEQ ID NO: 1144 - protein, 235 aa, Artificial Sequence
  anti-HIV_PGT121_HeavyChain
QMQLQESGPGLVKPSETLSLTCSVSGASISDSYWSWIRRSPGKGLEWIGYVHKSGDTNYSPSLKSRVNLSLDTSKNQVSLSLVAATAADSGKYYCARTLHGRRIYGIVAFNEWFTYFYMDVWGNGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSC

SEQ ID NO: 1145 - protein, 219 aa, Artificial Sequence
  anti-HIV_PGDM1400_LightChain
DFVLTQSPHSLSVTPGESASISCKSSHSLIHGDRNNYLAWYVQKPGRSPQLLIYLASSRASGVPDRFSGSGSDKDFTLKISRVETEDVGTYYCMQGRESPWTFGQGTKVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1146 - protein, 245 aa, Artificial Sequence
  anti-HIV_PGDM1400_HeavyChain
QAQLVQSGPEVRKPGTSVKVSCKAPGNTLKTYDLHWVRSVPGQGLQWMGWISHEGDKKVIVERFKAKVTIDWDRSTNTAYLQLSGLTSGDTAVYYCAKGSKHRLRDYALYDDDGALNWAVDVDYLSNLEFWGQGTAVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 1147 - protein, 210 aa, Artificial Sequence
  anti-HIV_N6_LightChain
YIHVTQSPSSLSVSIGDRVTINCQTSQGVGSDLHWYQHKPGRAPKLLIHHTSSVEDGVPSRFSGSGFHTSFNLTISDLQADDIATYYCQVLQFFGRGSRLHIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1148 - protein, 225 aa, Artificial Sequence
  anti-HIV_N6_HeavyChain
RAHLVQSGTAMKKPGASVRVSCQTSGYTFTAHILFWFRQAPGRGLEWVGWIKPQYGAVNFGGGFRDRVTLTRDVYREIAYMDIRGLKPDDTAVYYCARDRSYGDSSWALDAWGQGTTVVVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 1149 - protein, 360 aa, Artificial Sequence [sequence omitted]

SEQ ID NO: 1150 - protein, 215 aa, Artificial Sequence
  anti-HIV_10E8_LightChain
SYELTQETGVSVALGRTVTITCRGDSLRSHYASWYQKKPGQAPILLFYGKNNRPSGVPDRFSGSASGNRASLTISGAQAEDDAEYYCSSRDKSGSRLSVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1151 - protein, 236 aa, Artificial Sequence
  anti-HIV_10E8_HeavyChain
EVQLVESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGRGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 1152 - protein, 111 aa, Artificial Sequence
  anti-HIV_12A12_LightChain
DIQMTQSPSSLSASVGDRVTITCQAGQGIGSSLQWYQQKPGKAPKLLVHGASNLHRGVPSRFSGSGFHTTFSLTISGLQRDDFATYFCAVLEFFGPGTKVEIKRTVAAPSV

SEQ ID NO: 1153 - protein, 127 aa, Artificial Sequence
  anti-HIV_12A12_HeavyChain
SQHLVQSGTQVKKPGASVRISCQASGYSFTDYVLHWWRQAPGQGLEWMGWIKPVYGARNYARRFQGRINFDRDIYREIAFMDLSGLRSDDTALYFCARDGSGDDTSWHLDPWGQGTLVIVSAASTKG

SEQ ID NO: 1154 - protein, 105 aa, Artificial Sequence
  anti-HIV_12A21_LightChain
DIQMTQSPSSLSASVGDRVTINCQAGQGIGSSLNWYQKKPGRAPKLLVHGASNLQRGVPSRFSGSGFHTTFTLTISSLQPDDVATYFCAVFQWFGPGTKVDIKRT

SEQ ID NO: 1155 - protein, 128 aa, Artificial Sequence
  anti-HIV_12A21_HeavyChain
SQHLVQSGTQVKKPGASVRVSCQASGYTFTNYILHWWRQAPGQGLEWMGLIKPVFGAVNYARQFQGRIQLTRDIYREIAFLDLSGLRSDDTAVYYCARDESGDDLKWHLHPWGQGTQVIVSPASTKGP

SEQ ID NO: 1156 - protein, 216 aa, Artificial Sequence
  anti-HIV_35022_LightChain
QSVLTQSASVSGSLGQSVTISCTGPNSVCCSHKSISWYQWPPGRAPTLIIYEDNERAPGISPRFSGYKSYWSAYLTISDLRPEDETTYYCCSYTHNSGCVFGTGTKVSVLGQSKANPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1157 - protein, 243 aa, Artificial Sequence
  anti-HIV_35022_HeavyChain
EGQLVQSGAELKKPGASVKISCKTSGYRFNFYHINWIRQTAGRGPEWMGWISPYSGDKNLAPAFQDRVIMTTDTEVPVTSFTSTGAAYMEIRNLKFDDTGTYFCAKGLLRDGSSTWLPYLWGQGTLLTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKGLEVLFQ

SEQ ID NO: 1158 - protein, 216 aa, Artificial Sequence
  anti-HIV_3BC176_LightChain
QSVLTQPASVSASPGQSITVSCTGSRNDVGGYDFVSWYQRHPGGVPKLIIYEISKRPSGIPQRFSGSRSGNTASLTISGLQDDDEADYYCCSYASYDRLIFGGGTRVSVLRQPKAAPSVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 1159 - protein, 233 aa, Artificial Sequence
  anti-HIV_3BC176_HeavyChain
EQVQLMQSGAQLRDPGDSLKISCKASGYNFIDYHIHWVRLAPGRGLEWMGWIDPVGGITKYAGQFQGRLSLTRDTSTNTLFLELSRLTAGDTAVYFCARSMRPVDHGIDYSGLFVFHFWGRGSDVLVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 1160 - protein, 207 aa, Artificial Sequence
  anti-HIV_3BNC55_LightChain
DIQMTQSPSSLSASVGDKVTITCQTSAGYLNWYQQRRGRAPKLLMYDGSRLVTGVPSRFSGRRWGTQYNLTIGSLQPEDIATYYCQVYEFFGPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1161 - protein, 225 aa, Artificial Sequence
  anti-HIV_3BNC55_HeavyChain
QVQLVQSGTAVKRPGASVRVSCQASGYTFTDYFIYWWRQAPGQGLEWLGWINPLTSQPSYPSRFQGRLTLTRDTFDEMLYMDLRGLRSDDTGIYFCARRHSDYCDFDIWGSGTQIIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKT

SEQ ID NO: 1162 - protein, 206 aa, Artificial Sequence
  anti-HIV_3BNC60_LightChain
DIQMTQSPSSLSARVGDTVTITCQANGYLNWYQQRRGKAPKLLIYDGSKLERGVPARFSGRRWGQEYNLTINNLQPEDVATYFCQVYEFIVPGTRLDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1163 - protein, 229 aa, Artificial Sequence
  anti-HIV_3BNC60_HeavyChain
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKT

SEQ ID NO: 1164 - protein, 229 aa, Artificial Sequence
  anti-HIV_3BNC60_HeavyChain
EVHLSQSGAAVTKPGASVRVSCEASGYKISDHFIHWWRQAPGQGLQWVGWINPKTGQPNNARQFQGRVSLTRQASWDFDTYSFYMDLKAVRSDDTAIYFCARQRSDFWDFDVWGSGTQVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKT

SEQ ID NO: 1165 - protein, 216 aa, Artificial Sequence
  anti-HIV_447-52D_LightChain
QSVLTQPPSVSAAPGQKVTISCSGSSSNIGNNYVLWYQQFPGTAPKLLIYGNNKRPSGIPDRFSGSKSGTSATLGITGLQTGDEADYFCATWDSGLSADWVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTEC

SEQ ID NO: 1166 - protein, 231 aa, Artificial Sequence
  anti-HIV_447-52D_HeavyChain
EVQLVESGGGLVKPGGSLRLTCVASGFTFSDVWLNWVRQAPGKGLEWVGRIKSRTDGGTTDYAASVKGRFTISRDDSKNTLYLQMNSLKTEDTAVYSCTTDGFIMIRGVSEDYYYYYMDVWGKGTTVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVEL

SEQ ID NO: 1167 - protein, 215 aa, Artificial Sequence
  anti-HIV_447-52D_LightChain
QSVLTQPPSVSAAPGQKVTISCSGSSSNIGNNYVLWYQQFPGTAPKLLIYGNNKRPSGIPDRFSGSKSGTSATLGITGLQTGDEADYFCATWDSGLSADWVFGGGTKLTVLSQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTE

SEQ ID NO: 1168 - protein, 235 aa, Artificial Sequence
  anti-HIV_447-52D_HeavyChain
EVQLVESGGGLVKPGGSLRLTCVASGFTFSDVWLNWVRQAPGKGLEWVGRIKSRTDGGTTDYAASVKGRFTISRDDSKNTLYLQMNSLKTEDTAVYSCTTDGFIMIRGVSEDYYYYYMDVWGKGTTVTVSSASTKGPSVFPLAPCSRSTSGGTAALGCLVKDYFPEPVTVSWNSGALTSGVHTFPAVLQSSGLYSLSSVVTVPSSSLGTQTYTCNVNHKPSNTKVDKRVELKTPT

SEQ ID NO: 1169 - protein, 208 aa, Artificial Sequence
  anti-HIV_5H/I1-BMV-D5_LightChain
DIQMTQSPSTLSASIGDRVTITCRASEGIYHWLAWYQQKPGKAPKLLIYKASSLASGAPSRFSGSGSGTDFTLTISSLQPDDFATYYCQQYSNYPLTFGGGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKS

SEQ ID NO: 1170 - protein, 217 aa, Artificial Sequence
  anti-HIV_5H/I1-BMV-D5_HeavyChain
QVQLVQSGAEVRKPGASVKVSCKASGDTFSSYAISWVRQAPGQGLEWMGGIIPIFGTANYAQAFQGRVTITANESTSTAYMELSSLRSEDTAIYYCARDNPTLLGSDYWGAGTLVTVSSASTKGPSVFPLAPCSRSTSGGTAALGCLVKDYFPEPVTVSWNSGALTSGVHTFPAVLQSSGLYSLSSVVTVPSSSLGTQTYICNVNHKPSNTKVDKRV

SEQ ID NO: 1171 - protein, 219 aa, Artificial Sequence
  anti-HIV_5H/I1-BMV-D5_A-Chain
MQLLSGIVQQQNNLLRAIEAQQHLLQLTVWGIKQLQARILAGGSGGHTTWMEWDREINNYTSLIHSLIEESQNQQEKNEQELLEGSSGGQLLSGIVQQQNNLLRAIEAQQHLLQLTVWGIKQLQARILAGGSGGHTTWMEWDREINNYTSLIHSLIEESQNQQEKNEQELLEGSSGGQLLSGIVQQQNNLLRAIEAQQHLLQLTVWGIKQLQARILAGG

SEQ ID NO: 1172 - protein, 130 aa, Artificial Sequence
  anti-HIV_8ANC195_LightChain
DIQMTQSPSTLSASIGDTVRISCRASQSITGNWVAWYQQRPGKAPRLLIYRGAALLGGVPSRFSGSAAGTDFTLTIGNLQAEDFGTFYCQQYDTYPGTFGQGTKVEVKRTVAAPSVFIFPPSDEQLKSGT

SEQ ID NO: 1173 - protein, 141 aa, Artificial Sequence
  anti-HIV_8ANC195_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKGPSVF

SEQ ID NO: 1174 - protein, 111 aa, Artificial Sequence
  anti-HIV_CAP256-VRC26.01_LightChain
QSVLTQPPSVSAAPGQKVTISCSGSSSTIGNNYVSWYRLLPGTAPKLLIYKNDNRPSGIPDRFSGSKSGTSATLGISGLQTGDEADYYCGTWDTSLSGGGVFGTGTKVTVL

SEQ ID NO: 1175 - protein, 144 aa, Artificial Sequence
  anti-HIV_CAP256-VRC26.01_HeavyChain
EVQVVESGGGVVQPGRSLRLSCTASGFTFSNFAMGWVRQAPGKGLEWVAFISSDGSNKNYGDSVKGRFTISRDNSKNTVFLQMNSLRVEDTALYYCAKDVGDYKSDEWGTEYYDISISYPIQDPRAMVGAFDLWGQGTMVTVSP

SEQ ID NO: 1176 - protein, 108 aa, Artificial Sequence
  anti-HIV_CAP256-VRC26.02_LightChain
QSVLTQPPSVSAAPGQKVTISCSGSNSNIGNKDVSWYQQIPATAPKLLIYENNKRPSGISDRFSGSKSGTSATLAITGLQTGDEADYYCATWDGRVSVIGTGTNVIVL

SEQ ID NO: 1177 - protein, 144 aa, Artificial Sequence
  anti-HIV_CAP256-VRC26.02_HeavyChain
EVQLVESGGGVVQPGRSLRLSCAASQFSFGNYGMHWVRQAPGKGLEWVAAISFAGTKTNYADSVKGRFTISRDNSKNTVYLQMNSLRAEDTALYFCAKDIREYECEYWTSDYYDFGRPQPCIDSRGVVGTFDVWGQGTMVTVSS

SEQ ID NO: 1178 - protein, 111 aa, Artificial Sequence
  anti-HIV_CAP256-VRC26.03_LightChain
QSVLTQPPSVSAAPGQKVTISCSGSSSNIGNNFVSWYQQRPGTAPKILIYENNKRPSETPDRFSGSKSGTSATLAITGLQTADEAEYYCATWSASLSSARVFGTGTRITVL

SEQ ID NO: 1179 - protein, 144 aa, Artificial Sequence
  anti-HIV_CAP256-VRC26.03_HeavyChain
EVQLVESGGGVVQPGKSLRLSCAASRFSFNRYGMHWVRQAPGKGLEWVAAISYDGTDKYHADKVWGRFTISRDNSKNTLYLQMNSLRAEDTALYYCAKDLREDECEEWWSDYYDFGKQLPCRKSRGVAGIFDGWGQGTMVTVSS

SEQ ID NO: 1180 - protein, 111 aa, Artificial Sequence
  anti-HIV_CAP256-VRC26.04_LightChain
QPVLTQPPSVSAAPGQKVTISCSGSSSNIGNNFVSWYQQRPGTAPSLLIYETNKRPSGIPDRFSGSKSATSATLAITGLQTGDEADYYCATWAASLTSARVFGTGTKVIVS

SEQ ID NO: 1181 - protein, 144 aa, Artificial Sequence
  anti-HIV_CAP256-VRC26.04_HeavyChain
EVQLVESGGGVVQPGKSLRLSCAASQFSFNRYGMHWVRQAPGKGLEWVAAISYDGTDKYHADKVWGRFTISRDNSKNTLYLQMNSLRAEDTALYYCAKDLREDECEEWWSDYYDFGKQLPCRKSRGVAGIFDKWGQGTMVIVSS

SEQ ID NO: 1182 - protein, 108 aa, Artificial Sequence
  anti-HIV_CAP256-VRC26.05_LightChain
QSALTQPPSVSAAPGQKVTISCSGNIGNNYVSWYQQVPGTAPKLLIYENNKRPSGIPDRFSGSKSGTSATLVITGLQTGDEADFYCGTWGGSLRTGGVLGTGTRVTVL

SEQ ID NO: 1183 - protein, 144 aa, Artificial Sequence
  anti-HIV_CAP256-VRC26.05_HeavyChain
EVQLVESGGGVVQPGRSLRLSCAASHFSLSSYGMHWVRQAPGKGLEWVTGISFAGTKTYYGDSVRGRFTVSRDISKNTLFLQMNSLRPDDTAMYYCARDQRYYECEEWASDYYDFGREQPCLDPRGVVGIFDLWGQGTMVTVSS

SEQ ID NO: 1184 - protein, 108 aa, Artificial Sequence
  anti-HIV_CAP256-VRC26.06_LightChain
QSVLTQPPSVSAAPGQKVTISCSGSTSKIGQNSVSWYQQLPGTAPKLLIYENDRRPSGTPDRFSGSKSGTSATLAITGLQTGDEAEYYCETWDGSGGVFGTGTKVTVL

SEQ ID NO: 1185 - protein, 145 aa, Artificial Sequence
  anti-HIV_CAP256-VRC26.06_HeavyChain
EVQLIESGGGVVQPGRSLRLSCGASGFSFNNYGMHWVRQAPGKGLEWVAGISFAGIKKYYGTSVKGRFTISRDNSKNNFYLQMNSLRVEDTALYYCARDLRELECEEWTLYNYYDFGSRGPCVDPRGVAGSFDVWGQGTMVTVSS

SEQ ID NO: 1186 - protein, 111 aa, Artificial Sequence
  anti-HIV_CAP256-VRC26.07_LightChain
QAVLTQPPSVSAAPGQNVTISCSGSGSNIGNNFVSWYQQRPGTAPKLLIYESNKRPSGIPDRFSGSKSGTSATLAITGLQTGDEAYYYCATWAARLNSARVFGTGTMVTVL

SEQ ID NO: 1187 - protein, 144 aa, Artificial Sequence
  anti-HIV_CAP256-VRC26.07_HeavyChain
EVQLVESGGGVVQPGRSLRLSCVGSQFSFNRYGMHWVRQAPGKGLEWVAGISFDGTDRYHADNVWGRFTISRDNSKNTLYLQMSSLRAEDTALYYCAKDLREDECEEWWSDYYDFGKKLPCRKSRGVAGVFDKWGQGTMVTVSS

SEQ ID NO: 1188 - protein, 111 aa, Artificial Sequence
  anti-HIV_CAP256-VRC26.08_LightChain
QSALTQPPSVSAAPGQKVTISCSGNSSNIGNNFVSWYQQVPGTAPKLLLYETYRRPSGIPDRFSGSKSGTSATLAITGLQTGDEADYYCTVWGVRKGVGAVFGTGTKVTVL

SEQ ID NO: 1189 - protein, 146 aa, Artificial Sequence
  anti-HIV_CAP256-VRC26.08_HeavyChain
EVQLVESGGGVVQPGRSLTLSCAASQFTFSNYGMHWVRQAPGKGLEWVASVSNDGTKKYHGDSVWGRFTISRDNSKNTLFLQMSSLRAEDTAVYFCVRDQREDECEEWWSDYYDFGRELPCRKFRGLGLAGIFDIWGHGTMVTVSS

SEQ ID NO: 1190 - protein, 111 aa, Artificial Sequence
  anti-HIV_CAP256-VRC26.09_LightChain
QSALTQPPSVSAAPGQKVTISCSGNSSNIGNNFVSWYQQLPGTAPKLLIYENNRRPSGIPDRFSGSKSGTSATLAISGLQTGDEADYWCAVWGVRRGAGAVFGAGTKVTVL

SEQ ID NO: 1191 - protein, 146 aa, Artificial Sequence
  anti-HIV_CAP256-VRC26.09_HeavyChain
EVQLVESGGGVVQPGRSLTLSCAASQFNFANYGMHWVRQAPGKGLEWVASISNDGTKKYHEESVWGRFTISKDNSKSTLFLQMNSLRIEDTALYFCVKDQREDECEEWWSDYYDFGRELPCRKSRGLGLAGIFDMWGHGTMVTVSS

SEQ ID NO: 1192 - protein, 111 aa, Artificial Sequence
  anti-HIV_CAP256-VRC26.10_LightChain
QSVLTQPPSVSAAPGQKVTISCSGSSSNIGDNYVSWYQHLPGTAPKLLIYENTRRPSGIPDRFSGSKSGTSATLAITGLQTGDEADYYCGTWDVRPNRGAVFGTGTKVTVL

SEQ ID NO: 1193 - protein, 144 aa, Artificial Sequence
  anti-HIV_CAP256-VRC26.10_HeavyChain
QAILVESGGGVVQPGRSLRLSCAASQFTFSGHGLHWVRQAPGKGLEWVASISFAGTKMDYADSVKGRFAISRDNSKNTLYLQMNSLRVEDTALYYCAKDMREYECEYWTSDYYDFGRPQPCIDRRGVVGIFDMWGQGTMVTVST

SEQ ID NO: 1194 - protein, 107 aa, Artificial Sequence
  anti-HIV_CAP256-VRC26.11_LightChain
QSVLTQPPSVSAAPGQNVTISCSGPPSHIEKNDVSWYQRLPGMAPKMVIYESKRRPLGIPVRFSASRSGSSATLVITGLQTADEADYYCGTWDGRMNFGTGTTVSVL

SEQ ID NO: 1195 - protein, 143 aa, Artificial Sequence
  anti-HIV_CAP256-VRC26.11_HeavyChain
EVQLVESGGGVVPPGKSLTLSCVASRFTFSAFGMHWVRQAPGKGLEWVASISFAGIKKYYADSVKGRFSISRDNSNTLFLQMNGLRGEDTGLYHCVKDMRELECEEWASDYYDFGKPQPCLDRRGVSGISAWWGPGTMVTVSS

SEQ ID NO: 1196 - protein, 107 aa, Artificial Sequence
  anti-HIV_CAP256-VRC26.12_LightChain
QSVLTQPPSVSTAPGQTVTVSCSGGTSNTGNNFVSWYQHLPGTAPKLLIYENNKRPLGVPDRFSGAKSGTSATLAITGLQTGDEGDYYCATWSGSLNIGTGTKVSVL

SEQ ID NO: 1197 - protein, 144 aa, Artificial Sequence
  anti-HIV_CAP256-VRC26.12_HeavyChain
EVQLVQSGGGVVQPGRSLRLSCAAPYFEFGRYGFHWVRQAPGKGLEWVASISFAGRDYYHSPSVWGRFTISRDNSKNTLYLQMNSLRIEDTALYFCARDLRESECEEWESDYYDFGKKGPCVKPRGVAGGLDLWGQGTMVIVSS

SEQ ID NO: 1198 - protein, 111 aa, Artificial Sequence
  anti-HIV_CAP256-VRC26.I1_LightChain
QSVLTQPPSVSAAPGQKVTISCSGSSSNIGNNYVSWYQQLPGTAPKLLIYKNNERPSGIPDRFSGSKSGTSATLGITGLQTGDEADYYCGTWDTSLSAGGVFGTGTKVTVL

SEQ ID NO: 1199 - protein, 144 aa, Artificial Sequence
  anti-HIV_CAP256-VRC26.I1_HeavyChain
QVQLVESGGGVVQPGRSLRLSCAASGFTFSNYAMDWVRQAPGKGLEWVAVISSDGSNKNYADSVKGRFTISRDNSKNTLYLQMNSLRAEDTAVYYCAKDLGENKNDEWATDYYDLSIAYPVQDPRAVVGAFDIWGQGTMVTVSS

SEQ ID NO: 1200 - protein, 111 aa, Artificial Sequence
  anti-HIV_CAP256-VRC26.I2_LightChain
QSVLTQPPSVSAAPGQKVTISCSGSSSTIGNNYVSWYQLLPGTAPKLLIYKNDKRPSGIPDRFSGSKSGTSATLGITGLQTGDEADYYCGTWDTSLSAGGVFGTGTKVTVL

SEQ ID NO: 1201 - protein, 144 aa, Artificial Sequence
  anti-HIV_CAP256-VRC26.I2_HeavyChain
QVQLVESGGGVVQPGRSLRLSCAASGFTFSNFAMGWVRQAPGKGLEWVAFISSDGSNKNYGDSVKGRFTISRDNSKNTLFLQMNSLRAEDTALYYCAKDVGEYKSDEWATDYYDLSIAYPIQDPRAMVGAFDIWGQGTMVTVSS

SEQ ID NO: 1202 - protein, 111 aa, Artificial Sequence
  anti-HIV_CAP256-VRC26.UCA_LightChain
QSVLTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGGVFGTGTKVTVL

SEQ ID NO: 1203 - protein, 144 aa, Artificial Sequence
  anti-HIV_CAP256-VRC26.UCA_HeavyChain
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGESENEEWATDYYDFSIGYPGQDPRGVVGAFDIWGQGTMVTVSS

SEQ ID NO: 1204 - protein, 108 aa, Artificial Sequence
  anti-HIV_CH01_LightChain
EIVLAQSPGTLSLSPGERATLSCRASHNVHPKYFAWYQQKPGQSPRLLIYGGSTRAAGIPGKFSGSGSGTDFTLTISRVDPEDFAVYYCQQYGGSPYTFGQGTKVEIK

SEQ ID NO: 1205 - protein, 133 aa, Artificial Sequence
  anti-HIV_CH01_HeavyChain
EVQLVESGANVVRPGGSLRLSCKASGFIFENFGFSWVRQAPGKGLQWVAGLNWNGGDTRYADSVKGRFRMSRDNSRNFVYLDMDKVGVDDTAFYYCARGTDYTIDDAGIHYQGSGTFWYFDLWGRGTLVSVSS

SEQ ID NO: 1206 - protein, 108 aa, Artificial Sequence
  anti-HIV_CH02_LightChain
EIVLTQSPATLSVSPGERATLSCRASQNVHPRYFAWYQQKRGQSPRLLIHSGSTRAAGIADRFSGGGSGMHFTLTITRVEPEDFAVYFCQQYGGSPYTFGQGTRVELR

SEQ ID NO: 1207 - protein, 133 aa, Artificial Sequence
  anti-HIV_CH02_HeavyChain
EVQLVESGGSVVRPGGSLRLSCRASGFIFENYGLTWVRQVPGKGLHWVSGMNWNGGDTRYADSVRGRFSMSRDNSNNIAYLQMNNLRVEDTALYYCARGTDYTIDDQGRFYQGSGTFWYFDFWGRGTLVTVSS

SEQ ID NO: 1208 - protein, 108 aa, Artificial Sequence
  anti-HIV_CH03_LightChain
EIVLTQSPATLSLSPGERATLSCRASQSVHPKYFAWYQQKPGQSPRLLIYSGSTRAAGIADRFSGGGSGIHFTLTITRVEPEDFAVYFCQQYGGSPYTFGQGTKVELR

SEQ ID NO: 1209 - protein, 133 aa, Artificial Sequence
  anti-HIV_CH03_HeavyChain
EVQLVESGGGVVRPGGSLRLSCAASGFIFENYGLTWVRQVPGKGLHWVSGMNWNGGDTRYADSVRGRFSMSRDNSNNIAYLQMKNLRVDDTALYYCARGTDYTIDDQGIFYKGSGTFWYFDLWGRGTLVTVSS

SEQ ID NO: 1210 - protein, 108 aa, Artificial Sequence
  anti-HIV_CH04_LightChain
EIVLTQSPDTLSLSPGERATLSCRASQSVHSRYFAWYQHKPGQPPRLLIYGGSTRATGIPNRFSAGGSGTQFTLTVNRLEAEDFAVYYCQQYGRSPYTFGQGTKVEIR

SEQ ID NO: 1211 - protein, 133 aa, Artificial Sequence
  anti-HIV_CH04_HeavyChain
EVQLVESGGGLIRPGGSLRLSCKGSGFIFENFGFGWVRQGPGKGLEWVSGTNWNGGDSRYGDSVKGRFTISRDNSNNFVYLQMNSLRPEDTAIYYCARGTDYTIDDQGIRYQGSGTFWYFDVWGRGTLVTVSS

SEQ ID NO: 1212 - protein, 209 aa, Artificial Sequence
  anti-HIV_CH103_LightChain
YELTQPPSVSVSPGQTATITCSGASTNVCWYQVKPGQSPEVVIFENYKRPSGIPDRFSGSKSGSTATLTIRGTQAIDEADYYCQVWDSFSTFVFGSGTQVTVLRQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1213 - protein, 226 aa, Artificial Sequence
  anti-HIV_CH103_HeavyChain
QVQLQESGPGVVKSSETLSLTCTVSGGSMGGTYWSWLRLSPGKGLEWIGYIFHTGETNYSPSLKGRVSISVDTSEDQFSLRLRSVTAADTAVYFCASLPRGQLVNAYFRNWGRGSLVSVTAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 1214 - protein, 107 aa, Artificial Sequence
  anti-HIV_M66.6_LightChain
DIQLTQSPSSLSASVGDRVTITCRASQSIGSYLNWYQQKPGKAPKLLIYAASTLQSGVPSRFSGSGSGTDFTLTISSLQPEDSATYYCQQSYSTPFTFGPGTKVDIR

SEQ ID NO: 1215 - protein, 130 aa, Artificial Sequence
  anti-HIV_M66.6_HeavyChain
QVQLVQSGAEVKKPGESLKISCKVSGYNFASEWIGWVRQMPGKGLEWMGIIYPGDSDTKYSPSFQGQVIISADKSINTAYLQWSSLKASDTAIYYCARQNHYGSGSYFYRTAYYYAMDVWGQGTTVTVSS

SEQ ID NO: 1216 - protein, 109 aa, Artificial Sequence
  anti-HIV_NIH45-46_LightChain
EIVLTQSPATLSLSPGETAIISCRTSQSGSLAWYQQRPGQAPRLVIYSGSTRAAGIPDRFSGSRWGADYNLSISNLESGDFGVYYCQQYEFFGQGTKVQVDIKRTVAAP

SEQ ID NO: 1217 - protein, 133 aa, Artificial Sequence
  anti-HIV_NIH45-46_HeavyChain
QVRLSQSGGQMKKPGESMRLSCRASGYEFLNCPINWIRLAPGRRPEWMGWLKPRGGAVNYARKFQGRVTMTRDVYSDTAFLELRSLTSDDTAVYFCTRGKYCTARDYYNWDFEHWGRGAPVTVSSASTKGPSV

SEQ ID NO: 1218 - protein, 110 aa, Artificial Sequence
  anti-HIV_PG16_LightChain
QSALTQPASVSGSPGQTITISCNGTSSDVGGFDSVSWYQQSPGKAPKVMVFDVSHRPSGISNRFSGSKSGNTASLTISGLHIEDEGDYFCSSLTDRSHRIFGGGTKVTVL

SEQ ID NO: 1219 - protein, 137 aa, Artificial Sequence
  anti-HIV_PG16_HeavyChain
QEQLVESGGGVVQPGGSLRLSCLASGFTFHKYGMHWVRQAPGKGLEWVALISDDGMRKYHSDSMWGRVTISRDNSKNTLYLQFSSLKVEDTAMFFCAREAGGPIWHDDVKYYDFNDGYYNYHYMDVWGKGTTVTVSS

SEQ ID NO: 1220 - protein, 105 aa, Artificial Sequence
  anti-HIV_PGT122_LightChain
TFVSVAPGQTARITCGEESLGSRSVIWYQQRPGQAPSLIIYNNNDRPSGIPDRFSGSPGSTFGTTATLTITSVEAGDEADYYCHIWDSRRPTNWVFGEGTTLIVL

SEQ ID NO: 1221 - protein, 132 aa, Artificial Sequence
  anti-HIV_PGT122_HeavyChain
QVHLQESGPGLVKPSETLSLTCNVSGTLVRDNYWSWIRQPLGKQPEWIGYVHDSGDTNYNPSLKSRVHLSLDKSKNLVSLRLTGVTAADSAIYYCATTKHGRRIYGVVAFKEWFTYFYMDVWGKGTSVTVSS

SEQ ID NO: 1222 - protein, 105 aa, Artificial Sequence
  anti-HIV_PGT123_LightChain
SSMSVSPGETAKISCGKESIGSRAVQWYQQKPGQPPSLIIYNNQDRPAGVPERFSASPDFRPGTTATLTITNVDAEDEADYYCHIYDARGGTNWVFDRGTTLTVL

SEQ ID NO: 1223 - protein, 132 aa, Artificial Sequence
  anti-HIV_PGT123_HeavyChain
QLHLQESGPGLVKPPETLSLTCSVSGASINDAYWSWIRQSPGKRPEWVGYVHHSGDTNYNPSLKRRVTFSLDTAKNEVSLKLVDLTAADSATYFCARALHGKRIYGIVALGELFTYFYMDVWGKGTAVTVSS

SEQ ID NO: 1224 - protein, 105 aa, Artificial Sequence
  anti-HIV_PGT125_LightChain
QSALTQPPSASGSPGQSITISCNGTATNFVSWYQQFPDKAPKLIIFGVDKRPPGVPDRFSGSRSGTTASLTVSRLQTDDEAVYYCGSLVGNWDVIFGGGTTLTVL

SEQ ID NO: 1225 - protein, 137 aa, Artificial Sequence
  anti-HIV_PGT125_HeavyChain
QSQLQESGPRLVEASETLSLTCNVSGESTGACTYFWGWVRQAPGKGLEWIGSLSHCQSFWGSGWTFHNPSLKSRLTISLDTPKNQVFLKLTSLTAADTATYYCARFDGEVLVYNHWPKPAWVDLWGRGIPVTVTVSS

SEQ ID NO: 1226 - protein, 105 aa, Artificial Sequence
  anti-HIV_PGT126_LightChain
QSALTQPPSASGSPGQSISISCTGTSNRFVSWYQQHPGKAPKLVIYGVNKRPSGVPDRFSGSKSGNTASLTVSGLQTDDEAVYYCSSLVGNWDVIFGGGTKLTVL

SEQ ID NO: 1227 - protein, 137 aa, Artificial Sequence
  anti-HIV_PGT126_HeavyChain
QPQLQESGPGLVEASETLSLTCTVSGDSTAACDYFWGWVRQPPGKGLEWIGGLSHCAGYYNTGWTYHNPSLKSRLTISLDTPKNQVFLKLNSVTAADTAIYYCARFDGEVLVYHDWPKPAWVDLWGRGTLVTVTVSS

SEQ ID NO: 1228 - protein, 105 aa, Artificial Sequence
  anti-HIV_PGT127_LightChain
QSALTQPPSASGSPGQSITISCTGTSNNFVSWYQQYPGKAPKLVIYEVNKRPSGVPDRFSGSKSGSTASLTVSGLQADDEGVYYCSSLVGNWDVIFGGGTKLTVL

SEQ ID NO: 1229 - protein, 135 aa, Artificial Sequence
  anti-HIV_PGT127_HeavyChain
QPQLQESGPGLVEASETLSLTCTVSGDSTGRCNYFWGWVRQPPGKGLEWIGSLSHCRSYYNTDWTYHNPSLKSRLTISLDTPKNQVFLRLTSVTAADTATYYCARFGGEVLVYRDWPKPAWVDLWGRGTLVTVSS

SEQ ID NO: 1230 - protein, 105 aa, Artificial Sequence
  anti-HIV_PGT128_LightChain
QSALTQPPSASGSPGQSITISCTGTSNNFVSWYQQHAGKAPKLVIYDVNKRPSGVPDRFSGSKSGNTASLTVSGLQTDDEAVYYCGSLVGNWDVIFGGGTKLTVL

SEQ ID NO: 1231 - protein, 135 aa, Artificial Sequence
  anti-HIV_PGT128_HeavyChain
QPQLQESGPTLVEASETLSLTCAVSGDSTAACNSFWGWVRQPPGKGLEWVGSLSHCASYWNRGWTYHNPSLKSRLTLALDTPKNLVFLKLNSVTAADTATYYCARFGGEVLRYTDWPKPAWVDLWGRGTLVTVSS

SEQ ID NO: 1232 - protein, 110 aa, Artificial Sequence
  anti-HIV_PGT130_LightChain
QSALTQPPSASGSLGQSVTISCNGTSSDIGGWNFVSWYQQFPGRAPRLIIFEVNKRPSGVPGRFSGSKSGNSASLTVSGLQSDDEGQYFCSSLFGRWDVVFGGGTKLTVL

SEQ ID NO: 1233 - protein, 129 aa, Artificial Sequence
  anti-HIV_PGT130_HeavyChain
QVQLQESGPGLVKPAETLSLTCSVSGESINTGHYYWGWVRQVPGKGLEWIGHIHYTTAVLHNPSLKSRLTIKIYTLRNQITLRLSNVTAADTAVYHCVRSGGDILYYYEWQKPHWFSPWGPGIHVTVSS

SEQ ID NO: 1234 - protein, 110 aa, Artificial Sequence
  anti-HIV_PGT131_LightChain
QSALTQPPSASGSLGQSLTISCSGTGSDIGSWNFVSWYQQFPGRAPNLIIFEVNRRRSGVPDRFSGSKSGNTASLTVSGLRSEDEAEYFCSSLSGRWDIVFGGGTKVTVL

SEQ ID NO: 1235 - protein, 129 aa, Artificial Sequence
  anti-HIV_PGT131_HeavyChain
QVQLQESGPGLVKPSETLSLTCTVSGDSINTGHHYWGWVRQVPGKGPEWIAHIHYNTAVLHNPALKSRVTISIFTLKNLITLSLSNVTAADTAVYFCVRSGGDILYYIEWQKPHWFYPWGPGILVTVSS

SEQ ID NO: 1236 - protein, 107 aa, Artificial Sequence
  anti-HIV_PGT135_LightChain
EIVMTQSPDTLSVSPGETVTLSCRASQNINKNLAWYQYKPGQSPRLVIFETYSKIAAFPARFVASGSGTEFTLTINNMQSEDVAVYYCQQYEEWPRTFGQGTKVDIK

SEQ ID NO: 1237 - protein, 133 aa, Artificial Sequence [sequence omitted]

SEQ ID NO: 1238 - protein, 107 aa, Artificial Sequence
  anti-HIV_PGT136_LightChain
EIVMTQSPPTLSVSPGETATLSCRASQNVKNNLAWYQLKPGQAPRLLIFDASSRAGGIPDRFSGSGYGTDFTLTVNSVQSEDFGDYFCQQYEEWPRTFGQGTKVDIK

SEQ ID NO: 1239 - protein, 134 aa, Artificial Sequence
  anti-HIV_PGT136_HeavyChain
QLQLQESGPGLVKPSETLSLTCTVSGGSMRGTDWGENDFHYGWIRQSSAKGLEWIGSIHWRGRTTHYKTSFRSRATLSIDTSNNRFSLTFSFVTAADTAVYYCARHKYHDIFRVVPVAGWFDPWGQGLLVTVSS

SEQ ID NO: 1240 - protein, 107 aa, Artificial Sequence
  anti-HIV_PGT137_LightChain
EIMMTQSPAILSVSPGDRATLSCRASQSVKNNLAWYQKRPGQAPRLLIFDTSSRASGIPARFSGGGSGTEFTLTVNSMQSEDFATYYCQQYEEWPRTFGQGTKVEIK

SEQ ID NO: 1241 - protein, 133 aa, Artificial Sequence
  anti-HIV_PGT137_HeavyChain
EVHLEESGPGLVRPSETLSLTCTASGGSIRGGEWGDSDYHWGWVRHSPEKGLEWIGSIHWRGTTHYNAPFRGRGRLSIDLSRNQFSLRLTSVTAEDTAVYYCVKHKYHDIVMVVPIAGWFDPWGQGLQVTVSS

SEQ ID NO: 1242 - protein, 112 aa, Artificial Sequence
  anti-HIV_PGT141_LightChain
DTVVTQSPLSLPVTPGEAASMSCSSTQSLRHSNGANYLAWYQHKPGQSPRLLIRLGSQRASGVPDRFSGSGSGTHFTLKISRVEAEDAAIYYCMQGLNRPWTFGKGTKLEIK

SEQ ID NO: 1243 - protein, 141 aa, Artificial Sequence
  anti-HIV_PGT141_HeavyChain
QVQLVQSGPEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSS

SEQ ID NO: 1244 - protein, 112 aa, Artificial Sequence; identical to SEQ ID NO: 1242
  anti-HIV_PGT142_LightChain

SEQ ID NO: 1245 - protein, 141 aa, Artificial Sequence
  anti-HIV_PGT142_HeavyChain
QVQLVQSGPEVKKPGSSVKVSCKASGNTFSKYDVHWVRQATGQGLEWVGWISHERDKTESAQRFKGRVTFTRDTSATTAYMELRGLTSDDTAIYYCTRGSKHRLRDYVLYDDYGLINYQEWNDYLEFLDVWGHGTAVTVSS

SEQ ID NO: 1246 - protein, 112 aa, Artificial Sequence
  anti-HIV_PGT143_LightChain
DTVVTQSPLSLPVTPGEAASMSCTSTQSLRHSNGANYLAWYQHKPGQSPRLLIRLGSQRASGVPDRFSGSGSGTHFTLKISRVEPEDAAIYYCMQGLNRPWTFGKGTKLEIK

SEQ ID NO: 1247 - protein, 141 aa, Artificial Sequence
  anti-HIV_PGT143_HeavyChain
QVQLEQSGAEVKKPGSSVKVSCKASGNTFSKYDVHWVRQATGQGLEWVGWMSHEGDKTESAQRFKGRVTFTRDTSASTAYMELRGLTSDDTAIYYCTRGSKHRLRDYVLYDDYGLINYQEWNDYLEFLDVWGHGTAVTVSS

SEQ ID NO: 1248 - protein, 112 aa, Artificial Sequence
  anti-HIV_PGT144_LightChain
DTVVTQSPLSLSVTPGEAASMSCTSTQSLRHSNGANYLAWYQHKPGQSPRLLIRLGSQRASGVPDRFSGSGSGTHFTLKISRVEADDAAIYYCMQGLNRPWTFGKGTKLEIK

SEQ ID NO: 1249 - protein, 141 aa, Artificial Sequence
  anti-HIV_PGT144_HeavyChain
QVQLVQSGAEVKKPGSSVKVSCKASGNTFRKYDVHWVRQATGQGLEWVGWMSHEGDKTESAQRFKGRVSFTRDNSASTAYIELRGLTSDDTAIYYCTGGSKHRLRDYVLYDDYGLINQQEWNDYLEFLDVWGHGTAVTVSS

SEQ ID NO: 1250 - protein, 112 aa, Artificial Sequence
  anti-HIV_PGT145_LightChain
EVVITQSPLFLPVTPGEAASLSCKCSHSLQHSTGANYLAWYLQRPGQTPRLLIHLATHRASGVPDRFSGSGSGTDFTLKISRVESDDVGTYYCMQGLHSPWTFGQGTKVEIK

SEQ ID NO: 1251 - protein, 140 aa, Artificial Sequence
  anti-HIV_PGT145_HeavyChain
QVQLVQSGAEVKKPGSSVKVSCKASGNSFSNHDVHWVRQATGQGLEWMGWMSHEGDKTGLAQKFQGRVTITRDSGASTVYMELRGLTADDTAIYYCLTGSKHRLRDYFLYNEYGPNYEEWGDYLATLDVWGHGTAVTVSS

SEQ ID NO: 1252 - protein, 219 aa, Artificial Sequence
  anti-HIV_PGT151_LightChain
DIVMTQTPLSLSVTPGQPASISCKSSESLRQSNGKTSLYWYRQKPGQSPQLLVFEVSNRFSGVSDRFVGSGSGTDFTLRISRVEAEDVGFYYCMQSKDFPLTFGGGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1253 - protein, 240 aa, Artificial Sequence
  anti-HIV_PGT151_HeavyChain
RVQLVESGGGVVQPGKSVRLSCVVSDFPFSKYPMYWVRQAPGKGLEWVAAISGDAWHVVYSNSVQGRFLVSRDNVKNTLYLEMNSLKIEDTAVYRCARMFQESGPPRLDRWSGRNYYYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 1254 - protein, 219 aa, Artificial Sequence
  anti-HIV_PGT152_LightChain
DIVMTQTPLSLSVDPGQPASISCKSSQSLRQSNGKTSLYWYQQKPGQSPQLLIFEVSNRFSGVSDRFVGSGSGTDFTLRISRVEAEDVGFYYCMQSKDFPLTFGGGTKVDLKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1255 - protein, 240 aa, Artificial Sequence
  anti-HIV_PGT152_HeavyChain
RVQLVESGGGVVQPGKSVRLSCVVSDFPFSKYPMYWVRQAPGKGLEWVAAISADAWHVVYSGSVQGRFLVSRDNSKNILYLEMNTLKIEDTAVYRCARMFQESGPPRFDSWSGRNYYYYSGMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDK

SEQ ID NO: 1256 - protein, 103 aa, Artificial Sequence
  anti-HIV_VRC-CH30_LightChain
DIQMTQSPSSLSASLGDRVTITCQASRGIGKDLNWYQQKPGKAPKLLVSDASILEGGVPSRFSGSGFHQNFSLTISSLQPEDVATYFCQQYETFGQGTKVDIK

SEQ ID NO: 1257 - protein, 131 aa, Artificial Sequence
  anti-HIV_VRC-CH30_HeavyChain
QVQLVQSGAAVRKPGASVTVSCKFAEDDDYSPHWVNPAPEHYIHFLRQAPGQQLEWLAWMNPTNGAVNYAWQLHGRLTATRDGSMTTAFLEVRSLRSDDTAVYYCARAQKRGRSEWAYAHWGQGTPVAVSS

SEQ ID NO: 1258 - protein, 103 aa, Artificial Sequence
  anti-HIV_VRC-CH31_LightChain
DIQMTQSPSSLSASLGDRVTITCQASRGIGKDLNWYQQKAGKAPKLLVSDASTLEGGVPSRFSGSGFHQNFSLTISSLQAEDVATYFCQQYETFGQGTKVDIK

SEQ ID NO: 1259 - protein, 131 aa, Artificial Sequence
  anti-HIV_VRC-CH31_HeavyChain
QVQLVQSGAAVRKPGASVTVSCKFAEDDDYSPYWVNPAPEHFIHFLRQAPGQQLEWLAWMNPTNGAVNYAWYLNGRVTATRDRSMTTAFLEVKSLRSDDTAVYYCARAQKRGRSEWAYAHWGQGTPVVVSS

SEQ ID NO: 1260 - protein, 103 aa, Artificial Sequence
  anti-HIV_VRC-CH32_LightChain
DIQMTQSPSSLSASLGDRVTITCQASRGIGKDLNWYQQKPGRAPKLLVSDASILEGGVPTRFSGSGFHQNFSLTISSLQAEDVATYFCQQYETFGQGTKVDIK

SEQ ID NO: 1261 - protein, 131 aa, Artificial Sequence
  anti-HIV_VRC-CH32_HeavyChain
QVQLVQSGAAVRKPGASVTVSCKFAEDDDFSPHWVNPAPEHYIHFLRQAPGQQLEWLAWMKPTNGAVNYAWQLQGRVTVTRDRSQTTAFLEVKNLRSDDTAVYYCARAQKRGRSEWAYAHWGQGTPVVISA

SEQ ID NO: 1262 - protein, 103 aa, Artificial Sequence
  anti-HIV_VRC-CH33_LightChain
DIQMTQSPSSLSASLGDRVTITCQASRGIGKDLNWYQQKRGRAPRLLVSDASVLEGGVPSRFSGSGFHQNFSLTISTLQPEDVATYFCQQYETFGQGTKVDIK

SEQ ID NO: 1263 - protein, 131 aa, Artificial Sequence
  anti-HIV_VRC-CH33_HeavyChain
QVQLVQSGAAVRKPGASISVSCKFADADDYSPHWMNPAPEHYIHFLRQAPGQQLEWLAWMNPTNGAVNYAWYLNGRVTATRDRSMTTAFLEVRSLRSDDTAVYYCARAQKRARSEWAYAHWGQGTPVVVSS

SEQ ID NO: 1264 - protein, 103 aa, Artificial Sequence
  anti-HIV_VRC-CH34_LightChain
DIQMTQSPSSLSASLGDRVTITCQASRGIGKDLNWYQQKAGKAPKLLVSDASILEGGVPSRFSGSGFHQNFSLTISSLQPEDVATYFCQQYETFGQGTKVDIK

SEQ ID NO: 1265 - protein, 131 aa, Artificial Sequence
  anti-HIV_VRC-CH34_HeavyChain
QVQLVQSGAAVRKPGASVTVSCKFAEDDDWSPHWVNPAPEHYIHFLRQAPGQQLEWLAWMNPTNGAVNYAWQLNGRLTATRDTSMTTAFLEVKSLRSDDTAVYYCARAQKRGRSEWAYAHWGQGTPVVVSS

SEQ ID NO: 1266 - protein, 102 aa, Artificial Sequence
  anti-HIV_VRC-PG04_LightChain
EIVLTQSPGTLSLSPGETASLSCTAASYGHMTWYQKKPGQPPKLLIFATSKRASGIPDRFSGSQFGKQYTLTITRMEPEDFARYYCQQLEFFGQGTRLEIRR

SEQ ID NO: 1267 - protein, 125 aa, Artificial Sequence
  anti-HIV_VRC-PG04_HeavyChain
QVQLVQSGSGVKKPGASVRVSCWTSEDIFERTELIHWVRQAPGQGLEWIGWVKTVTGAVNFGSPDFRQRVSLTRDRDLFTAHMDIRGLTQGDTATYFCARQKFYTGGQGWYFDLWGRGTLIVVSS

SEQ ID NO: 1268 - protein, 101 aa, Artificial Sequence
  anti-HIV_VRC-PG04b_LightChain
EIVLTQSPGTLSLSPGETASLSCTAASYGHMTWYQKKPGQPPKLLIFATSKRASGIPDRFSGSQFGKQYTLTITRMEPEDFAGYYCQQVEFFGQGTRLEIR

SEQ ID NO: 1269 - protein, 125 aa, Artificial Sequence
  anti-HIV_VRC-PG04b_HeavyChain
QVQLVQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 1270 - protein, 204 aa, Artificial Sequence
  anti-HIV_VRC-PG20_LightChain
QSALTQPPSVSGSPGQSITLSCTGASTSVAWYQQYADKAPRLIVFDGNKRPSDISSRFSGSQSGGTASLTISGLQSEDEAYYHCNAFEFFGGGTKLTVLSQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPTEC

SEQ ID NO: 1271 - protein, 227 aa, Artificial Sequence
  anti-HIV_VRC-PG20_HeavyChain
EVHLMQSGTEMKKPGASVRVTCQTSGYTFSDYFIHWLRQVPGRGFEWMGWMNPQWGQVNYARTFQGRVTMTRDVYREVAYLDLRSLTFADTAVYFCARRMRSQDREWDFQHWGQGTRIIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDK

SEQ ID NO: 1272 - protein, 353 aa, Artificial Sequence [sequence omitted]

SEQ ID NO: 1273 - protein, 104 aa, Artificial Sequence
  anti-HIV_VRC02_LightChain
EIVLTQSPGTLSLSPGETAIISCRTSQYGSLAWYQQRPGQAPRLVIYSGSTRAAGIPDRFSGSRWGPDYNLTIRNLESGDFGLYYCQQYEFFGQGTKVQVDIKR

SEQ ID NO: 1274 - protein, 121 aa, Artificial Sequence
  anti-HIV_VRC02_HeavyChain
QVQLVQSGGQMKKPGESMRISCQASGYEFIDCTLNWVRLAPGRRPEWMGWLKPRGGAVNYARPLQGRVTMTRDVYSDTAFLELRSLTADDTAVYYCTRGKNCDYNWDFEHWGRGTPVTVSS

SEQ ID NO: 1275 - protein, 103 aa, Artificial Sequence
  anti-HIV_VRC03_LightChain
EIVLTQSPGILSLSPGETATLFCKASQGGNAMTWYQKRRGQVPRLLIYDTSRRASGVPDRFVGSGSGTDFFLTINKLDREDFAVYYCQQFEFFGLGSELEVHR

SEQ ID NO: 1276 - protein, 130 aa, Artificial Sequence
  anti-HIV_VRC03_HeavyChain
QVQLVQSGAVIKTPGSSVKISCRASGYNFRDYSIHWVRLIPDKGFEWIGWIKPLWGAVSYARQLQGRVSMTRQLSQDPDDPDWGVAYMEFSGLTPADTAEYFCVRRGSCDYCGDFPWQYWGQGTVVVVSS

SEQ ID NO: 1277 - protein, 210 aa, Artificial Sequence
  anti-HIV_VRC23_LightChain
EIVMTQSPVTVSVSRGGTATLSCRASQGVGSDVAWYQHKPGQTPRLLIYGASTRASGVPERFSGSGFHVDFTLSISGLQPEDVAIYYCQQYETFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1278 - protein, 224 aa, Artificial Sequence
  anti-HIV_VRC23_HeavyChain
EVQFVQSGAEVKKPGASVRVSCEASGYSFTDYVLQWIRQAPGQRPEWMGWIKPERGAVSYAPQFQGRLTLTRDLYTETAYMHFKNLRSDDTAIYYCARGVRRDASWWLQFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 1279 - protein, 359 aa, Artificial Sequence
  anti-HIV_VRC23_G-Chain
VWRDADTTLFCASDAKAYETEKHNVWATHACVPTDPNPQEIHLDNVTEKFNMWKNNMVEQMHTDIISLWDQSLKPCVKLTGGSAITQACPKVSFEPIPIHYCTPAGFAILKCKDEGFNGTGLCKNVSTVQCTHGIKPVVSTQLLLNGSLAEKNITIRSENITNNAKIIIVQLVQPVTIKCIRPNNGGSGSGGDIRQAHCNVTRSRWNKTLQEVAEKLRTYFGNKTIIFANSSGGDLEITTHSFNCGGEFFYCNTSGLFNSTWYVNSTWNDTDSTQESNDTITLPCRIKQIINMWQRAGQAMYAPPIPGVIKCESNITGLLLTRDGGKDNNVNETFRPGGGDMRDNWRSELYKYKVVEIE

SEQ ID NO: 1280 - protein, 216 aa, Artificial Sequence
  anti-HIV_5CCK_LightChain
QSALTQPASVSASPGQSITISCSGTRSDVGGYDFVSWYQQHPGKVPKLIIYEVTKRPSGIPQRFSGSKSGNTASLTISGLQADDEADYYCCSYANYDKLILGGGTKLTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPTECS

SEQ ID NO: 1281 - protein, 232 aa, Artificial Sequence
  anti-HIV_5CCK_HeavyChain
QVQLVQSGAEMKDPGASVKVSCRASGYKFTDYYMHWVRQAPGQGLEWVGWVNTNGGFTKYGAKFQGRVTVTRDTSTNTVFLELSRLTFGDTAMYFCARPMRPVSHGIDYSGLFVFQFWGRGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 1282 - protein, 216 aa, Artificial Sequence; identical to SEQ ID NO: 1158
  anti-HIV_5AWN_LightChain

SEQ ID NO: 1283 - protein, 232 aa, Artificial Sequence
  anti-HIV_5AWN_HeavyChain
QVQLMQSGAQLRDPGDSLKISCKASGYNFIDYHIHWVRLAPGRGLEWMGWIDPVGGITKYAGQFQGRLSLTRDTSTNTLFLELSRLTAGDTAVYFCARSMRPVDHGIDYSGLFVFHFWGRGSDVLVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCD

SEQ ID NO: 1284 - protein, 215 aa, Artificial Sequence
  anti-HIV_3QEG_LightChain
EIVMMQSPGTLSLSPGERATLSCRASQSVSSSYLAWYQQKPGQAPRLLIYGASSRATGIPDRFSGSGSGTDFTLTISRLEPEDFAVYYCQQYGSSPETFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1285 - protein, 239 aa, Artificial Sequence
  anti-HIV_3QEG_HeavyChain
QVQLVQSGAEVKKPGSSVKVSCRASRGTFSSYGITWVRQAPGQGLEWMGGIIPIFDVTNYAQNFQGRVAITTDAEMSTAYMELRSLKSEDSAVYYCASDSRDFSYYEPGTSYSHYYNIMDVWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTH

SEQ ID NO: 1286 - protein, 230 aa, Artificial Sequence
  anti-HIV_1N0X_K-Chain
QVQLVQSGAEVKKPGASVKVSCQASGYRFSNFVIHWVRQAPGQRFEWMGWINPYNGNKEFSAKFQDRVTFTADTSANTAYMELRSLRSADTAVYYCARVGPYSWDDSPQDNYYMDVWGKGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 1287 - protein, 215 aa, Artificial Sequence
  anti-HIV_1N0X_M-Chain
EIVLTQSPGTLSLSPGERATFSCRSSHSIRSRRVAWYQHKPGQAPRLVIHGVSNRASGISDRFSGSGSGTDFTLTITRVEPEDFALYYCQVYGASSYTFGQGTKLERKRTVAAPSVFIFPPSDEQLKSGTASVVCLLNNFYPREAKVQWKVDNALQSGNSQESVTEQDSKDSTYSLSSTLTLSKADYEKHKVYACEVTHQGLRSPVTKSFNRGEC

SEQ ID NO: 1288 - protein, 218 aa, Artificial Sequence
  anti-HIV_3QEH_HeavyChain
DIVMTQSPLSLPVTPGEAASISCRSSQSLLHTNGFQYLDWYLQKPGQSPQLLIYLGSNRATGVPHRFSGSGSGTEFTLKISRVEAEDVGVYYCMQAKESPTFGQGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1289 - protein, 232 aa, Artificial Sequence
  anti-HIV_3QEH_G-Chain
QVQLVQSGAEVRKPGASVTVSCKTSGYTFVNFYIVWVRQAPGQGLEWMGVINPFRGDTYFAQKFKGRVTLTRDTSTSTVFMELSSLRSDDTAIYYCARDLEMRDGNNHGSHLEFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTH

SEQ ID NO: 1290 - protein, 226 aa, Artificial Sequence
  anti-HIV_2B1H_HeavyChain
EIQLEQSGAEVKKSGESLKISCQTSGYSFSDYWIGWVRQMPGKGLEWMGIFYPGDSDSRYSPSFEGQVTMSADRSTNTAHLQWSSLKPSDTALYYCARLGGDYEDSGADAFDFWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 1291 - protein, 215 aa, Artificial Sequence
  anti-HIV_2B1H_LightChain
QSVLTQPPSASGTPGQRISISCSGTSSNVENNYVYWYQHLPGTAPKLLIYRNDHRSSGIPDRFSASKSGTSASLAISGLRPEDEGDYYCAAWDDSRGGPDWVFGGGTKLTVLAQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPT

SEQ ID NO: 1292 - protein, 216 aa, Artificial Sequence
  anti-HIV_3TNM_B-Chain
QSVLTQPPSASGSPGQSVTISCTGTSSDVGGYNYVSWYQHHPGKAPKLIISEVNNRPSGVPDRFSGSKSGNTASLTVSGLQAEDEAEYYCSSYTDIHNFVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAPTECS

SEQ ID NO: 1293 - protein, 231 aa, Artificial Sequence
  anti-HIV_3TNM_A-Chain
QVQLQESGPGLVKPSQTLSLSCTVSGGSSSSGAHYWSWIRQYPGKGLEWIGYIHYSGNTYYNPSLKSRITISQHTSENQFSLKLNSVTVADTAVYYCARGTRLRTLRNAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTHT

SEQ ID NO: 1294 - protein, 230 aa, Artificial Sequence
  anti-HIV_3UJJ_HeavyChain
EVQLVQSGAEVKKPGESLKISCKASGYSFSSYWIAWVRQMPGKGLEWMGFIYPADSDTRYSPSFQGQGTISADKSISTAYLQWSSLKASDTAMYYCAILGFWGANRGGGGMDVWGQGTTVIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSCDKT

SEQ ID NO: 1295 - protein, 213 aa, Artificial Sequence
  anti-HIV_3UJJ_LightChain
SYELTQPPSVSVSPGQTARITCSGDALPEKYAYWYQQKSGQAPVLIIYEDSKRPSGIPERFSGSRSGTMATLTISGAQVDDEADYYCYSTNSGGTFFVFGTGTKVTVLGQPKANPTVTLFPPSSEELQANKATLVCLISDFYPGAVTVAWKADSSPVKAGVETTTPSKQSNNKYAASSYLSLTPEQWKSHRSYSCQVTHEGSTVEKTVAPTEC

SEQ ID NO: 1296 - protein, 223 aa, Artificial Sequence
  anti-HIV_3UJI_HeavyChain
QVQLVQSAAEVKKPGEALKISCKGSGYSFSNYWIAWVRQMPGKGLEWMGIVYPDDSDSSYNSSFQGQITFSADKSISTAYLHWTSLQASDTAMYYCARLGFEGDYSGSFFDYWGQGTLLIVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 1297 - protein, 209 aa, Artificial Sequence
  anti-HIV_3UJI_LightChain
SYELTQPPSVSVSPGQTASITCSGDILGDKYVSWYQQKSGQSPLLVIYEDTKRPSGIPDRFSGSKSGNTATLTISGTQAMDEADYYCQAWDSTLGVVFGGGTKVTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAP

SEQ ID NO: 1298 - protein, 222 aa, Artificial Sequence
  anti-HIV_2QSC_HeavyChain
QVQLVQSGGGLVQPGGSLRLSCAAFGFNFSSYVMHWVRQAPGQGLEYLSAISSDGETTYHANSVKGRFTSSRDNSKNTLFLQMGSLRTEDVAVYYCARDRYYETSGSNAFDVWGQGTMVVVSSASTKGPSVFPLAPCSRSTSESTAALGCLVKDYFPEPVTVSWNSGALTSGVHTFPAVLQSSGLYSLSSVVTVPSSNFGTQTYTCNVDHKPSNTKVDKTVE

SEQ ID NO: 1299 - protein, 215 aa, Artificial Sequence
  anti-HIV_2QSC_LightChain
NSVLTQSPSSLSASVGDRVTITCQASQDISNYLNWYQHKPGKAPKLLIYTASNLETGVPSRFSGGGSGTHFSFTITSLQPEDAATYFCQQYDNLGDLSFGGGTKVEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1300 - protein, 230 aa, Artificial Sequence
  anti-HIV_3MLZ_HeavyChain
QVQLQESGPGLVKPSETLSLTCTVSGGSISGFHWSWIRQPPGKGLEYIGYIYYSGSTSYNPSLKSRVSMSVDTSRNQFSLELSSVTAADTAVYYCARDFGEYHYDGRGFQCEGFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 1301 - protein, 214 aa, Artificial Sequence
  anti-HIV_3MLZ_LightChain
QSVLTQPPSVSAAPGQKVTISCSGSSSNIGNNMVSWYQQHPGTAPKLLIYENSKRPSGIPDRFSGSRSGTSATLGIIGLQTGDEAEYYCATWDGSLRTVFGGGTKLTVLSQPKAAPSVTLFPPSSEELQANKATLVCLISDFYPGAVTVAWKADSSPVRAGVETTTPSKQSNNKYAASSYLSLTPEQWKSHRSYSCQVTHEGSTVEKTVAPTEC

SEQ ID NO: 1302 - protein, 228 aa, Artificial Sequence
  anti-HIV_3MLX_I-Chain
QVQLQESGPGLVKPSETLSLTCTVSGGSISGFHWSWIRQPPGKGLEYIGYIYYSGSTSYNPSLKSRVSMSVDTSRNQFSLELSSVTAADTAVYYCARDFGEYHYDGRGFQCEGFDLWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 1303 - protein, 211 aa, Artificial Sequence
  anti-HIV_3MLX_M-Chain
SVLTQPPSVSAAPGQKVTISCSGSSSNIGNNMVSWYQQHPGTAPKLLIYENSKRPSGIPDRFSGSRSGTSATLGIIGLQTGDEAEYYCATWDGSLRTVFGGGTKLTVLSQPKAAPSVTLFPPSSEELQANKATLVCLISDFYPGAVTVAWKADSSPVRAGVETTTPSKQSNNKYAASSYLSLTPEQWKSHRSYSCQVTHEGSTVEKTVAPT

SEQ ID NO: 1304 - protein, 228 aa, Artificial Sequence
  anti-HIV_3MLW_I-Chain
QVQLVQSGAEVKKAGESLEISCKGSGYTFTDHWIAWVRQVPGKGLEWMGMIYPGDSDTRYSPSLQGRVTMSADKTLSTAYLQWSRLEASDTAMYYCARLHYSDRSGSYFNDVFHMWGQGTTVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 1305 - protein, 215 aa, Artificial Sequence
  anti-HIV_3MLW_M-Chain
QSVLTQPPSASGTPGQRVTISCSGNSSNIENNYVYWYQQLPGSTPKLLIFRDDQRPSGVPDRFSGSKSGTSASLAISGLRSEDEADYYCASWDDSRGGPDYVFGTGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAPT

SEQ ID NO: 1306 - protein, 226 aa, Artificial Sequence
  anti-HIV_3MLV_N-Chain
EVQLVESGGEVKQPGQSLKISCKSSGYNFLDSWIGWVRQIPGKGLEWIGIIYPDDSDAHYSPSFEGQVTMSVDKSISTAYLQWTTLQASDTGKYFCTRLYLFEGAQSSNAFDLWGQGTMILVSSGTTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKS

SEQ ID NO: 1307 - protein, 219 aa, Artificial Sequence
  anti-HIV_3MLV_M-Chain
SYLLTQPPSVSVSPGQTASISCSGDKLDDKYVSWYYQRPGQSPVLLMYQDFKRPSGIPERLSGSKSGKTATLTISGTQSLDEGDYYCQAWDASTGVSGGGTKLTVLFGEGTRLTVLAQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPT

SEQ ID NO: 1308 - protein, 218 aa, Artificial Sequence
  anti-HIV_3MLU_LightChain
YLLTQPPSVSVSPGQTASISCSGDKLDDKYVSWYYQRPGQSPVLLMYQDFKRPSGIPERLSGSKSGKTATLTISGTQSLDEGDYYCQAWDASTGVSGGGTKLTVLFGEGTRLTVLAQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPT

SEQ ID NO: 1309 - protein, 219 aa, Artificial Sequence
  anti-HIV_3MLT_G-Chain
SYDLTQPPSVSVSPGQTASISCSGDKLDDKYVSWYYQRPGQSPVLLMYQDFKRPSGIPERLSGSKSGKTATLTISGTQSLDEGDYYCQAWDASTGVSGGGTKLTVLFGDGTRLTVLGQPKAAPSVTLFPPSSEELQANKATLVCLISDFYPGAVTVAWKADSSPVKAGVETTTPSKQSNNKYAASSYLSLTPEQWKSHKSYSCQVTHEGSTVEKTVAPT

SEQ ID NO: 1310 - protein, 222 aa, Artificial Sequence
  anti-HIV_3GO1_HeavyChain
EVQLQESGPGLVKPSETLSLTCTVSGGPINNAYWTWIRQPPGKGLEYLGYVYHTGVTNYNPSLKSRLTITIDTSRKQLSLSLKFVTAADSAVYYCAREWAEDGDFGNAFHVWGQGTMVAVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEP

SEQ ID NO: 1311 - protein, 209 aa, Artificial Sequence
  anti-HIV_3GO1_LightChain
SYVLTQPPSVSVSPGQTARITCSAEALSNQYAYWYRQRPGQAPLLIIYKDTKRPSGIPERFSGSTSGTTVTLTISGVQAEDEADYYCQSADSSGDYVFGGGTKVTVLGQPKANPTVTLFPPSSEELQANKATLVCLISDFYPGAVTVAWKADGSPVKAGVETTKPSKQSNNKYAASSYLSLTPEQWKSHRSYSCQVTHEGSTVEKTVAP

SEQ ID NO: 1312 - protein, 230 aa, Artificial Sequence
  anti-HIV_4XCY_J-Chain
QVQLVQSGAEVKRPGSSVTVSCKASGGSFSTYALSWVRQAPGRGLEWMGGVIPLLTITNYAPRFQGRITITADRSTSTAYLELNSLRPEDTAVYYCAREGTTGWGWLGKPIGAFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPKSC

SEQ ID NO: 1313 - protein, 215 aa, Artificial Sequence
  anti-HIV_4XCY_K-Chain
EIVLTQSPGTQSLSPGERATLSCRASQSVGNNKLAWYQQRPGQAPRLLIYGASSRPSGVADRFSGSGSGTDFTLTISRLEPEDFAVYYCQQYGQSLSTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 1314 - protein, 210 aa, Artificial Sequence
  anti-HIV_4YBL_C-Chain
VLTQPPSASGSPGQSVTISCTGTSSDVGGYNYVSWYQHHPGKAPKLIISEVNNRPSGVPDRFSGSKSGNTASLTVSGLQAEDEAEYYCSSYTDIHNFVFGGGTKLTVLGQPKAAPSVTLFPPSSEELQANKATLVCLISDFYPGAVTVAWKADSSPVKAGVETTTPSKQSNNKYAASSYLSLTPEQWKSHRSYSCQVTHEGSTVEKTVAP

SEQ ID NO: 1315 - protein, 224 aa, Artificial Sequence
  anti-HIV_4YBL_B-Chain
QVQLQESGPGLVKPSQTLSLSCTVSGGSSSSGAHYWSWIRQYPGKGLEWIGYIHYSGNTYYNPSLKSRITISQHTSENQFSLKLNSVTVADTAVYYCARGTRLRTLRNAFDIWGQGTMVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPK

SEQ ID NO: 1316 - protein, 210 aa, Artificial Sequence
  anti-HIV_4R4N_X-Chain
DIQMTQSPSFVSASVGDRVTITCRASQGISSYLAWYQQKPGKAPKLVIYAASTLQSGVPSRFSGSGSGTEFTLTISSLQPEDFATYYCQHLIGLRSFGQGTKLEIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 1317 - protein, 220 aa, Artificial Sequence
  anti-HIV_4R4B_F-Chain
QVQLQQWGAGLLKPSETLSLTCGVYGESLSGHYWSWVRQPPGKRLEWIGEIKHNGSPNYHPSLKSRVTISLDMSKNQFSLNLTSVTAADTAVYFCARRSNWPYLPFDPWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 1318 - protein, 250 aa, Artificial Sequence
  anti-HIV_3JUY_D-Chain
QVQLVQSGAEVKKPGASVKVSCQASGYRFSHFTVHWVRQAPGQRFEWMGWINPYNGNKEFSAKFQDRVTFTADTSANTAYMELRSLRSADTAVYYCARVGEWGWDDSPYDNYYMDVWGKGTTVIVSSGGGGSGGGGSGGGGSEIVLTQAPGTLSLSPGERATFSCRSSHSIRSRRVAWYQHKPGQAPRLVIHGVSNRASGISDRFSGSGSGTDFTLTITRVEPEDFALYYCQVYGASSYTFGQGTKLERK

SEQ ID NO: 1319 - protein, 123 aa, Artificial Sequence
  anti-HIV_4KG5_HeavyChain
QLVQSGPEAKRPGSSVKVSCKASRDTFNNYVLNWVRQAPGQGLEWMGGIGPIIETADYAEKFRGRLSITADESTTTAYMELSSLTSDDTAVYYCARSPYSSLTDTYYYYMDLWGKGTTVTVSS

SEQ ID NO: 1320 - protein, 112 aa, Artificial Sequence
  anti-HIV_4KG5_LightChain
LTQSPDSLAVSLGERATINCKSSQSILDSSNNRNYLTWYQQKPGQPPKLLIYWASTRESGVPDRFSGSGSSTDFTLTISSLQAEDVAVYYCQQYFSTPGITFGQGTRLEIKR

SEQ ID NO: 1321 - protein, 103 aa, Artificial Sequence
  anti-HIV-1_LightChain
EIVLTQSPATLSLSPGERATLSCRASQSVYTKLAWYQQKPGQPPRLLIYDASNRAAGIPARFSGSGSGTEFTLTIKRMEREDFAVYYCQILEFFGQGTTIDMN

SEQ ID NO: 1322 - protein, 104 aa, Artificial Sequence
  anti-HIV-1_LightChain
DIQMTQSPSSVSASVGDRVTITCRASQGILSSQLAWHQQRRGQPPRLLIYGGSNRAPGIPERFTGSGSGTDFVLTIKRLQRDDFAVYYCQILEFFGRGTRVEMN

SEQ ID NO: 1323 - protein, 104 aa, Artificial Sequence
  anti-HIV-1_LightChain
GLLLTQSPGPVSFFPGERATVSCRASHSVNSAAINWYQQKRGQPPRLIIVDGSTRATAVPERFSATGSGTEFTLVISRLEPEDFAVYFCQHLQFFGLGTKVDIK

SEQ ID NO: 1324 - protein, 104 aa, Artificial Sequence
  anti-HIV-1_LightChain
AFVMTQSPGTLALSPGERATLSCRTSQEILSNQLAWHQQRRGQPPRLLIYGGSNRAPGIPERFTGSGSGTDFVLTINRLERDDFAVYYCQILEFFGRGTRVEMN

SEQ ID NO: 1325 - protein, 104 aa, Artificial Sequence
  anti-HIV-1_LightChain
GIVLTQSPDTLSLSPGDRATLSCKTSQSIASEHLAWYQQRPGQPPRLLIFGASNRASGIPTRFSGSGSGADFTLSITRLEPEDFAVYYCQFSEFFGRGARVEVK

SEQ ID NO: 1326 - protein, 104 aa, Artificial Sequence
  anti-HIV-1_LightChain
QFVMTQSPATLSSSPGGTATLSCRTSHSILNSQLAWHQQRRGQPLRLLIYGASNRAPGIPERFSASGSGTEFVLTIKRMEREDFAVYYCQILEFFGQGTTIDMN

SEQ ID NO: 1327 - protein, 118 aa, Artificial Sequence
  anti-HIV-1_HeavyChain
RVHLVQSGTQVKKPGASVKVSCETSGFKFLDSLIHWVRQAPGQGLYWMGWIKPYRGSVNYDGYFRGRVSMTRDIYTDTAYLELSGLRSDDTAIYYCAFGAGDGWDLVWGQGTLVIVSS

SEQ ID NO: 1328 - protein, 118 aa, Artificial Sequence
  anti-HIV-1_HeavyChain
RVHLVQSGTQVKKPGASVKVSCETSGFKFLDSLIHWVRQAPGQGLYWMGWIKPFRGSVNYDGYFRGRVSMTRDIYTDTAYMELSGLRSDDTAIYYCAFGAGDGWDLVWGQGTLVIVSS

SEQ ID NO: 1329 - protein, 118 aa, Artificial Sequence
  anti-HIV-1_HeavyChain
QVHLVQSGTQVKKPGASVRVSCETSGFKFLDSIIHWFRQAPGEGLFWMGWIKPYTGSVNYVRRYQGRVSMTRDVYSDTAYMDLSGLNSDDTAVYFCTYGAGDGWNLVWGQGTLVIVSA

SEQ ID NO: 1330 - protein, 121 aa, Artificial Sequence
  anti-HIV-1_HeavyChain
QVRLVQSGNQVRKPGASVRISCEASGYKFIDHFIHWVRQVPGHGLEWLGWINPRGGGVNYSRGFQGKLSMTMTRDNFEETAYLDLSRLNPGDTAVYYCARGFAGYEWSFLWGQGTLVIVSS

SEQ ID NO: 1331 - protein, 119 aa, Artificial Sequence
  anti-HIV-1_HeavyChain
QVSLVQSGNQLKKPGASVRISCETSGYNFLNHFIHWVRQVPGHGLEWLGWINPRGGGVNYSRNFQGKVSLTRNIDMETVYLDVRGLTPGDTAVYYCARGFGGSDWNFVWGQGTRITVSA

SEQ ID NO: 1332 - protein, 119 aa, Artificial Sequence
  anti-HIV-1_HeavyChain
RINLHQSGSQVKRSGASVRISCETSGFKFMDSHLHWVRQVAGQGFEWMGWIFTSGGGVNYARQFQGRLTLTRDVFTDTVFMDLSGVNVGDTGVYYCVKGTGGNEWGFSWGQGTVVVVSP

SEQ ID NO: 1333 - protein, 119 aa, Artificial Sequence
  anti-HIV-1_HeavyChain
RINLDQSGSQVKKSGASVRISCETSGFKFMDSHLHWVRQVAGQPFEWMGWIFTSGGGVNYARQFQGRLTLTRDVFSETVFMDLSGLNAGDTGVYFCVKGTGGNEWGFVWGQGTVVVVSP

SEQ ID NO: 1334 - protein, 119 aa, Artificial Sequence
  anti-HIV-1_HeavyChain
RIELHQSGSQVKKSGASVRISCETSGFKFMDSHLHWVRQVAGQRFEWMGWIFTSGGGVNYARQFQGRLRLTRDVFSESVFMDLSGLNSGDTGVYYCVKGTGGNEWGFVWGQGSLVVVSP

SEQ ID NO: 1335 - protein, 124 aa, Artificial Sequence
  anti-HIV-1_HeavyChain
QALVQSGSQMKKPGDSVRLSCQTSDSAITKYFIHWIRQAPGKGLEWIAWISPYGGRVNYGWQVRDRATLTRNIHMETVYMDLRGLRPDDTATYYCAMRDYCRDDNCNRWDLGHWGQGSLIVVSA

SEQ ID NO: 1336 - protein, 119 aa, Artificial Sequence
  anti-HIV-1_HeavyChain
QVTLVQSGNQLKRPGASVRISCETSGYNFMDHFIHWVRQVPGHGPEWLGWVNPRGGGVNYSRKFQGRFSMTRDVYMETAYLDVTGLSPADTAVYYCARGFGGSDWSFLWGQGTLIIVSS

SEQ ID NO: 1337 - protein, 108 aa, Artificial Sequence
  anti-HIV-1_LightChain
EIVLTQSPGTLSLSAGERASLSCRASQTLNSNFFAWYHQKPGQAPRLLIYGASNRATGIPDRFSGSGSGSDFTLTISRLEPEDFGKYYCEQYDVSPRTFGQGTKVEIK

SEQ ID NO: 1338 - protein, 108 aa, Artificial Sequence
  anti-HIV-1_LightChain
EVVLTQSPGTLSLSPGERATLSCRASQSINSNFFAWYHQKPGQAPRLLIYGASSRATGIPDRISGTGSGADFTLTITGLEPEDFGLYYCQQYDFSPRTFGQGTRVEIK

SEQ ID NO: 1339 - protein, 108 aa, Artificial Sequence
  anti-HIV-1_LightChain
EVVLTQSPGTLSLSPGERATLSCRASQTINSNFFAWYHQKPGQAPRLLIYGASSRATGIPDRISGSGSGTDFTLTITGLEPEDFGLYYCQQFDFSPRTFGQGTRVEIK

SEQ ID NO: 1340 - protein, 108 aa, Artificial Sequence
  anti-HIV-1_LightChain
EIVLTQSPGTLSLAPGERATLSCRASQSISTTYLAWYQQKPGQAPRLLIYETSSRASDIPDRFSGSGSGTDFTLTISRLEPEDFAVYYCHQYDRSPRTFGQGTKVEIK

SEQ ID NO: 1341 - protein, 112 aa, Artificial Sequence
  anti-HIV-1_LightChain
DIVMTQSPASLSVTPGETASISCKCSRSLREEVGYNYLDWYLQRPGKSPQLLIYVGSFRAPGVSERFRGSGEHKDFTLKIARVEPGDAGIYYCMQGIDTPRTFGQGTTLEIN

SEQ ID NO: 1342 - protein, 107 aa, Artificial Sequence
  anti-HIV-1_LightChain
DIQMTQSPSSLSASVGDRVTITCRASQAFRNDLGWYQHKPGKAPERLIYATSTLESGVPSRFSGSGSGTNFTLTISSLQAEDFATYYCLQYNTFPRTFGQGTKVEIK

SEQ ID NO: 1343 - protein, 111 aa, Artificial Sequence
  anti-HIV-1_LightChain
NFMLTQPHSVSESPGKTVTISCARTRGGIDSAYVHWYQQRPGSVPTTVIFEDNRRPPGVPDRFSGSIDTSSNTASLTISGLKTEDEADYYCQSYDDTYFWVFGGGTKLTVL

SEQ ID NO: 1344 - protein, 111 aa, Artificial Sequence
  anti-HIV-1_LightChain
NFMLTQPHSVSESPGKTVTISCARTRGTIDSAYVHWYQQRPGAVPTTVIFEDDRRPSGVPDRFSGSIDSSSNSASLTISGLKTEDEADYYCQSYDSNYYWVFGGGTKLTVL

SEQ ID NO: 1345 - protein, 132 aa, Artificial Sequence
  anti-HIV-1_HeavyChain
QVQLQQSGPALVKPSETLSLTCSVSSGRVSSYYWSWIRQSPGKGLEWIGYIHYDPDTNTNYRTHYHPSLRGRVVISVDSSKSQVSLKVRSVTAADSALYYCARHRYDPWSKGYDIRSPFDFWGQGTLVTVSS

SEQ ID NO: 1346 - protein, 132 aa, Artificial Sequence
  anti-HIV-1_HeavyChain
QVHLQQSGPGLVKPSETLSLTCTVSGGRVSSYYWSWIRQSPGKGLEWIGYIHYDPDTSTNYRTHYHPSLRGRVVISVDTSKNQVSLTVRSVTAADSALYYCARHRYDVWSNGYDIRSPYDFWGRGTLVTVSS

SEQ ID NO: 1347 - protein, 132 aa, Artificial Sequence
  anti-HIV-1_HeavyChain
QVHLEQSGPALVKPSETLSLTCTVSGGRVSSYYWSWIRQSPGKGLEWIGYIHYDPDTSTNYRTHYHPSLRGRVVISVDSSKNQVSLKVRSVTAADSALYYCARHRYDVWSKGYDIRSPFDFWGRGTLVTVSS

SEQ ID NO: 1348 - protein, 130 aa, Artificial Sequence
  anti-HIV-1_HeavyChain
QVVFQKPGPGVVKPSETLSLTCTVSGGRVRSYYWSWIRLPPGQGLEWIGYIHYDETTEYKRSYNPSLKSRITISMDTSKNQVSLKLSSVTAADAAVYYCARHRYDRWSDSYDIRSPFDIWGQGTVVTVSA

SEQ ID NO: 1349 - protein, 132 aa, Artificial Sequence
  anti-HIV-1_HeavyChain
QVQLQQWGAGLLKPSETLSLTCAIYGSSFSGHYWMWIRQSPAKTLEWIAEINHTGGTRYNPSLASRVRVFSDTSKNQFSLNMTSLTAADTGIYYCVRGHLSRDRLGQYAFWSGALIDYLDPWGQGTLVTVSS

SEQ ID NO: 1350 - protein, 129 aa, Artificial Sequence
  anti-HIV-1_HeavyChain
QVQLHQWGAGLLKPSETLSLTCAVYGSFTGFQWTWVRQTPGKGLEWIGEINHSGLLVTGKTDYNPSLESRVTISVDTSKNQFSLKLTSVTAADTGVYYCARAGGMSDWAYPYYYGMDVWGQGTMVTVSS

SEQ ID NO: 1351 - protein, 119 aa, Artificial Sequence
  anti-HIV-1_HeavyChain
QVQLVESGGGVVQPGRSLTLSCATSGFDFSSYGFHWVRQAPGKGLQWVSIISHDGSIKNYGDSMKGRFSVSRDNAKDILYLQMNSLRPDDTALYHCVRGDGENGGTDYWGLGTLVTVSA

SEQ ID NO: 1352 - protein, 119 aa, Artificial Sequence
  anti-HIV-1_HeavyChain
QVDLVESGGGVVQPGKSLKLSCTASGFTFTSYGMHWVRQIPGKGLEWVAIISHDGTIKNYGDSVKGRFTISRDNAMNILYLQMNNLRGDDTALYYCVRGDGENGGTDYWGQGTVVTVSS

SEQ ID NO: 1353 - protein, 123 aa, Artificial Sequence
  anti-HIV_V3_HeavyChain
EVQLVQSGAEVKKPGESLKISCQGFGYTFSTYWIGWVRQMPGKGLEWLGIIYPEDSETIYSPSFQGQATISADKSLSTAYLQWSGLRASDSAIYYCARLGYCGSTSCSFFDFWGRGTLVTVSS

SEQ ID NO: 1354 - protein, 123 aa, Artificial Sequence
  anti-HIV_V3_HeavyChain
EVQLVQSGAEVTKPGESLKISCKGSGYSFSTHWIAWVRQMPGRGLEWMGFIYPDDSDTRYSPSLQGHVIISADKSLSTAYLQWSSLKASDTAMYYCARLGGDEYQSSGGMDVWGQGTTVIVSS

SEQ ID NO: 1355 - protein, 131 aa, Artificial Sequence
  anti-HIV_V3_HeavyChain
EVQLVQSGAEVKKPGATVKISCKVSGYTLTDYYIHWVQQAPGRGLEWLGLVDPENGETLYAEKFQGRVTLTADTSTDTAYMELKSLRYEDTAVYYCATEGPPSYYDSGTYAKSLPASFACWGQGTLVTVSS

SEQ ID NO: 1356 - protein, 123 aa, Artificial Sequence
  anti-HIV_V3_HeavyChain
QVQLQESGPGLVKPSETLSLTCTVSGGSINNYYWSWIRQPPGKGLEYIGYIFYSGSTNYNPSLKSRVTFSVDTSKNQFSLKLTSVTATDTAVYYCARGPLLYFGAPRTHFDYWGQGALVTVSS

SEQ ID NO: 1357 - protein, 124 aa, Artificial Sequence
  anti-HIV_V3_HeavyChain
EVQLVQSGAEVKKPGESLKISCKGSGYSFSSHWIGWVRQLPGKGLEWMGIIYPDDSDTKYNPSFQGQVTISADRSISTAYLQWSSLKASDTAMYYCARVGYDSYGYSGSNFDEWGQGTLVTVSS

SEQ ID NO: 1358 - protein, 119 aa, Artificial Sequence
  anti-HIV_V3_HeavyChain
EVQLVQSGAEVKKPGESLKISCKGSGYNFNSDWIGWVRQMPGKGLEWVGMIYPDDFEVRHSPPFQGRVTMSVDKSISTAYLQWSSLKSSDTGMYFCARLDGNAAAFDYWGQGTQVTVSS

SEQ ID NO: 1359 - protein, 120 aa, Artificial Sequence
  anti-HIV_V3_HeavyChain
DVQLVQSGAEVKKAGESLKISCRPSGYNFADYWIGWVRQMPGKGLEWMGIIFPDDSDTRYGPSFEGQVTISADKSINTAYLQWNSLKASDTAMYFCARHGGSGAAPGDYWGQGTLVTVSS

SEQ ID NO: 1360 - protein, 121 aa, Artificial Sequence
  anti-HIV_V3_HeavyChain
EVQLVQSGAEVKKPGATVKISCKVSGYTFTDYFMHWVQEAPGKGLAWMGLVDPENGDTVYAEKLQGRVTMSADTSRDTAYMELTSLRSEDTAVYYCAIGKSVAGTSAYDIWGQGTMVTVSS

SEQ ID NO: 1361 - protein, 123 aa, Artificial Sequence
  anti-HIV_V3_HeavyChain
QVQLVQSGAEVRKPGASVKVSCKASGDTFNNHDINWVRQAPGQGPEWVGWMNPKSGNAGYAQKFQGRVTMTRDTSISTAYMELRSLTSEDTGVYYCARLTVDCDDGGCYGDYWGQGTLVTVSS

SEQ ID NO: 1362 - protein, 118 aa, Artificial Sequence
  anti-HIV_V3_HeavyChain
EVYLQQSGAELKEPGANVKISCKAFGFIFTDYFIHWLRQAPGKGPQWVGVVDPEDGSTTYAEAFQGRVSITADRSTDTAYMDLAGLTSDDTAVYYCALMWNESGPDNWGQGTLVIVSS

SEQ ID NO: 1363 - protein, 131 aa, Artificial Sequence
  anti-HIV_V3_HeavyChain
EVQVVEFGGEVKKPGASVKVSCEASGYTFAKFAIHWVRQAPRQGLEWMGWINGDDGKTEYSQKFQDRVTMTRDTSASTVYMELSSLRSEDTALYYCARAMYPDTVTGNDNPAPPPFEGDYWGQGTLVTVSS

SEQ ID NO: 1364 - protein, 131 aa, Artificial Sequence
  anti-HIV_V3_HeavyChain
EVQLVESGGGLVKPGGSLRLTCVASGFTFSDVWLNWVRQAPGKGLEWVGRIKSRTDGGTTDYAASVKGRFTISRDDSKNTLYLQMNSLKTEDTAVYSCTTDGFIMIRGVSEDYYYYYMDVWGKGTTVTVSS

SEQ ID NO: 1365 - protein, 129 aa, Artificial Sequence
  anti-HIV_CD4bs_HeavyChain
EEQLVESGGGLVKPGGSQRLSCAASEFTFSRYTMNWVRQAPGKGLEWVSSISGNDNNIYYADSVKGRFTISRDNARNSLYLQINSLRVEDTAVYYCARGPLDSYDFWSGSRHYYGLDVWGQGTTVTVSS

SEQ ID NO: 1366 - protein, 124 aa, Artificial Sequence
  anti-HIV_CD4bs_HeavyChain
QVQLVQSGSELKKPGASVKVSCKASGYTFTSHIINWVRQAPGQGLEWMGWINTNTGNPTYAQGFTGRFVFSLDTSVSMAYLQISSLKAEDTGVYYCARGFRQWLVARITYFDYWGQGTLVTVSS

SEQ ID NO: 1367 - protein, 123 aa, Artificial Sequence
  anti-HIV_CD4bs_HeavyChain
ELRLQASGPGLVKPSETLSLVCSVSGVSISDSYWNWIRQPAGKGLEWIGRVYTRGTHTYNPSLGGRATVSGDTNKNEVSLKLMSVTAADTAVYYCARALSGDWTRRYFYMDVWGRGTPVTVSS

SEQ ID NO: 1368 - protein, 127 aa, Artificial Sequence
  anti-HIV_CD4bs_HeavyChain
QLQLQESGPRLVKPSETLSLTCTVSGGSISSGDYYWTWIRQPPGEGLEYIGYIYSGGSTDYNPSLKSRASISQDTSTNEFSLKLTSVTAADTAVYFCARDRRVLLWFGEPRRGLDFWGPGTLVTVSS

SEQ ID NO: 1369 - protein, 132 aa, Artificial Sequence
  anti-HIV_CD4bs_HeavyChain
EVQLVESGGGLVKPGGSLRLSCAASGFTFSSAWMSWVRQAPGKGLEWVGRIKSKSDGETTDYAAPVKGRFTISRDNLESTLYLQLNSLKTEDTAVYYCATATPSYYDIMTGNYKYYYYMDVWGKGTTVTVSS

SEQ ID NO: 1370 - protein, 121 aa, Artificial Sequence
  anti-HIV_CD4bs_HeavyChain
QVQLVESGGGLVKPGGSLRLSCAASGFIFRDHYMTWIRQAPGKGLEWVSYISSSSNNIQYADSVKGRFTVSRDNAKNSLYLQMNSLRADDTAVYYCARSGPFYNYGPPNNWGQGTLVTVSS

SEQ ID NO: 1371 - protein, 126 aa, Artificial Sequence
  anti-HIV_CD4bs_HeavyChain
QVQLVESGGGVVQPGGSLTLSCTASGFPFNSYAMHWVRQAPGKGLEWVSMTSHDGGNKDFVDSVKGRFTISRDNSRNTLFLQMNSLSQDDTGVYYCVRGKLEDYNFWGHYRDFDSWGQGTLVTVSA

SEQ ID NO: 1372 - protein, 135 aa, Artificial Sequence
  anti-HIV_CD4bs_HeavyChain
EPHVVESGGGMAKPGGSLRLSCAGSGFTFTNAWMNWVRQAPGKGLEWVGLIKSKSDGGTTDYAADVEGRFTISRDDLESTMFLEMHSLQIEDTAVYFCTTQYPRYYDLMTGNYKRRYFSSGMDVWGQGTAVTVSS

SEQ ID NO: 1373 - protein, 128 aa, Artificial Sequence
  anti-HIV_CD4bs_HeavyChain
QVQLQESGPGLVKPSQTLSLTCTVSGDSVSSGNYYWSWIRQPAGKPLEWIGHISTGGGTKNNPSLQSRVTISLDSSKNQVSLSLSSVTAADTAVYTCARGPPRSLWFGDPTYSYMDVWGKGTTVTVSS

SEQ ID NO: 1374 - protein, 124 aa, Artificial Sequence
  anti-HIV_CD4bs_HeavyChain
QVQLVQSGAEVKKPGSSVKVSCKASGGTFNSHAFTWVRQAPGQGLEWMGGIIPTLGLANDAQKFQGRFTITADESTTTVYMELSSLRSEDTAVYYCARRPYYDQVSGVGAFDIWGQGTRVTVSS

SEQ ID NO: 1375 - protein, 130 aa, Artificial Sequence
  anti-HIV_V2_HeavyChain
QVQLVQSGAEVKKPGSSVKVSCEASGVTSSSYTISWVRLAPGQGLEWMGRITPIFDITNYAQKFQGRVTLTADKSTGTTYMELSSLRSDDTAVYYCARDKSDVVVVTSIRPAYYYGMDVWGQGTTVTVSS

SEQ ID NO: 1376 - protein, 122 aa, Artificial Sequence
  anti-HIV_V2_HeavyChain
QVQLVQSGAEVKKPGSSVKVSCKASGGTFRSYAISWVRQAPGQGLEWMGGIIPIFGTADYAQKFQGKVTITADESTSTAYMELSSLTSEDTAMYYCARSRDHFFDTRVFQGWGQGTLVTVSS

SEQ ID NO: 1377 - protein, 121 aa, Artificial Sequence
  anti-HIV_V2_HeavyChain
QVQLVQSGAEVKKPGSSVKVSCKASGGNFNTYTISWVRQAPGQGLEWMGRIIPIFGIVNPAQKFPGRVTINVDKSTNTAYMELSSLRSEDTAVYYCATSGVGLHFGYFDYWGQGTQVTVSS

SEQ ID NO: 1378 - protein, 126 aa, Artificial Sequence
  anti-HIV_V2_HeavyChain
QVQLQQWGPGLLKPSETLSLTCAVYGGSFGRYYWSWIRQSSGEGLEWLGQIDHTGSTTYNPSLKGRVTISIDSSTNQFSLKVTSVIAADTAVYYCARAPSGYPGVSLYQYYGLDVWGQGTTVTVSP

SEQ ID NO: 1379 - protein, 122 aa, Artificial Sequence
  anti-HIV_V2_HeavyChain
QVQLVQSGAEVKKPGSSVKVSCKASGGTFSNYAISWVRQAPGQGLEWMGGIIPIFGTTDYAQKFQGRVTITADASTSTAYMELSSLRSDDTAVYYCARSRGHYFDTRVFEGWGQGTLVTVSS

SEQ ID NO: 1380 - protein, 124 aa, Artificial Sequence
  anti-HIV_V2_HeavyChain
QVHLVQSGTEVKKPGASVTVSCKASGYSFTGYYLHWVRQAPGQGLEWMGWINPNSGGTYYAQNFQARVTMTRDTSISTVYMDLSRLRSDDTAVYYCVRRAVLTALPPRYYFDFWGQGTLVTVSS

SEQ ID NO: 1381 - protein, 106 aa, Artificial Sequence
  anti-HIV_V3_LightChain
SLELTQPPSVSVSPGQTVSITCSGNLLGDKDASWYQLKPGQSPILVIYLDTERPSGIPERFSGSKSGNTATLTISGTQAMDEAEYFCQAWDTTTVLFGGGTRLTVL

SEQ ID NO: 1382 - protein, 108 aa, Artificial Sequence
  anti-HIV_V3_LightChain
SDELTQPPSVSVSPGQTARITCSGDALPEKYAYWYQQKSGQAPVLVIDEDNKRPFGTPERFSGSRSGTMATLTITGAQMEDEADYYCSSTDSRGTYWVFGGGTKLTVL

SEQ ID NO: 1383 - protein, 112 aa, Artificial Sequence
  anti-HIV_V3_LightChain
QSVLTQPPSVSAAPGQKVTISCSAGNSKIGDNYISWYQHVPGAAPKLLIYENDKRPSGIPDRFSGSKSGTSASLGITGLQTGDEADYYCAAWDNSLSSALYVFGTGTKVTVL

SEQ ID NO: 1384 - protein, 113 aa, Artificial Sequence
  anti-HIV_V3_LightChain
DIVMTQSPDSLAVSLGERATINCKSSQNVFYSSNNRNYLAWYQQRPGQPPKLLFYWASTRESGVPDRFSGSGSGTDFTLTISSLQTEDVAIYYCQQYYNTPPTFGPGTKVEIK

SEQ ID NO: 1385 - protein, 106 aa, Artificial Sequence
  anti-HIV_V3_LightChain
SYELTQPPSVSVSPGQTATITCSGDLLGDKYASWYRQKPGQSPVLVIYEDTKRPSGLPERFSGSNSGNTATLTISETQAMDEADYYCQAWDTRTVVFGGGTKLTVL

SEQ ID NO: 1386 - protein, 109 aa, Artificial Sequence
  anti-HIV_V3_LightChain
QSVLTQPPSVSAAPGQKVTISCSGRSSDIENKFVSWYQQLPGTAPKLLIYEDNKRPSGIPDRFSGSKSGTSATLGITGLQTGDEADYYCGTWDNNLRAGFGGGTHLTVL

SEQ ID NO: 1387 - protein, 108 aa, Artificial Sequence
  anti-HIV_V3_LightChain
SYELTQPPSVSVSPGQTARITCSGDALPNKYAFWYQQKSGQAPVLVIFDDNRRPAGIPERFSGSRSGTLATLTISGAQVEDEADYYCYSTDNDGKYFVFGSGTMVTVL

SEQ ID NO: 1388 - protein, 106 aa, Artificial Sequence
  anti-HIV_V3_LightChain
SYELTQPPSVSVSPGQTASITCSGHKLGDKYASWYQHKPGQSPVLVIYEDTQRPSGIPERISGSKSGNTATLTISGTQAMDEADYYCQAWDSRAAVFGGGTRLTVL

SEQ ID NO: 1389 - protein, 109 aa, Artificial Sequence
  anti-HIV_V3_LightChain
QSALTQPASVSGSPGQSITISCTGISSDIGTDNYVSWYQQHPGKAPKLIIYEVSNRPSGISHRFSGSKSGNTASLIISGLQVEDEAHYYCNSYRSDTLVFGGGTKVTVL

SEQ ID NO: 1390 - protein, 111 aa, Artificial Sequence
  anti-HIV_V3_LightChain
QSVLTQPPSASGTPGQRVTISCSGSSSNIGSNTVNWYQHLPGTAPKLLIYSNDQRPSGVPDRFSGSSSGTSASLAISGLQSEDEADYYCAAWDDSLNGPFVFGTGTKVTVL

SEQ ID NO: 1391 - protein, 106 aa, Artificial Sequence
  anti-HIV_V3_LightChain
DIQMTQSPSSLSASVGDRITITCRTSQSIDNHLNWYQHKPGKAPKLLISAASRLQSGVPSRFTGSGSGTEFTLTISSLQPEDFAVYYCQQSYITITFGPGTKVDIK

SEQ ID NO: 1392 - protein, 107 aa, Artificial Sequence
  anti-HIV_V3_LightChain
EIVMTQSPATLSVSPGEGVTLSCRASQSVSSNILWYQQRPGQAPRLLLYGASTRATGIPARFSGSGSGTEFTLTINSMQSEDFAIYYCQQYHDWLWTLGQGTQVEIK

SEQ ID NO: 1393 - protein, 109 aa, Artificial Sequence
  anti-HIV_V3_LightChain
SYELTQPPSVSVSPGQTASITCSGDKMGERYTSWYQQKPGQSPVLVMSENIKRPAGIPERFSGSSSGNTAILTISGTQAVDEADYYCQVWDTTTTSYVIFGGGTKLTVL

SEQ ID NO: 1394 - protein, 107 aa, Artificial Sequence
  anti-HIV_V3_LightChain
DIQMTQSPSSLSASVGDRVTITCQASQDIGNYLNWYHQKPGKAPKLLIYDASNVETGVASRFSGSGSGTDFTLTISSLQPEDIGTYFCQQYESLPWAFGGGTKVEIR

SEQ ID NO: 1395 - protein, 111 aa, Artificial Sequence
  anti-HIV_V3_LightChain
NFKLTQPHSVSESPGKTVTISCTRTSGTIATNYVQWFQQRPGSSPTTMIYENDKRPSGVPDRFSGSIDTSSNSASLTISGLKTEDEADYYCQSYNSTDIVVFGGGTKLTVL

SEQ ID NO: 1396 - protein, 109 aa, Artificial Sequence
  anti-HIV_V3_LightChain
QSVLTQPPSVSAAPGQKVTISCSGSSSNIGNNMVSWYQQHPGTAPKLLIYENSKRPSGIPDRFSGSRSGTSATLGIIGLQTGDEAEYYCATWDGSLRTVFGGGTKLTVL

SEQ ID NO: 1397 - protein, 108 aa, Artificial Sequence
  anti-HIV_V3_LightChain
SYELTQPPSVSVSPGQTARITCSGDALPNQYGYWYQQKPGQAPVLVIFKDSERPSGIPERFSGSSSGTTVTLTISGVQAEDEADYYCQSADSSGNYEVFGGGTKLTVL

SEQ ID NO: 1398 - protein, 110 aa, Artificial Sequence
  anti-HIV_V3_LightChain
QSVLTQPPSVSEAPRQRVTISCSGSSSNIGNNAVNWYQQVPGKAPKLLIYYDDLLPSGVSDRFSGSKSGSSASLAISGLQSEDEADYYCAAWDDSLKVYVFGTGTSVTVL

SEQ ID NO: 1399 - protein, 111 aa, Artificial Sequence
  anti-HIV_V3_LightChain
DIVMNQSPPSLAVTPGEPASISCRASQSLLYSDGHNYLDWYLQKPGQAPQLLIYLGSTRASGVPDRFSGSGSGTDFTLKISRVEAEDVGVYYCMQPLQSYTFGQGTKLEIK

SEQ ID NO: 1400 - protein, 107 aa, Artificial Sequence
  anti-HIV_V3_LightChain
AYELTQPPSVSVSPGQTARITCSGDALPNQYAYWYHQRPGQAPVLVIHKDTERPSGIPARFSGSSSGTTVTLTISEVQAEDEGDYYCQSADTSAYVVFGGGTKLTVL

SEQ ID NO: 1401 - protein, 110 aa, Artificial Sequence
  anti-HIV_V3_LightChain
QSVLTQAPSSSGTPGQSVTISCSGSSSNMEINYVYWYRQFPGTAPQLLIYNDNQRPSGVPDRFSASKSGTSASLAIGGLRSEDEADYFCAVWHGDRGGPVFGGGTKLTVL

SEQ ID NO: 1402 - protein, 109 aa, Artificial Sequence
  anti-HIV_V3_LightChain
SYELKQPRSVSVSPGQTARITCSGDAMPNQYAYWYQQRPGRAPVLLIFKDNERASGIPERISGSSSGTTATLTINRVQAEDEADYLCQSADSSGAFPWVFGGGTTLTVL

SEQ ID NO: 1403 - protein, 108 aa, Artificial Sequence
  anti-HIV_V3_LightChain
SYELTQPPSVSVSPGQTARITCSGDALPKEYAYWYQQKSGQAPVLVIYEDTRRPSGIPERFSGSSSGTMATLTVSGAHVDDEADYYCYSRDTSANQWVFGGGTKLTVL

SEQ ID NO: 1404 - protein, 106 aa, Artificial Sequence
  anti-HIV_V3_LightChain
EIVLTQSPATLSLSPGERATLSCRASQSISTYLGWYQQKPGQAPRLLIYDASNRATGIPARFSGSGSGTDFTLTISSLEPEDFAVYYCQQRYTWITFGQGTRLEIK

SEQ ID NO: 1405 - protein, 109 aa, Artificial Sequence
  anti-HIV_V3_LightChain
SYELTQPPSVSVSPGQTARITCSGDALPNQYVYWYQQRPGQAPVVVLYKDTERPSGIPERFSGSSSGTTVTLTISGVQAEDEADYYCQSADNSGAYPLFFGGGTKLTVL

SEQ ID NO: 1406 - protein, 111 aa, Artificial Sequence
  anti-HIV_V3_LightChain
QSVLTQPPSVSAAPGQKVTISCSGSSSNIGNNYVLWYQQFPGTAPKLLIYGNNKRPSGIPDRFSGSKSGTSATLGITGLQTGDEADYFCATWDSGLSADWVFGGGTKLTVL

SEQ ID NO: 1407 - protein, 107 aa, Artificial Sequence
  anti-HIV_V3_LightChain
DIQMTQSPSSLSASVGDRVTITCRASQEIDNYLAWYQQRPGKAPKSLIYAASSLQGGVPPKFSGSGSGTEFTLTISSLQAEDFATYYCQQYNAYPLTFGQGTRLDIN

SEQ ID NO: 1408 - protein, 108 aa, Artificial Sequence
  anti-HIV_V3_LightChain
SYELTQPPSLSVSPGQTASITCSGDGLPKQYGYWYQQKPGQAPLLVILKDTERPSGIPERFSGSSSGTTVTLTISGVQAEDEADYYCQSVDSTGSYYVFGPGTKVTVL

SEQ ID NO: 1409 - protein, 108 aa, Artificial Sequence
  anti-HIV_V3_LightChain
SYELTQPPSVSVSPGQTARITCSGDVLPKKYAYWYQQKSGLAPVLVIYEDNRRPSGIPERFSGSSSGTMATLTISGAQVEDEGDYYCSSTDSSGDHYVFGTGTKVTVL

SEQ ID NO: 1410 - protein, 107 aa, Artificial Sequence
  anti-HIV_V3_LightChain
AYELTQPPSVSVSPGQTARITCSAEALSNQYAYWYRQRPGQAPLLIIYKDTKRPSGIPERFSGSTSGTTVTLTISGVQAEDEADYYCQSADSSGDYVFGGGTKVTVL

SEQ ID NO: 1411 - protein, 111 aa, Artificial Sequence
  anti-HIV_CD4bs_LightChain
QPVLTQSSSASASLGSSVKLTCTLGSGHSGSIIAWHQQQPGKAPRYLMKVQSSGSYNKGSGVPDRFSGSSSGADRYLTISNLQFEDEGDYYCETWDTNKYVFGTGTKVTVL

SEQ ID NO: 1412 - protein, 108 aa, Artificial Sequence
  anti-HIV_CD4bs_LightChain
ELVLTQSPGTLSLSPGERATLSCRASQSVASYYLAWYQQKPGQAPRLLIYGASSRATGIPDRFSGSVSGTDFTLTISRLEPEDFALYYCQQYGSSPLSFGGGTKVEIR

SEQ ID NO: 1413 - protein, 111 aa, Artificial Sequence
  anti-HIV_CD4bs_LightChain
QSALTQPPSMSGSPGQSITISCTGSGSDVGSHNFVSWYQQHPARVPKLLIYAVGNRPSGVSERFSGSKSGNTAYLTISGLQADDEADYYCSSHTTGTTLEVFGGGTRLTVL

SEQ ID NO: 1414 - protein, 111 aa, Artificial Sequence
  anti-HIV_CD4bs_LightChain
DIVMTQSPLSLPVTPGEPASISCRSSESLLHSNGFIYLDWYLQKPGQSPQLLIYLGSKRASGVSDRFSGSGSGTAFTLKISRVEAEDVGVYYCMQALESRTFGQGTKLEIK

SEQ ID NO: 1415 - protein, 109 aa, Artificial Sequence
  anti-HIV_CD4bs_LightChain
EIVLTQSPGTLSLSPGERATLSCRASQSVSSSYLAWYQQKPGQSPRLLIYGASSRATGIPDRFSGSGSGTDFTLTISRLEPEDFAVYYCQHYGSSSIFTFGPGTKVDIR

SEQ ID NO: 1416 - protein, 110 aa, Artificial Sequence
  anti-HIV_CD4bs_LightChain
NFMLTQPHSVSGSPGKTVTISCTRSSGSIAGNYVQWYQQRPGTSPTTVIYENDQRSSGVPDRFSGSIDSSSNSASLTISGLKTEDEADYYCHSYDATNQVFGGGTKLTVL

SEQ ID NO: 1417 - protein, 111 aa, Artificial Sequence
  anti-HIV_CD4bs_LightChain
DVVVTQSPLSLPVTLGQPASISCRSSQSLVYSDGTTHLNWYHQRPGQPPRRLIYRVSNRDSGVPDRFSGSGSGTDFTLRISRVEAEDVGLYYCMLATHPFTFGPGTKVEIK

SEQ ID NO: 1418 - protein, 112 aa, Artificial Sequence
  anti-HIV_CD4bs_LightChain
QSVLTQPPSVSGAPGQTVTISCTGSSSNIGPSYDVQWYQQFPGRAPKLLISGNNNRASGVPDRFSGSKSGTSASLAITGLQSEDEADYYCQTYDSSLSGHVVFGGGTRLTVL

SEQ ID NO: 1419 - protein, 107 aa, Artificial Sequence
  anti-HIV_CD4bs_LightChain
DIQMTQSPSTLSASVGDRVTITCRASASIYTWLAWYQQRPGKAPEVLIYKASTLKSGVPSRFSGSGSGTEFTLTISSLQPGDFATYYCQQYTTYPLTFGGGTTVEIK

SEQ ID NO: 1420 - protein, 110 aa, Artificial Sequence
  anti-HIV_CD4bs_LightChain
QSALTQPASVSGSPGQSITISCTGTSNDIGTYNLVSWYQHHPNKAPKVVVYENNKRPSGISNRFSGSKSGNTASLTISGLQAEDEADYYCCSYAGSSTWVFGGGTKLTVL

SEQ ID NO: 1421 - protein, 107 aa, Artificial Sequence
  anti-HIV_V2_LightChain
DIQMTQSPSTLSASVGDRVTITCRASQTISSWLAWYQQKSGTAPKLLIYKASSIVSGVPSRFSGSGSGTEFTLTITSLQPDDFATYYCQQYNSSPETFGQGTKVEIK

SEQ ID NO: 1422 - protein, 106 aa, Artificial Sequence
  anti-HIV_V2_LightChain
EIVLTQSPGTLSLSPGERATLSCRASQSVSSYLAWYQQKPGQAPRLLIYDASSRATGIPDRFSGSGSGTDFTLTISRLEPEDFAVYYCQHYAGSRTFGQGTKVEIK

SEQ ID NO: 1423 - protein, 111 aa, Artificial Sequence
  anti-HIV_V2_LightChain
QSVLTQPPSVSGAPGQRVTISCTGSSSNIGAHYDVHWYQQLPGTAPKLLIYGNSNRPSGVPDRFSGSKSGTSASLAITGLQAEDEADYYCQSYDSSLSGYVFGTGTKVTVL

SEQ ID NO: 1424 - protein, 108 aa, Artificial Sequence
  anti-HIV_V2_LightChain
DTVMTQSPATLSVSPGERVTLSCRASQIINTNLAWYQKRPGQAPRLLIYAASARATGIPARFSGSGSGTEFTLTISGLQSEDSAVYYCQQYKHWPPYTFGRGTKLEIR

SEQ ID NO: 1425 - protein, 107 aa, Artificial Sequence
  anti-HIV_V2_LightChain
EIVLTQSPGTLSLSPGERATLSCRASQSVSSSYLAWYQQKPGQAPRLLIYGASSRATGIPDRFSGSGSGTDFTLTISRLEPEDFAVYYCQQYGSSRTFGQGTKVEIK

SEQ ID NO: 1426 - protein, 107 aa, Artificial Sequence
  anti-HIV_V2_LightChain
DIQMTQSPSSLSASVGDRVTITCRASQSISGNLNWYQQKPGKAPNLLIYGASSLQSGVPSRFSGSGSGTDFTLTISSLQPEDFATYHCQQSHSTSWTFGQGTKVVIK

SEQ ID NO: 1427 - protein, 109 aa, Artificial Sequence
  anti-HIV_10E8
ASELTQDPTVSVALGQTVTITCRGDSLRNHYTSWYQQKTGQAPVLLIYPKHNRSPGISDRFSASSSGNTASLTITGAQTEDEGDYYCSSRDKSGSRLVTFGGGTEVTGL

SEQ ID NO: 1428 - protein, 109 aa, Artificial Sequence
  anti-HIV_10E8
ASELTQDPTVSVALGQTVTITCRGDSLRNHYTSWYQQKTGQAPVLLIYPKHNRSPGISDRFSASSSGNTASLTITGAQTEDEGDYYCSSRDKSGSRLVTFGGGTKVTVV

SEQ ID NO: 1429 - protein, 109 aa, Artificial Sequence
  anti-HIV_10E8
ASELTQDPTVSVALGQTVTITCRGDSLRNYYTSWYQQKPGQAPVLLIYPKHNRPPGISDRFSASSSGNTASLTITGAQTEDEGDYYCSSRDKSGSRLVTFGGGTKVTGL

SEQ ID NO: 1430 - protein, 109 aa, Artificial Sequence
  anti-HIV_10E8
ASELTQDPTVSVALGQTVTITCRGDSLRNYYTSWYQQKPGQAPVLLIYPKHNRPPGISDRFSASSSGNTASLTITGAQTEDEGDYYCSSRDKSGSRLVTFGRGTKLTVV

SEQ ID NO: 1431 - protein, 109 aa, Artificial Sequence
  anti-HIV_10E8
ASELTQDPTVSVALGQTVTITCRGDSLRNHYTSWYQQKTGQAPVLLIYPKHNRSPGISDRFSASSSGNTASLTITGAQTEDEGDYYCSSRDKSGSRLVTFGGGTKVTVL

SEQ ID NO: 1432 - protein, 109 aa, Artificial Sequence
  anti-HIV_10E8
ASELTQDPTVSVALGQTVTITCRGDSLRNYYTSWYQQKPRQAPVLLIYPKHNRPPGISDRFSASSSGNTASLTITGAQTEDEGDYYCSSRDKSGSRLVTFGGGTKLTVL

SEQ ID NO: 1433 - protein, 109 aa, Artificial Sequence
  anti-HIV_10E8
ASELTQDPTVSVALGQTVTITCRGDSLRNYYTSWYQQKPGQAPVLLIYPKHNRPPGISDRFSASSSGNTASLTITGAQTEDEGDYYCSSRDKSGSRLVTFGGGTKLTVL

SEQ ID NO: 1434 - protein, 109 aa, Artificial Sequence
  anti-HIV_10E8
ASELTQDPTVSVALGQTVTITCRGDSLRNHYTSWYQQKTGQAPILLIYPKHNRPPGISDRFSASSSGNTASLTITGAQTEDEGDYYCSSRDKSGSRLVTFGGGTKLTVL

SEQ ID NO: 1435 - protein, 109 aa, Artificial Sequence
  anti-HIV_10E8
SSDLTQDPAVSVALGQTVRITCQGDSLRRYYAGWYQQKPGQAPVLVVYGRDNRPSGIPDRFSGSTSGNTASLTIAGAQAEDDADYYCSSRDKSGSRLSVFGGGTKLTVL

SEQ ID NO: 1436 - protein, 109 aa, Artificial Sequence
  anti-HIV_10E8
ASELTQDPAVSVAFEKTVTITCQGDSLRSHYVSWYQKRPGQAPVLVFYGKNNRPSGIPDRFSGSTSGNTASLTIAGAQAEDDADYYCSSRDKSGSRLSVFGGGTKLTVP

SEQ ID NO: 1437 - protein, 109 aa, Artificial Sequence
  anti-HIV_10E8
ASELTQDPAVSVALKQTVTITCRGDSLRSHYVSWYQQKPGQAPVLVFYGKNNRPSGIPDRFSGSSSGNTASLTIAGAQAEDDADYYCSSRDKSGSRLSVFGGGTKLTVL

SEQ ID NO: 1438 - protein, 109 aa, Artificial Sequence
  anti-HIV_10E8
SSELTQDPGVSVALKQTVTITCRGDSLRSHYVSWYQKKPGQAPVLVFYGKNIGPSGIPDRFSGSTSGNTASLTIAGAQAEDDADYYCSSRDKSGSRLSVFGGGTKLTVL

SEQ ID NO: 1439 - protein, 109 aa, Artificial Sequence
  anti-HIV_10E8
ASELTQDPAVSVALKQTVTITCRGDSLRSHYVSWYQKKPGQAPVLVFYGKNNRPSGIPDRFSGSSSGNTASLTIAGAQAEDDADYYCSSRDKSGSRLSVFGGGTKLTVL

SEQ ID NO: 1440 - protein, 109 aa, Artificial Sequence
  anti-HIV_10E8
ASELTQDPGVSVALKQTVTITCRGDSLRSHYVSWYQKRPGQAPVLVFYGKNNRPSGIPDRFSGSTSGNTASLTIAGAQAEDDADYYCSSRDKSGSRLSVFGGGTKLTVL

SEQ ID NO: 1441 - protein, 109 aa, Artificial Sequence
  anti-HIV_10E8
ASELTQDPGVSVALEQTVTITCRGDSLRSHYVSWYQKKPGQAPVLVFYGKNNRPSGIPDRFSGSTSGNTASLTIAGAQAEDDADYYCSSRDKSGSRLSVFGGGTKLTVL

SEQ ID NO: 1442 - protein, 109 aa, Artificial Sequence
  anti-HIV_10E8
ASELTQDPGVSVALKQTVTITCRGDSLRSHYVSWYQKKPGQAPVLVFYGKNNRPSGIPDRFSGSTSGNTASLTIAGAQAEDDADYYCSSRDKSGSRLSVFGGGTKLTVL

SEQ ID NO: 1443 - protein, 109 aa, Artificial Sequence
  anti-HIV_10E8
SSELTQDPGVSVALKQTVTITCRGDSLRSHYVSWYQKKPGQAPVLVFYGKNNRPSGIPDRFSGSTSGNTASLTIAGAQAEDDADYYCSSRDKSGSRLSVFGGGTKLTVL

SEQ ID NO: 1444 - protein, 109 aa, Artificial Sequence
  anti-HIV_10E8
SSELTQETGVSVALGRTVTITCRGDSLRSHYASWYQEKPGQAPKLLFYGKNNRPSGIPDRFSGSASGNRASLTISGAQAEDDAEYYCSSRDKSGSRLSVFGGGTKLAVL

SEQ ID NO: 1445 - protein, 109 aa, Artificial Sequence
  anti-HIV_10E8
SSELTQETGVSVALGRTVTITCRGDSLRSHYASWYQKKPGQAPKLLFYGKNNRPSGIPDRFSGFASGNRASLTISGAQAEDDAEYYCSSRDKSGSRLSVFGGGTKLTVL

SEQ ID NO: 1446 - protein, 109 aa, Artificial Sequence
  anti-HIV_10E8
SSELTQETGVSVALGRTVTITCRGDSLRSHYASWYQKKPGQAPKLLFYGKNNRPSGIPDRFSGSASGNRASLTISGAQAEDDAEYICSSRDKSGSRLSVFGGGTKLTVL

SEQ ID NO: 1447 - protein, 109 aa, Artificial Sequence
  anti-HIV_10E8
SSELTQETGVSVALGRTVTITCRGDSLRSHYASWYQKKPGQAPKLLFYGKNNRPSGIPDRFSGSASGNRASLTISGAQAEDDAEYYCSSRDKSGSRLSVFGGGTKLTVL

SEQ ID NO: 1448 - protein, 109 aa, Artificial Sequence
  anti-HIV_10E8
SSELTQETGVSVALGRTVTITCRGDSLRSHYASWYQKKPGQAPILLFYGKNNRPSGIHDRFSGSASGNRASLTISGAQAEDDAEYYCSSRDKSGSRLSVFGGGTKLTVL

SEQ ID NO: 1449 - protein, 131 aa, Artificial Sequence
  anti-HIV_10E8
EVQLVESGGDLVKPGGSLRLSCSASGFSFKNTWMTWVRQAPGKGLEWVGRITGPGEGWTSDYAATVQGRFTISRNNMIDMLYLEMNRLRTDDTGLYYCVHTEKYYNFWGGYPPGEEYFQHWGRGTLVIVSS

SEQ ID NO: 1450 - protein, 131 aa, Artificial Sequence
  anti-HIV_10E8
EIRLVESGGGLVKPGGSLRLSCSASGFNFDSAWMTWVRQPPGKGLEWVGRITGPGEGWSVGYAESVKGRFIISRINSINFLYLEMNNLRPEDTGSYFCAHTGKHYDFWRGYPPGEEYFQDWGQGTQVIVSS

SEQ ID NO: 1451 - protein, 131 aa, Artificial Sequence
  anti-HIV_10E8
EIRLVESGGGLVKPGGSLRLSCSASGFNFDSAWMTWVRQPPGKGLEWVGRITGPGEGWSVDYAESVKGRFIISRINSINFLYLEMNNLRPEDTGSYFCAHTGKHYDFWRGYPPGEEYFQDWGQGTQVIVSS

SEQ ID NO: 1452 - protein, 131 aa, Artificial Sequence
  anti-HIV_10E8
EVRLVESGGRLVRPGGSLRLSCSASGFNFDNAWMTWVRQPPGKGLEWVGRITGPGEGWSVDYAASVKGRFTISRMNSINFFYLEMNNLKIEDTGLYFCARTGKHYAFWGGYPPGEEYLEDWGQGTLVIVSS

SEQ ID NO: 1453 - protein, 131 aa, Artificial Sequence
  anti-HIV_10E8
EVRLVESGGGLVKPGGSLRLSCSASGFNFDDAWMTWVRQPPGKGLEWVGRISGPGEGWSVDYAESVKGRFTISRLNSINFLYLEMNNVRTEDTGYYFCARTGKHYDFWSGYPPGEEYFQDWGQGTLVIVSS

SEQ ID NO: 1454 - protein, 131 aa, Artificial Sequence
  anti-HIV_10E8
EVRLAESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGQGTLVIVPS

SEQ ID NO: 1455 - protein, 131 aa, Artificial Sequence
  anti-HIV_10E8
EVRLVESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGQGTLVIVPS

SEQ ID NO: 1456 - protein, 131 aa, Artificial Sequence
  anti-HIV_10E8
EVRLVESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGQGTLVIVSS

SEQ ID NO: 1457 - protein, 131 aa, Artificial Sequence
  anti-HIV_10E8
EVRLAESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGRGTLVIVSS

SEQ ID NO: 1458 - protein, 131 aa, Artificial Sequence
  anti-HIV_10E8
EVRLVESGGGLVKPGGSLRLSCSASGFDFDNAWMTWVRQPPGKGLEWVGRITGPGEGWSVDYAAPVEGRFTISRLNSINFLYLEMNNLRMEDSGLYFCARTGKYYDFWSGYPPGEEYFQDWGRGTLVIVSS

SEQ ID NO: 1459 - protein, 111 aa, Artificial Sequence
  anti-HIV-1_LightChain
QSVLTQPPSVSAAPGQKVTISCSGRSSNIGNNNVFWYQQLPGTAPKLLIYDNDKRPSGIPDRFSGSKSGTSATLGITGLQTGDEADYYCGTWDSSLSAGGVFGTGTKVTVL

SEQ ID NO: 1460 - protein, 112 aa, Artificial Sequence
  anti-HIV-1_LightChain
QSVLTQPASVSGSPGQSITISCTGTKSDIGGYKYVSWYQQHPGKAPKILIYDVNKRPSGIPDRFSGSKSGTSATLGITGLQTGDEADYYCGTWDNSLSTGGVFGTGTKVTVL

SEQ ID NO: 1461 - protein, 107 aa, Artificial Sequence
  anti-HIV-1_LightChain
QSVLTQPPSVSAAPGQRVTISCFGSRFSSVSWYQQLPGTAPKLLIYENTKRPSGIPDRFSGSKSGTSATLGITGLQTGDEADYYCGTWDRSLSAGGVFGTGTKVTVL

SEQ ID NO: 1462 - protein, 111 aa, Artificial Sequence
  anti-HIV-1_LightChain
QSVLTQPPSASGTPGQTITISCSGSSSNIGSNDVYWYQHLPGTTPKVVIYKNNRRPSGIPDRFSGSKSGTSATLGITGLQTGDEADYYCGTWDRSLSAGGVFGTGTKVTVL

SEQ ID NO: 1463 - protein, 109 aa, Artificial Sequence
  anti-HIV-1_LightChain
QSVLTQPPSMSAAPGQKVTISCSGSTSIIGNNYISWYQQLPGTAPKLLIYEDNKRPSGIPDRFSGSKSGTSATLGITGLQTGDEADYYCGTWHSSLSAGGVFGTGTKVT

SEQ ID NO: 1464 - protein, 111 aa, Artificial Sequence
  anti-HIV-1_LightChain
QSVLTQPPSVSAAPGLKVTISCSGNTSNVGDNFVSWYRYLPGTAPKLLSYEDDKRPSGIPDRFSGSKSGTSATLGITGLQTGDEADYYCGTWDSSLSAGGVFGTGTKVTVL

SEQ ID NO: 1465 - protein, 111 aa, Artificial Sequence
  anti-HIV-1_LightChain
QSVLTQPPSASGTPGQRVTISCSGSSSNIGSNTVNWYQQFPGTAPKLLIYENNRRPSGVPARFSGSKSGTSATLAITGLQTGDEADYYCATWDSSLSAGGVFGTGTKVTVL

SEQ ID NO: 1466 - protein, 106 aa, Artificial Sequence
  anti-HIV-1_LightChain
QSVLTQPPSVSAAPGQKVTISCSGSSSNIGNNYVSWYQQLPGTAPKLLIYENNKRPSGIPDRFSGSKSGTSATLGITGLQTGDEADYYCGTWDNSLSTGGVFGTGT

SEQ ID NO: 1467 - protein, 96 aa, Artificial Sequence
  anti-HIV-1_LightChain
GLSPSLCSGSSSNIGNNYVSWYQQLPGTAPKLLIYENTKRPSGIPDRFSGSKSGTSATLGITGLQTGDEGDYYCGTWDRSLSAGGVFGTGTKVTVL

SEQ ID NO: 1468 - protein, 111 aa, Artificial Sequence
  anti-HIV-1_LightChain
QFVLTQPPSVSAAPGQRVTVSCSGTTSDIGENYVSWYQKFSEAAPKLLLYDNDKRPSGIPDRFSGSKSGTSATLGITGLQTGDEADYYCGTWDSSLSAGGVFGTGTKVTVL

SEQ ID NO: 1469 - protein, 109 aa, Artificial Sequence
  anti-HIV-1_LightChain
QSVLTQPPSVSAAPGQKVTISCSGGSSNIGNYYVSWYLQLPGTAPKLLIYENNKRPSGIPDRFSGSKSGTSATLGITGLQTGDEADYYCGTWHSSLSAGGVFGTGTKVT

SEQ ID NO: 1470 - protein, 111 aa, Artificial Sequence
  anti-HIV-1_LightChain
QSVLTQPPSVSAAPGQKVTISCSGNMSNIGDNAVSWYRQVPEAPPQLLIFGNDKRPSGVTDRFSGSKSGTSATLGITGLQTGDEADYYCGTWDRSLSAGGVFGTGTKVTVL

SEQ ID NO: 1471 - protein, 112 aa, Artificial Sequence
  anti-HIV-1_LightChain
QSVLTQPPSVSGAPGQRVTISCTGSSSNIGAGYDVHWYLQLPGTAPRLLIYDNDKRPSGIPDRFSGSKSGTSATLGITGLQTGDEADYYCGTWHSSLSAGGVFGTGTKVTVL

SEQ ID NO: 1472 - protein, 111 aa, Artificial Sequence
  anti-HIV-1_LightChain
QSVLTQPPSVSAAPGQKVTISCSGSTSNIGNNFVSWYQQLPGTAPKLLFYDNYKRPSGIPDRFSGSKSGTSATLAITGLQTGDEADYYCATWDSSLSAGGVFGTGTKVTVL

SEQ ID NO: 1473 - protein, 112 aa, Artificial Sequence
  anti-HIV-1_LightChain
QSVLTQPPSVSGAPGQRVTISCTGGSSNIGAGYDVHWYQHLPGTAPQLLIYENTKRPSGIPDRFSGSKSGTSATLGITGLQTGDEADYYCGTWDRSLSAGGVFGTGTKVTVL

SEQ ID NO: 1474 - protein, 111 aa, Artificial Sequence
  anti-HIV-1_LightChain
QSVLTQPPSLSAAPGQRVTVSCSGSSSNIGDNYVSWYQQLPGAAPRLLIYENNKRPSGIPDRFSGSKSGTSATLGITGLQTGDEADYYCGTWDNSLSTGGVFGTGTKVTVL

SEQ ID NO: 1475 - protein, 111 aa, Artificial Sequence
  anti-HIV-1_LightChain
QSVLTQPPSVSAAPGQKVTISCSGRSSNIGNYFVSWYQQFPGTAPKLLIYDNNKRPSGIPDRFSGSKSGTSATLGITGLQTGDEADYYCGTWDRSLSAGGVFGTGTKVTVL

SEQ ID NO: 1476 - protein, 111 aa, Artificial Sequence
  anti-HIV-1_LightChain
QSVLTQPPSASGTPGQRVTISCSGSSSNIGSNAVHWFRQLPGTAPKLLIYENNKRPSGIPDRFSGSKSGTSATLGITGLQTGDEADYYCATWDSSLSAGGVFGTGTKVTVL

SEQ ID NO: 1477 - protein, 111 aa, Artificial Sequence
  anti-HIV-1_LightChain
QSVLTQPPSVSAASGQKVTISCSGSSSNIGNNYVSWYHQLPGTAPKLLIYDTNKRPSGIPDRFSGSTSGTSATLGITGLQTGDEADYYCGTWDNSLSTGGVFGTGTKVTVL

SEQ ID NO: 1478 - protein, 111 aa, Artificial Sequence
  anti-HIV-1_LightChain
QPVLTQPPSVSAAPGQTVTISCSGSFSNIETNYVSWYQQLPGTAPKLLIYDNNMRPSGIPDRFSGSKSGTSATLGITGLQTGDEADYYCGTWDTSLSAGGVFGTGTKVTVL

SEQ ID NO: 1479 - protein, 112 aa, Artificial Sequence
  anti-HIV-1_LightChain
QPVLTQPPSVSGAPGQRVTISCTGSSSNIGAGYDVHWYQQLPGTAPKLLIYENNKRPSGIPDRFSGSKSGTSATLGITGLQTGDEADYYCGTWDNSLSTGGVFGTGTKVTVL

SEQ ID NO: 1480 - protein, 111 aa, Artificial Sequence
  anti-HIV-1_LightChain
QSVLTQPPSLSAAPGQRITISCSGSSSNIGNNYVSWYQQFPGTAPKLLIYENNKRPSGIPDRFSASKSGTSATLGITGLQTGDEANYYCGTWHSSLSAGGVFGTGTKVTVL

SEQ ID NO: 1481 - protein, 111 aa, Artificial Sequence
  anti-HIV-1_LightChain
QSVLTQPPSVSAAPGQRVTISCFGSRFNVGTSSVSWYQQLPGTAPKLLIDANGERPSGIPDRFSGSKSGTSATLGITGLQTGDEADYYCGTWDSSLSAGGVFGTGTKVTVL

SEQ ID NO: 1482 - protein, 111 aa, Artificial Sequence
  anti-HIV-1_LightChain
QSVLTQPPSVSATPGQKVTISCSGSRSNIGSHYVSWYQQFPGTAPKLLIYDNNKRPSGIPDRFSGSKSGTSATLGITGLQTGDEADYYCGTWHSSLSAGGVFGTGTKVTVL

SEQ ID NO: 1483 - protein, 111 aa, Artificial Sequence
  anti-HIV-1_LightChain
QSVLTQPPSASGTPGQRVTISCSGSSSNIGSNHVYWYQQLPGKTPKLLIYRNNQRPSGIPDRFSGSKSGTSATLGITGLQTGDEADYYCGTWDSSLSTGGVFGTGTKVTVL

SEQ ID NO: 1484 - protein, 111 aa, Artificial Sequence
  anti-HIV-1_LightChain
QSVLTQPPSVSAAPGQKVTISCSGSSANIGNNYVSWYQQFPGTGPRLIIYESNKRPSGISDRFSGSQSDAAATLDITGLQTGDEADYYCGTWDSSLSAGGVFGTGTRVTVL

SEQ ID NO: 1485 - protein, 112 aa, Artificial Sequence
  anti-HIV-1_LightChain
QSVLTQPPSVSGAPGQTVTISCTGDTSNIGADYRVHWYQQLPGTAPKLLIYENNKRPSGIPDRFSGSKSGTSATLGITGLQTGDEADYYCGTWDNSLSTGGVFGTGTKVTVL

SEQ ID NO: 1486 - protein, 111 aa, Artificial Sequence
  anti-HIV-1_LightChain
QSVLTQPPSLSAAPGQRVTVSCSGSSSNIGNNYVSWYQQLPGAAPKLLIYNNNIRPSGIPERFSGSKSGTSATLGITGLQTGDEGDYYCGTWDRSLSAGGVFGTGTKVTVL

SEQ ID NO: 1487 - protein, 111 aa, Artificial Sequence
  anti-HIV-1_LightChain
QSVLTQPPSASGTPGQRVTISCSGSSSNIGGNYVSWYQQLPGTAPKLLISENNKRPSGIPDRFSGSKSGTSATLGITGLQTGDEADYYCGTWDSSLSAGGVFGTGTKVTVL

SEQ ID NO: 1488 - protein, 111 aa, Artificial Sequence
  anti-HIV-1_LightChain
QSLLTQPPSVSAAPGQKVTISCSGSSSNIGNNFVSWYQQLPGTAPKLLIYENNMRPSGIPDRFSGSKSGTSATLGITGLQTGDEADYYCGTWDSSLSAGGVFGTGTKVTVL

SEQ ID NO: 1489 - protein, 111 aa, Artificial Sequence
  anti-HIV-1_LightChain
QSVLTQPPSVSAAPGQKVTISCSGTSSNIANYYVSWYRQLPGTAPKLLIYENNKRPSGIPDRFSGSKSGTSATLGITGLQTGDEADYYCGTWDSSLSAGGVFGTGTKVTVL

SEQ ID NO: 1490 - protein, 111 aa, Artificial Sequence
  anti-HIV-1_LightChain
QPVLTQPPSVSGAPGQRVTISCSGSSSNIGNNDVSWYQQVPGTAPKLLIYENNKRPSGIPDRFSGSKSGTSATLGITGLQTGDEADYYCGTWDTSLSAGGVFGTGTKVTVL

SEQ ID NO: 1491 - protein, 111 aa, Artificial Sequence
  anti-HIV-1_LightChain
QLVLTQPPSVSAAPGQRVTISCFGSRFNVGTSSVSWYQQLPGTAPKLLIDANGERPSGIPDRFFGSESGTSATLGITGLQTGDEADYYCGTWHSSLSAGGVFGTGTKVTVL

SEQ ID NO: 1492 - protein, 111 aa, Artificial Sequence
  anti-HIV-1_LightChain
SYELTQPPSVSAAPGQKVTISCSGSSSNIGNNYVSWYQQLPGTAPKLLIYENNKRPSGIPDRFSGSKSGTSATLGITGLQTGDEADYYCGTWDTSLSAGGVFGTGTKVTVL

SEQ ID NO: 1493 - protein, 111 aa, Artificial Sequence
  anti-HIV-1_LightChain
QSVLTQPPSASGTPGQRVTISCSGSTSNIGTYYVSWYQQLPGTAPKLLIYENTKRPSGIPDRFSGSKSGTSATLGITGLQTGDEGDYYCGTWDRSLSAGGVFGTGTKVTVL

SEQ ID NO: 1494 - protein, 112 aa, Artificial Sequence
  anti-HIV-1_LightChain
QSALTQPASVSASPGQSIAISCTGTSSDVGSYNYVSWYQQLPGTAPKLLIYENTKRPSGIPDRFSGSKSGTSATLGITGLQTGDEADYYCGTWDRSLSAGGVFGTGTKVTVL

SEQ ID NO: 1495 - protein, 110 aa, Artificial Sequence
  anti-HIV-1_LightChain
QSVLTQPPSVSAAPGQRVTISCSGGSSNIGNNHVSWYQHLPGRAPQLLIYDTTQRPSGIPDRFSGSKSGTSATLGITGLQTGDEADYYCGTWDSSLSTGGVFGTGTKVTV

SEQ ID NO: 1496 - protein, 111 aa, Artificial Sequence
  anti-HIV-1_LightChain
QSVLTQPPSASGTPGQRVTISCSGSSSNIGSKYVCWYQQLPGTAPKLLIYRNNQRPSGIPDRFSGSKSGTSATLGITGLQTGDEADYYCGTWHSSLSAGGVFGTGTKVTVL

SEQ ID NO: 1497 - protein, 111 aa, Artificial Sequence
  anti-HIV-1_LightChain
QSVLTQPPSVSAAPGQKVTISCSGDSSTFENDYVCWYQQLPGTAPKLLIYDNNKRPSGIPDRFSGSKSGTSATLGITGLQTGDEADYYCGTWHSSLSAGGVFGTGTKVTVL

SEQ ID NO: 1498 - protein, 111 aa, Artificial Sequence
  anti-HIV-1_LightChain
QSVLTQPPSVSAAPGQKVTISCSGSSSNIGNNYVSWYQQLPGTAPKLLIYGNSNRPSGVPDRFSGSKSGTSASLAITGLQAEDEADYYCGTWDSSLSAGGVFGTGTKVTVL

SEQ ID NO: 1499 - protein, 111 aa, Artificial Sequence
  anti-HIV-1_LightChain
QSVLTQPPSVSAAPGQTVTISCSGSSSNIGSNTVNWYQQLPGTAPKLLIYENNKRPSGIPDRFSGSKSGTSATLGITGLQTGDEADYYCGTWDNSLSTGGVFGTGTKVTVL

SEQ ID NO: 1500 - protein, 112 aa, Artificial Sequence
  anti-HIV-1_LightChain
QSVLTQPPSVSGAPGQRVTIFCTGSSSNVGGGYDVHWYQQLPGTAPKLLIYENNKRPSGIPDRFSGSKSGTSATLGITGLQTGDEADYYCGTWDSSLSAGGVFGTGTKVTVL

SEQ ID NO: 1501 - protein, 111 aa, Artificial Sequence
  anti-HIV-1_LightChain
QSVLTQPPSVSAAPGQKVTLSCSGSSSNIGNNSVSWYQQFPGTAPKLLIYDSDKRPSGIPDRFSGSKSGTSATLGITGLQTGDEGDYYCGTWDRSLSAGGVFGTGTKVTVL

SEQ ID NO: 1502 - protein, 111 aa, Artificial Sequence
  anti-HIV-1_LightChain
QSVLTQPPSASGTPGQKVTISCSGSSSQIGSNSVYWYQQLPGTTPKLLIYGNNQRPSGIPDRFSGSKSGTSATLGITGLQTGDEADYYCGTWDSSLSAGGVFGTGTKVTVL

SEQ ID NO: 1503 - protein, 112 aa, Artificial Sequence
  anti-HIV-1_LightChain
QSALTQPASVSGSPGQSITISCTGTGSDVGGYNHVSWYQQHPGKAPKLLIYDNNKRPSGIPDRFSGSKSGTSATLGITGLQTGDEADYYCGTWHSSLSAGGVFGTGTKVTVL

SEQ ID NO: 1504 - protein, 111 aa, Artificial Sequence
  anti-HIV-1_LightChain
QSVLTQPPSVSAAPGQRVTISCSGSGSNIGDRFVSWYQHLPGTVPKLLIYDNEHRPSGIPDRFSGSKSGTSATLGITGLQTGDEADYYCGTWDSSLSAGGVFGTGTKVTVL

SEQ ID NO: 1505 - protein, 111 aa, Artificial Sequence
  anti-HIV-1_LightChain
QSVLTQPPSVSAAPGQKITISCSGSSSNIGKSVVSWYRQFPGTAPKLLIYDTYKRPSGIPDRFSGSKSGTSATLGITGLQTGDEADYYCGTWHSSLSAGGVFGTGTKVTVL

SEQ ID NO: 1506 - protein, 111 aa, Artificial Sequence
  anti-HIV-1_LightChain
QPVLTQPPSASGTPGQRVTISCSGSSSNIGGNTVNWYQQFPGAAPRLLIYEDNKRPSGIPDRFSGSKSGTSATLGITGLQTGDEADYYCGTWDSSLSAGGVFGTGTKVTVL

SEQ ID NO: 1507 - protein, 111 aa, Artificial Sequence
  anti-HIV-1_LightChain
NFMLTQPHSVSESPGKTVTISCTRSSGSVASNYVQWYQQLPGTAPKLLIYENNKRPSGIPDRFSGSKSGTSATLGITGLQTGDEADYYCGTWHSSLSAGGVFGTGTKVTVL

SEQ ID NO: 1508 - protein, 111 aa, Artificial Sequence
  anti-HIV-1_LightChain
QSMLTQPPSVSAAPGQRVTVSCSGSSSNIGSHFVSWYQQLPGTAPKLLIYDNSNRPSAIPDRFSGSKSGTSATLGISGLHTGDEADYYCATWDNSLSTGGVFGTGTKVTVL

SEQ ID NO: 1509 - protein, 111 aa, Artificial Sequence
  anti-HIV-1_LightChain
QSVLTQPPSVSAAPGQKVIISCSGGSSNIGNNFVSWYHQLPGTAPKLLIYENTKRPSKIPARFSGSKSGTSATLGITGLQTGDEADYYCGTWDSSLSAGGVFGTGTKVTVL

SEQ ID NO: 1510 - protein, 105 aa, Artificial Sequence
  anti-HIV-1_LightChain
QSLLTQPPSVSAAPGQKVTISCSGSSSNIGNNYVSWYQQLPGTAPKLLIYENNKRPSGIPDRFSGSKSGTSATLGITGLQTGDEADYYCGTWDSSLSAGGVFGTG

SEQ ID NO: 1511 - protein, 112 aa, Artificial Sequence
  anti-HIV-1_LightChain
QSALTQPASVSGSPGQSITISCTGTSSDIGSYSFVSWYQQHPGKAPKLIIYDVNKRPSGIPDRFSGSKSGTSATLGITGLQTGDEADYYCGTWDRSLSAGGVFGTGTKVTVL

SEQ ID NO: 1512 - protein, 112 aa, Artificial Sequence
  anti-HIV-1_LightChain
QSVLTQPPSVSGAPGQRVTISCTGNSSNIGAGFDVHWYRHLPGTAPKLLIYENTKRPSGIPDRFSGSKSGTSATLGITGLQTGDEADYYCGTWDRSLSAGGVFGTGTKVTVL

SEQ ID NO: 1513 - protein, 111 aa, Artificial Sequence
  anti-HIV-1_LightChain
QSVLTQPPSVSAAPGQKVTISCSGGSSNIGNYYVSWYLQLPGAAPKLLIYDTDKRPSGIPDRFSGSKSGTSATLGITGLQTGDEADYYCGTWDRSLSAGGVFGTGTKVTVL

SEQ ID NO: 1514 - protein, 111 aa, Artificial Sequence
  anti-HIV-1_LightChain
QSVLTRPPSVSAAPGQKVTISCSGRSSNIGNNYVSWYQQLPGAAPKLLIYENNKRPSGIPDRFSGSKSGTSATLGITGLQTGDEADYYCGTWDSSLSAGGVFGTGTKVTVL

SEQ ID NO: 1515 - protein, 111 aa, Artificial Sequence
  anti-HIV-1_LightChain
QSVLTQPPSVSAAPGQKVTISCSGTISNIGANLVSWYRQLPGTVPTVLIHENNKRPSGIPDRFSGSKSGTSATLGITGLQTGDEADYYCGTWHSSLSAGGVFGTGTKVTVL

SEQ ID NO: 1516 - protein, 109 aa, Artificial Sequence
  anti-HIV-1_LightChain
QSVLTQPPSVSAAPGQKVTISCSGSSSNIGNNFVSWYQQLPGTAPKLLIYENTKRPSGIPDRFSGSKSGTSATLGITGLQTGDEADYYCGTWDRSLSAGGVFGTGTKVT

SEQ ID NO: 1517 - protein, 111 aa, Artificial Sequence
  anti-HIV-1_LightChain
QSVLTQSPSVSAAPGQRVTISCSGGSSNIGSNAVSWYQQLPGTAPKLLIYGDTMRPSGIPDRFSGSKSGTSATLGITGLQTGDEADYYCGTWDRSLSAGGVFGTGTKVTVL

SEQ ID NO: 1518 - protein, 111 aa, Artificial Sequence
  anti-HIV-1_LightChain
QSVLTQPPSVSAAPGQQVTISCSGTTSNIGTNYVSWYQQMPPAAPKLLIYDNKKRPSDIPDRFSGSKSGTSATLGITGLQTGDEADYYCGTWDRSLSAGGVFGTGTKVTVL

SEQ ID NO: 1519 - protein, 111 aa, Artificial Sequence
  anti-HIV-1_LightChain
QSVVTQSPSASGTPGQRVIISCSGSSSNIGNIYVSWYQQLPGTAPKLLIYENNKRPSGIPDRFSGSKSGTSATLGITGLQTGDEADYYCGTWHSSLSAGGVFGTGTKVTVL

SEQ ID NO: 1520 - protein, 111 aa, Artificial Sequence
  anti-HIV-1_LightChain
QSVLTQPPSMSAAPGQKVTISCSGSTSIIGNNYISWYQQLPGTAPKLLIYEDNKRPSGIPDRFSGSKSGTSATLGITGLQTGDEADYYCGTWDRSLSAGGVFGTGTKVTVL

SEQ ID NO: 1521 - protein, 112 aa, Artificial Sequence
  anti-HIV-1_LightChain
QSALTQPPSASGSRGQSVIISCTGTSSDVGVYNLVSWYQQLPGTAPKLLIYENNKRPSGIPDRFSGSKSGTSATLGITGLQTGDEADYYCGTWHSSLSAGGVFGTGTKVTVL

SEQ ID NO: 1522 - protein, 111 aa, Artificial Sequence
  anti-HIV-1_LightChain
QSVLTQPPSMSAAPGQSVSISCSGSSDNIERNQVIWLRQVPGAAPTVLIIFNNRRPSGVPDRFSGSRSGTSATLGITGLQTGDEADYYCGTWDRSLSAGGVFGTGTKVTVL

SEQ ID NO: 1523 - protein, 111 aa, Artificial Sequence
  anti-HIV-1_LightChain
QSVLTQPPSVSAAPGQTVTISCSGSFSNIETNYVSWYQQLPGTAPKLLIYENTKRPSGIPDRFSGSKSGTSATLGITGLQTGDEADYYCGTWDRSLSAGGVFGTGTKVTVL

SEQ ID NO: 1524 - protein, 111 aa, Artificial Sequence
  anti-HIV-1_LightChain
QSLLTQPPSVSAAPGQKVTISCSGSSSNIGSKYVCWYQQLPGTAPKLLIYENTKRPSGIPDRFSGSKSGTSATLGITGLQTGDEADYYCGTWDRSLSAGGVFGTGTKVTVL

SEQ ID NO: 1525 - protein, 112 aa, Artificial Sequence
  anti-HIV-1_LightChain
QSALTQPRSVSGSPGQSVTISCTGTTSDVGGYNYVSWYQQLPGTAPKLLIYENNKRPSGIPDRFSGSKSGTSATLGITGLQTGDEADYYCGTWDNSLSTGGVFGTGTKVTVL

SEQ ID NO: 1526 - protein, 111 aa, Artificial Sequence
  anti-HIV-1_LightChain
QSVLTQPPSVSAAPGQRVTISCTGFTSNIGLNYVSWYQQVPGTTPKLVIFENDRRFLGIPDRFSGSKSGASATLGITGLQTGDEADYYCGTWDSSLSAGGVFGTGTKVTVL

SEQ ID NO: 1527 - protein, 111 aa, Artificial Sequence
  anti-HIV-1_LightChain
QSVLAQPPSVSAAPGQKVTISCSGRTSNIGNNYVSWYQQLPGTAPKLLIYENNKRPSGIPDRFSGSKSGTSATLGITGLQTGDEADYYCGTWDTSLSAGGVFGTGTKVTVL

SEQ ID NO: 1528 - protein, 111 aa, Artificial Sequence
  anti-HIV-1_LightChain
QSVLTQPTSVSAAPGRWVTVSCSGTRSNIGDHSVSWFQHLPGAAPKLLIYENNKRPSGIPDRFSGSKSGTSATLGITGLQTGDEADYYCGTWDSSLSTGGVFGTGTKVTVL

SEQ ID NO: 1529 - protein, 111 aa, Artificial Sequence
  anti-HIV-1_LightChain
QSVLTQPPSVSAAPGQKVTISCSGSSSNIGDNYVSWYQQFPGTAPKLLISENNKRPSGIPDRFSGSKSGTSATLGITGLQTGDEADYYCGTWDSSLSAGGVFGTGTKVTVL

SEQ ID NO: 1530 - protein, 111 aa, Artificial Sequence
  anti-HIV-1_LightChain
QALLTQPPSVSAAPGQKVTISCSGSSSNIGNNYVSWYQQLPGTAPKLLISENNKRPSGIPDRFSGSKSGTSATLGITGLQTGDEADYYCGTWDTSLSAGGVFGTGTKVTVL

SEQ ID NO: 1531 - protein, 111 aa, Artificial Sequence
  anti-HIV-1_LightChain
QLVLTQPPSASGTPGQRVTISCSGSTSNIGTYYVYWYQLLPGTTPKVLIYANDQRPSGIPDRFSGSKSGTSATLGITGLQTGDEADYYCGTWDSSLSTGGVFGTGTKVTVL

SEQ ID NO: 1532 - protein, 111 aa, Artificial Sequence
  anti-HIV-1_LightChain
QSVLTQPPSVSAAPGQKVTISCSGTSSNIGNNFVSWYQRLPGTAPKLLIFENDKRPSGIPDRFSGSKSGTSATLGITGLQTGDEADYYCGTWDRSLSAGGVFGTGTKVTVL

SEQ ID NO: 1533 - protein, 111 aa, Artificial Sequence
  anti-HIV-1_LightChain
QSVLTQSPSVSATPGQRVTISCSGNTSNIGKNFVSWYQQFPGTAPKLLIYDNDKRPSGIPDRFSGSKSGTSATLGITGLQTGDEADYYCGTWDSSLSAGGVFGTGTKVTVL

SEQ ID NO: 1534 - protein, 111 aa, Artificial Sequence
  anti-HIV-1_LightChain
QSVLTQPPSVSAAPGREVIISCSGSSSNIGNNHVSWYQQLPGTAPKVLIYESNKRHSGIPDRFSGSKSGTSATLAITGLQTGDEADYYCGAWDSSLSAGGVFGTGTKVTVL

SEQ ID NO: 1535 - protein, 111 aa, Artificial Sequence
  anti-HIV-1_LightChain
QSVLTQPPSASGTPGQRVTISCSGSSSNIGDSTVNWYQQLPGTAPKLLIYENTKRPSGIPDRFSGSKSGTSATLGITGLQTGDEADYYCGTWDRSLSAGGVFGTGTKVTVL

SEQ ID NO: 1536 - protein, 111 aa, Artificial Sequence
  anti-HIV-1_LightChain
QSVLTQPPSVSAAPGQKVTISCSGSTSNIGNNYVSWYQQLPGTAPKLLIYENNRQPSGIPDRFSGSKSGTSATLGITGLQTGDEGDYYCGTWDRSLSAGGVFGTGTKVTVL

SEQ ID NO: 1537 - protein, 111 aa, Artificial Sequence
  anti-HIV-1_LightChain
QSVLTQPPSVSAAPGQKVTISCSGSSSNIGSNYVSWYQQLPGTAPKLLIYENNKRPSGIPDRFSGSKSGTSATLGITGLQTGDEAVYYCGTWDSSLTAGGVFGSGTKVTVL

SEQ ID NO: 1538 - protein, 112 aa, Artificial Sequence
  anti-HIV-1_LightChain
QSVLTQPPSVSGAPGQRVTISCIGSSSNIGADYRVHWYQQLPGTAPKLLIYENNKRPSGIPDRFSGSKSGTSATLGITGLQTGDEADYYCGTWDSSLSTGGVFGTGTKVTVL

SEQ ID NO: 1539 - protein, 112 aa, Artificial Sequence
  anti-HIV-1_LightChain
QSVLTQPPSVSGAPGQRITVSCTGTSSNIGAPYDVNWYQQLPGTAPKLLIYENTKRPSGIPDRFSGSKSGTSATLGITGLQTGDEADYYCGTWDRSLSAGGVFGTGTKVTVL

SEQ ID NO: 1540 - protein, 111 aa, Artificial Sequence
  anti-HIV-1_LightChain
QSVLTQPPAMSAAPGQSVTISCSGSAFNIERHQVTWLRHLPGTAPTSVIIMNNQRPSGVPDRFSGSRSGTSATLGITGLQTGDEGDYYCGTWDRSLSAGGVFGTGTKVTVL

SEQ ID NO: 1541 - protein, 111 aa, Artificial Sequence
  anti-HIV-1_LightChain
QSVLAQPPSASGTPGQRVTISCSGSASNIGFNSVTWYQQLPGTAPTVLIYGNDLRPSGIPDRFSGSKSGTSATLGITGLQTGDEGDYYCGTWDRSLSAGGVFGTGTKVTVL

SEQ ID NO: 1542 - protein, 112 aa, Artificial Sequence
  anti-HIV-1_LightChain
QSALTQPASVSGSPGESITISCTGTRSDIGNYAYVSWYQQLPGTAPKLLISENNKRPSGIPDRFSGSKSGTSATLGITGLQTGDEADYYCGTWDSSLSAGGVFGTGTKVTVL

SEQ ID NO: 1543 - protein, 111 aa, Artificial Sequence
  anti-HIV-1_LightChain
QSVLTQPPSVSAPPGQKVTISCSGTTSNIGSNYVAWYQQLPGTAPKLLIYDNDKRPSGIPDRFSGSKSGTSATLGITGLQTGDEADYYCGTWDRSLSAGGVFGTGTKVTVL

SEQ ID NO: 1544 - protein, 111 aa, Artificial Sequence
  anti-HIV-1_LightChain
QSVLTQSPSVSGTPGQRVTIFCSGSDSDIGINSVSWYQQLPGTAPKLLIYDNNKRPSGIPDRFSGSKSGTSATLGITGLQTGDEADYYCGTWDRSLSAGGVFGTGTKVTVL

SEQ ID NO: 1545 - protein, 111 aa, Artificial Sequence
  anti-HIV-1_LightChain
QSVLTQPPSVSAAPGQKVTISCSGNSSNIGNNYVSWYQHLPGTAPKLLIYENTKRPSGIPDRFSGSKSGTSATLGITGLQTGDEADYYCGTWDRSLSAGGVFGTGTKVTVL

SEQ ID NO: 1546 - protein, 111 aa, Artificial Sequence
  anti-HIV-1_LightChain
QSLLTQPPSVSAAPGQKVTISCSGGNSDIGKNFVSWYQQLPGTAPKLLIYENNKRPSGIPDRFSGSKSGTSATLGITGLQTGDEADYYCGTWDNSLSTGGVFGTGTKVTVL

SEQ ID NO: 1547 - protein, 111 aa, Artificial Sequence
  anti-HIV-1_LightChain
QSVLTQPPSVSAAPGQKVIISCSGSSSNIGKNYVAWYQQLPGTAPKLLVYENTNRPSGIPDRFSGSKSGTSATLGITGLQTGDEADYYCGTWDSSLSAGGVFGTGTKVTVL

SEQ ID NO: 1548 - protein, 111 aa, Artificial Sequence
  anti-HIV-1_LightChain
QSVLTQPPSVSAAPGQKVTISCSGSMSDIGLNPVSWYRQLPEAPPHLLIFDNDERPSGTAGRFSASKSGTSATLDITGLQTGDEADYYCGTWDSSLSAGGVFGTGTKVTVL

SEQ ID NO: 1549 - protein, 112 aa, Artificial Sequence
  anti-HIV-1_LightChain
QSALTQPASVSGSPGQSITISCTGTSSDVGSYNLVSWYQQYPGRAPKLLIYENNKRPSGIPDRFSGSKSGTSATLGITGLQTGDEADYYCGTWDNSLSTGGVFGTGTKVTVL

SEQ ID NO: 1550 - protein, 111 aa, Artificial Sequence
  anti-HIV-1_LightChain
QSLLTQPPSVSASPGQKVTISCSGTSSNIGNNYVSWYQQFPGTAPKLLIYENNKRSSGIPDRFSGSKSDTSATLGITGLQTGDEADYYCGTWDRSLSAGGVFGTGTKVTVL

SEQ ID NO: 1551 - protein, 112 aa, Artificial Sequence
  anti-HIV-1_LightChain
QSVLTQPPSVSGAPGQRVTISCTGRRSNIGAGYDVHWYQQLPGTAPKLLIYENNKRPSGIPDRFSGSKSGTSATLGITGLQTGDEADYYCGTWDTSLSAGGVFGTGTKVTVL

SEQ ID NO: 1552 - protein, 111 aa, Artificial Sequence
  anti-HIV-1_LightChain
QSVLTQPPSVSAAPGQRVTISCSGSSSNIGNNFVSWYQFFPGTAPKLVIYENDKRPSGTPDRFSGSKSGTSATLAIIGLQTGDEGDYYCGTWDNSLSTGGVFGTGTKVTVL

SEQ ID NO: 1553 - protein, 111 aa, Artificial Sequence
  anti-HIV-1_LightChain
QSVLTQPPSVSAAPGQRVTISCSGGSSNIGNNHVSWYQQLPGTAPKLLISENNKRPSGIPDRFSGSKSGTSATLGITGLQTGDEADYYCGTWDSSLSAGGVFGTGTKVTVL

SEQ ID NO: 1554 - protein, 111 aa, Artificial Sequence
  anti-HIV-1_LightChain
QSVLTQPPSVSAAPGQKVTISCSGSSSNIGRDFVSWYQQVPGTAPKLLIYDNDKRPSGIPDRFSGSKSGTSATLGITGLQTGDEADYYCGTWDSSLSAGGVFGTGTKVTVL

SEQ ID NO: 1555 - protein, 112 aa, Artificial Sequence
  anti-HIV-1_LightChain
QTVVTQPPSVSGAPGQTATISCTGSSSNIGADYDVHWYQQLPGTAPKLLIYDNNKRPSGIPDRFSGSKSGTSATLGITGLQTGDEADYYCGTWDRSLSAGGVFGTGTKVTVL

SEQ ID NO: 1556 - protein, 111 aa, Artificial Sequence
  anti-HIV-1_LightChain
NFMLTQPPSASGTPGQRVTISCSGSSSNIGSNYVYWYQQLPGTTPKLLIYRNNQRPSGIPDRFSGSKSGTSATLGITGLQTGDEADYYCGTWDSSLSAGGVFGTGTKVTVL

SEQ ID NO: 1557 - protein, 111 aa, Artificial Sequence
  anti-HIV-1_LightChain
QSVLTQPPSVSAAPGQKVTISCSGSSPNIGNNFLSWYQQLPGTAPKLLIYENTKRPSGIPDRFSGSKSGTSATLGITGLQTGDEADYYCGTWDRSLSAGGVFGTGTKVTVL

SEQ ID NO: 1558 - protein, 111 aa, Artificial Sequence
  anti-HIV-1_LightChain
QSVLTQSPSVSAAPGQKVTISCSGSSSDIGNNFVSWYQQLPGTAPKLLIYENNKRPSGIPDRFSGSKSGTSATLGITGLQTGDEADYYCGTWDSSLSAGGVFGTGTKVTVL

SEQ ID NO: 1559 - protein, 111 aa, Artificial Sequence
  anti-HIV-1_LightChain
QFFLTQPPSLSATPGQRVSISCSGGGSNIANNDVFWFQQFPGAGPRLLIYDNLKRHYGTPDRFSGSKSGTSATLGITGLQTGDEADYYCGTWDNSLSTGGVFGTGTKVTVL

SEQ ID NO: 1560 - protein, 111 aa, Artificial Sequence
  anti-HIV-1_LightChain
QSVLTQPPSVSAAPGQKVTISCSGSGPNIGSNSVSWYQHFPGTAPKLLIYDNNKRPSGIPDRFSGSKSGTSATLGITGLQTGDEADYYCGTWDRSLSAGGVFGTGTKVTVL

SEQ ID NO: 1561 - protein, 111 aa, Artificial Sequence
  anti-HIV-1_LightChain
QSVLTQSPSASGTPGQRVTISCSGSSSNIGSNTVSWFQHLPGTAPKLLIYENNKRPSGIPDRFSGSKSGTSATLGITGLQTGDEADYYCGTWHSSLSAGGVFGTGTKVTVL

SEQ ID NO: 1562 - protein, 111 aa, Artificial Sequence
  anti-HIV-1_LightChain
QSVLTQPPSVSGAPGQNVIISCSGSSSNIGKNYVAWYQQLPGTAPKIVIYETTNRPSGIPARFSGSKSGTSATLGITGLQAGDEADYYCGTWDSSLNAGGVFGTGTKVTVL

SEQ ID NO: 1563 - protein, 111 aa, Artificial Sequence
  anti-HIV-1_LightChain
QSVLTQPPSVSAAPGQKVTISCSGSSSNIGNNFLSWYQHLPGTAPRLLIYDNDQRPSGIPDRFSGSKSGTSATLGITGLQTGDEADYYCGTWHSSLSAGGVFGTGTKVTVL

SEQ ID NO: 1564 - protein, 111 aa, Artificial Sequence
  anti-HIV-1_LightChain
QSVLTQPPSASGTPGQKVTISCSGSSSNIGNNYVSWYQQLPGTAPKLLIYENNKRPSGIPDRFSGSKSGTSATLGITGLQTGDEADYYCGTWDSSLSTGGVFGTGTKVTVL

SEQ ID NO: 1565 - protein, 111 aa, Artificial Sequence
  anti-HIV-1_LightChain
QSVLTQPPSVSAAPGQKVTISCSGTTSNIGNHYVSWYQQFPGTAPKLIIYETDRRPSGIPARFSGSKSGTSATLAIAGLQTGDEADYYCGTWDSSLSTGGVFGTGTKVTVL

SEQ ID NO: 1566 - protein, 111 aa, Artificial Sequence
  anti-HIV-1_LightChain
QLVLTQPPSVSAAPGQKVTISCSGSSSNIGNNYVSWYQQLPGTAPKLLIYENNKRPSGIPDRFSGSKSGTSATLGITGLQTGDEADYYCGTWDSSLSTGGVFGTGTKVTVL

SEQ ID NO: 1567 - protein, 111 aa, Artificial Sequence
  anti-HIV-1_LightChain
QSVLTQPPSVSAAPGQRVTISCSGGSSNIGNNHVSWYQHLPGRAPQLLIYDTTQRPSRIPDRFSGSKSGTSATLGITGLQTGDEADYYCGTWDNSLSTGGVFGTGTKVTVL

SEQ ID NO: 1568 - protein, 111 aa, Artificial Sequence
  anti-HIV-1_LightChain
QSVLTQPPSVSAAPGQKITISCSGSRSNIGNNYVSWYQQFPGTAPKLLIYDNNQRPSRIPDRFSGSKSGTSATLGITGLQTGDEADYYCGTWDSSLSAGGVFGTGTKVTVL

SEQ ID NO: 1569 - protein, 107 aa, Artificial Sequence
  anti-HIV-1_LightChain
QSVLTQPPSVSAAPGQRVTISCFGSRFSSVSWYQQLPGTAPKLLIYPNGERPSGIPDRFFGSESGTSATLGITGLQTGDEADYYCATWDSSLSAGGVFGTGTKLTVL

SEQ ID NO: 1570 - protein, 111 aa, Artificial Sequence
  anti-HIV-1_LightChain
QSVLTQPPSLSAAPGQKVTISCSGSSLNIGNHYVSWYQQVPGTAPKLLIYEDNKRPSGIPDRFSGSKSGTSATLGITGLQTGDEADYYCGTWHSSLSAGGVFGTGTKVTVL

SEQ ID NO: 1571 - protein, 111 aa, Artificial Sequence
  anti-HIV-1_LightChain
QFVLTQPPSVSAAPGQKVTVSCSGTTSDIGENYVSWYQKFPEAAPKLLIYDNDKRPSGIPDRFSGSKSGTSATLGITGLQTGDEADYYCGTWDRSLSAGGVFGTGTKVTVL

SEQ ID NO: 1572 - protein, 111 aa, Artificial Sequence
  anti-HIV-1_LightChain
LSVLTQPPSVSAAPGQQVTISCSGTTSNIGTNYVSWYQQMPPTAPKLLIYENNKRPSGIPDRFSGSKSGTSATLGITGLQTGDEADYYCGTWDSSLSAGGVFGTGTKVTVL

SEQ ID NO: 1573 - protein, 112 aa, Artificial Sequence
  anti-HIV-1_LightChain
QSMLTQPPSVSGAPGQRVTISCTGSRSNIGAGYDVHWYLQLPGTAPKLLIYENNKRPSGIPDRFSGSKSGTSATLGITGLQTGDEADYYCGTWDNSLSTGGVFGTGTKVTVL

SEQ ID NO: 1574 - protein, 111 aa, Artificial Sequence
  anti-HIV-1_LightChain
QSVLTQPPSVSATPGQKVTISCSGSRSNIGSHYVSWYQQFPESAPTLLIYENVERPSGIPDRFSGSKSGTSATLGITGLQTGDEADYYCGTWDSSLSAGGVFGTGTKVTVL

SEQ ID NO: 1575 - protein, 111 aa, Artificial Sequence
  anti-HIV-1_LightChain
QFFLTQPPSLSATPGQRVSISCSGGGSNIANNDVFWFQQFPGAGPRLLIYDNLKRHYGTPDRFSGSKSGATGTLEITEVQTADEADYYCGTWDSSLSAGGVFGTGTKVTVL

SEQ ID NO: 1576 - protein, 111 aa, Artificial Sequence
  anti-HIV-1_LightChain
QSVLTQPPSVSAAPGQKVTISCSGGSSNIGDNSVSWYQQLPGTAPKLLIYENNKRPSGIPDRFSGSKSGTSATLGITGLQTGDEADYYCGTWDSSLSTGGVFGTGTKVTVL

SEQ ID NO: 1577 - protein, 111 aa, Artificial Sequence
  anti-HIV-1_LightChain
QSVLTQPPSVSAAPGQTVTISCSGSASNIGRNSVSWYQYVPGAAPKRLIYENNKRPSGIPDRFSGSKSGTSATLGITGLQTGDEADYYCGTWDTSLSAGGVFGTGTKVTVL

SEQ ID NO: 1578 - protein, 111 aa, Artificial Sequence
  anti-HIV-1_LightChain
QSVLAQPPSVSAAPGQKVTISCSGRTSNIGNYFVSWYQQFPGTAPRLLIYDNDQRPSGIPDRFSGSKSGTSATLGITGLQTGDEADYYCGTWDSSLSAGGVFGTGTKVTVL

SEQ ID NO: 1579 - protein, 111 aa, Artificial Sequence
  anti-HIV-1_LightChain
QSALTQPASVSAAPGQKVTISCSGSSSNIGNIYVSWYQQLPGTAPKLLIYENNKRPSGIPDRFSGSKSGTSATLGITGLQTGDEADYYCGTWHSSLSAGGVFGTGTKVTVL

SEQ ID NO: 1580 - protein, 111 aa, Artificial Sequence
  anti-HIV-1_LightChain
QSVLTQPPSVSATPGQRVTVSCSGSSSNIGNHYVSWYQQVPGTAPKLLIYDNSNRPSGIPDRFSGSKSGTSATLGITGLQTGDEADYYCGTWDSSLSAGGVFGTGTKVTVL

SEQ ID NO: 1581 - protein, 111 aa, Artificial Sequence
  anti-HIV-1_LightChain
QSVLTQPPSLSAAPGQRVTVSCSGSSSNIGDNYVSWYQQLPGAAPRLLIYDNSIRPSAIPARFSGSKSGTSATLAITGLQTGDEADYYCGTWDSSLSAGGVFGTGTKVTVL

SEQ ID NO: 1582 - protein, 112 aa, Artificial Sequence
  anti-HIV-1_LightChain
QSALTQPASVSGSPGQSITISCTGTSSDVGGYDYVSWYLQLPGTAPKLLIYENNKRPSGIPDRFSGSKSGTSATLGITGLQTGDEADYYCGTWDSSLSAGGVFGTGTKVTVL

SEQ ID NO: 1583 - protein, 111 aa, Artificial Sequence
  anti-HIV-1_LightChain
QSVLTQPPSVSAAPGQRVTVSCSGSSSNIGNNYVSWYQQFPGTAPKLVIYDTDKRPSGIPDRFSGSKSGTSATLGITGLQTGDEADYYCATWDSSLSAGGVFGTGTKVTVL

SEQ ID NO: 1584 - protein, 112 aa, Artificial Sequence
  anti-HIV-1_LightChain
QSVLTQPPSVSGAPGQRVTISCTGNSSNIGAGYDVHWYQQLPGTAPKLLISENNKRPSGIPDRFSGSKSGTSATLGITGLQTGDEADYYCGTWDSSLSAGGVFGTGTKVTVL

SEQ ID NO: 1585 - protein, 111 aa, Artificial Sequence
  anti-HIV-1_LightChain
QSVLTQPPSASGTPGQRVTISCSGSSSNIGSNYVDWYQQLPGTAPKLLIYENNKRPSGIPDRFSGSKSGTSATLGITGLQTGDEADYYCGTWHSSLSAGGVFGTGTKVTVL

SEQ ID NO: 1586 - protein, 111 aa, Artificial Sequence
  anti-HIV-1_LightChain
QSVLTQPPSVSATPGQTVTISCSGSSSNIGNNYLSWYRQLPRTAPKLLIYENNRRPSGVPARFSGSKSGTSATLAITGLQTGDEADYYCGTWDSSLSAGGVFGTGTKVTVL

SEQ ID NO: 1587 - protein, 107 aa, Artificial Sequence
  anti-HIV-1_LightChain
QSVLTQPPSVSAAPGQRVTISCFGSRFSSVSWYQQLPGTAPKLLIYPNGERPSGIPDRFFGSESGTSATLGITAVQTGDEADYYCGTWDDSLSTGGVFGTGTKVTVL

SEQ ID NO: 1588 - protein, 111 aa, Artificial Sequence
  anti-HIV-1_LightChain
QSVLTQPPSVSAAPGQKVTLSCSGTSSNIGNNYVSWYQQVPGAAPKVLIYENDKRPSGIPDRFSGSKSGTSATLGITGLQTGDEADYYCGTWDRSLSAGGVFGTGTKVTVL

SEQ ID NO: 1589 - protein, 111 aa, Artificial Sequence
  anti-HIV-1_LightChain
QSVLTQPPSVSAAPGQKVTISCSGSNSNIGNNYVSWYQQLPGTATKLLIYENDKRPSGIPDRFSGSKSGTSATLGITGLQTGDEADYYCGTWHSSLSAGGVFGTGTKVTVL

SEQ ID NO: 1590 - protein, 111 aa, Artificial Sequence
  anti-HIV-1_LightChain
QSVLTQPPSLSAAPGQQVSISCLGRSSNIGTNYVSWYQQFPGTAPKLLIYENKKRPSEIPDRFSGSKSGTSATLGITGLQPGDEADYYCGTWDSSLSAGGVFGTGTKVTVL

SEQ ID NO: 1591 - protein, 112 aa, Artificial Sequence
  anti-HIV-1_LightChain
QSALTQPPSASGSPGQSVTISCTGTSSDVGAYNSVSWYQQLPGTAPKLLISENNKRPSGIPDRFSGSKSGTSATLGITGLQTGDEADYYCGTWDSSLSAGGVFGTGTKVTVL

SEQ ID NO: 1592 - protein, 111 aa, Artificial Sequence
  anti-HIV-1_LightChain
QSALTQPPSASGSPGQSVTISCSGGSSNIGNNHVSWYQHLPGRAPQLLIYDTTQRPSRIPDRFSGSRSGTSATLAITGLQTGDEAVYYCGTWDNSLSTGGVFGTGTKVTVL

SEQ ID NO: 1593 - protein, 111 aa, Artificial Sequence
  anti-HIV-1_LightChain
QSVLTQPPSVSAAPGQRVTISCSGGTSNIGNEYVSWYQQLPGTAPKLLIYENNKRPSGIPDRFSGSKSGTSATLGITGLQTGDEADYYCGTWDSSLSAGGVFGTGTKVTVL

SEQ ID NO: 1594 - protein, 111 aa, Artificial Sequence
  anti-HIV-1_LightChain
QSVLTQPPSVSAAPGQRVTVSCSGSSSNIGNNYVSWYQQLPGAAPKLLIYDTDKRPSGIPDRFSGSKSGTSATLGITGLQTGDEADYYCGTWDRSLSAGGVFGTGTKVTVL

SEQ ID NO: 1595 - protein, 111 aa, Artificial Sequence
  anti-HIV-1_LightChain
QSLLTQPPSVSAAPGQKVTISCSGGNSDIGKNFVSWYQQSPGAAPRLLIYENDRRPSGIPDRFSGSKSGTSATLGITGLQTGDEADYYCGTWDRSLSAGGVFGTGTKVTVL

SEQ ID NO: 1596 - protein, 111 aa, Artificial Sequence
  anti-HIV-1_LightChain
QSVLTQPPSVSAAPGQKVNISCSGSSSNIGKNYVSWYQQIPGTAPKVLIYENNKRPSGIPDRFSGSKSGTSATLGIAGLQTGDEADYYCATWDSSLSAGGVFGTGTKVTVL

SEQ ID NO: 1597 - protein, 111 aa, Artificial Sequence
  anti-HIV-1_LightChain
QSVLTQPPSVSAAPGQKVTISCSGSSSNIGNRHVSWYQQLPGTVPKLLIYETNKRPSGIPDRFSGSKSGTSATLGITGLQTGDEADYYCGTWDNSLSTGGVFGTGTKVTVL

SEQ ID NO: 1598 - protein, 112 aa, Artificial Sequence
  anti-HIV-1_LightChain
QSVLTQPPSVSGAPGQRVTISCTGSSSNIGAGYDVHWYQQLPGTAPKLLIFGHDKRPSGIPDRFSGSKSGTSATLGITGLQTGDEADYYCGTWDSSLSAGGVFGTGTKVTVL

SEQ ID NO: 1599 - protein, 111 aa, Artificial Sequence
  anti-HIV-1_LightChain
QSVLTQLPSASGLPGQTVTISCSGSTSSIGSNHVYWYQQVAGTAPKLLIYENNKRPSGIPDRFSGSKSGTSATLGITGLQTGDEADYYCATWDSSLSAGGVFGTGTKVTVL

SEQ ID NO: 1600 - protein, 111 aa, Artificial Sequence
  anti-HIV-1_LightChain
QSVLTQTPSASGAPGQGVTISCSGSSSNVGRNYVSWYQQLPGTAPKLLIYENTKRPSGIPDRFSGSKSGTSATLGITGLQTGDEADYYCGTWDRSLSAGGVFGTGTKVTVL

SEQ ID NO: 1601 - protein, 111 aa, Artificial Sequence
  anti-HIV-1_LightChain
QSVLTQPPSVSAAPGQKVTISCSGSSSNIGNNYVSWYQQFPGTAPKLLISDNNKRPSGIPDRFSVSKSGTSATLGITGLQAGDEADYYCGTWDSSLSAGGVFGTGTKVTVL

SEQ ID NO: 1602 - protein, 111 aa, Artificial Sequence
  anti-HIV-1_LightChain
QSVLTQPPSVSAAPGQKVTISCSGSNSNIGNNYVTWYQQFPGTAPKVLIYDNSRRPSGIPDRFSGSKSGTSATLGITGLQTGDEADYYCGTWDSSLSAGGVFGTGTKVTVL

SEQ ID NO: 1603 - protein, 111 aa, Artificial Sequence
  anti-HIV-1_LightChain
QSVLTQPPSVSGAPGQRVTISCSGSSSNIGNNYVSWYQQLPGTAPKLLIYENTKRPSGIPDRFSGSKSGTSATLGITGLQTGDEADYYCGTWDRSLSAGGVFGTGTKVTVL

SEQ ID NO: 1604 - protein, 111 aa, Artificial Sequence
  anti-HIV-1_LightChain
QSVLTQPPSVSAAPGQTVTISCSGSTSNIGQNFLSWFQHVPGTAPKLLIYENNKRPSGIPDRFSGSKSGTSATLGITGLQTGDEADYYCGTWHSSLSAGGVFGTGTKVTVL

SEQ ID NO: 1605 - protein, 111 aa, Artificial Sequence
  anti-HIV-1_LightChain
NFMLTQPPSASGTPGQRVTISCSGSSSNIGSKYVSWYQQLPGTAPKLLIYENTKRPSGIPDRFSGSKSGTSATLGITGLQTGDEADYYCGTWDRSLSAGGVFGTGTKVTVL

SEQ ID NO: 1606 - protein, 111 aa, Artificial Sequence
  anti-HIV-1_LightChain
QSVLTQPPSVSAAPGQKVTISCSGSSSNIGNNYVSWYQLLPGTAPKLLIYENNKRPSGIPDRFSGSKSGTSATLGITGLQTGDEADYYCGTWDNSLSTGGVFGTGTKVTVL

SEQ ID NO: 1607 - protein, 111 aa, Artificial Sequence
  anti-HIV-1_LightChain
QSVLTQPPSVSAAPGQKVTISCSGSSSNIGNNYVSWYQQLPGTAPKIIIYDNNKRPSGIPDRFSGSKSGTSATLGITGLQTGDEADYYCGTWHSSLSAGGVFGTGTKVTVL

SEQ ID NO: 1608 - protein, 111 aa, Artificial Sequence
  anti-HIV-1_LightChain
QSVLTQPPSASATPGQRVTISCSGSSSNIGSKHVYWYQKLPGTAPKLLIYENTKRPSGIPDRFSGSKSGTSATLGITGLQTGDEADYYCGTWDRSLSAGGVFGTGTKVTVL

SEQ ID NO: 1609 - protein, 144 aa, Artificial Sequence
  anti-HIV-1_HeavyChain
QAQLVESGGGVVQPGRSLRLSCAASGFTFSSYGIHWVRQAPGKGLEWVAVMSSDGTYKYYGDSMKGRFTISRDNSKNSLYLQMNSLRAVDTAVYYCAKDLGEGENEEWATDYYDFSIGYPGQDPRGVVGTFDIWGQGTMVTVSS

SEQ ID NO: 1610 - protein, 142 aa, Artificial Sequence
  anti-HIV-1_HeavyChain
QVQLVESGGGVVQPGRSLRLSCAASGFTFSSYGMHWVRQAPGKGLEWVAVISDDGSNKYYADSVKGRFTISRDNSKNTLYLQMNSLRAEDTAVYYCAKDLGESENEEWASDYYDFGSDYPGQDPRAVVGAFWGQGTMVTVSS

SEQ ID NO: 1611 - protein, 144 aa, Artificial Sequence
  anti-HIV-1_HeavyChain
QVQLVESGGGVVQSGRSLRLSCAASGFTFSAYALHWVRQAPGKGLEWVAVISYDGRDKDYADSVKGRFTISRDNSKNTLYLQMNSLRAEDTAVYYCAKDLGESENEEWASDYYDFGSDYPGQDPRAVVGAFDIWGQGTMVTVSS

SEQ ID NO: 1612 - protein, 144 aa, Artificial Sequence
  anti-HIV-1_HeavyChain
QVQLVQSGGGLVQPGRSLRLSCVASGFRFSFHGMHWVRQAPGKGLEWVAVVSDDGSDQKYVDSVKGRLTISRDNSKNTVYLQMNSLRAEDTAVYYCAKDLGESENEEWASDYYDFGSDYPGQDPRAVVGAFDIWGQGTMVTVSS

SEQ ID NO: 1613 - protein, 144 aa, Artificial Sequence
  anti-HIV-1_HeavyChain
EVHLVESGGGVVQPGRSLRLSCAASGFTFNSYAMIWVRQAPGKGLEWVAVISYDGNNKYYADSVKGRFTISRENSKNTLYLQMNSLRAEDTAVYHCAKDLGESENEEWASDYYDFGRDYPGQDPRGVVGTFDIWGHGTMVTVSS

SEQ ID NO: 1614 - protein, 144 aa, Artificial Sequence
  anti-HIV-1_HeavyChain
QVQLVESGGGVVRPGGSLRLSCTASGFHFNKYGMNWVRQAPGKGLALVAFIQSGASYNYYADSVKGRFTISRDNSKNTLYLQMNSLRAEDTAVYYCAKDLGDSENEEWASDYYDFGRDYPGQDPRGVVGAFDIWGHGTMVTVSS

SEQ ID NO: 1615 - protein, 144 aa, Artificial Sequence
  anti-HIV-1_HeavyChain
QVHLVESGGGVVQPGKSLTIYCAVSEFTLSNYAMHWVRLTPGKGLQWVAVISYDGSNKYYADSVKGRFTISRDNSKNTLYLQMNSLRAEDTAVYYCAKDLGESENEEWASDYYDFGRDYPGQDPRGVVGVFDIWGQGTMVTVSS

SEQ ID NO: 1616 - protein, 144 aa, Artificial Sequence
  anti-HIV-1_HeavyChain
EVQLLESGGGVVQPGRSLRLSCAASGFTFSTYALHWVRQAPGKGLEWVAVISYDGSTKFYADSVKGRFTISRDNSKNTLYLQMNSLRAEDTAVYYCAKDLGESENEEWASDYYDFGSDYPGQDPRAVVGAFDIWGQGTMVTVSS

SEQ ID NO: 1617 - protein, 144 aa, Artificial Sequence
  anti-HIV-1_HeavyChain
QVQLVESGGGVVQPGGSLRLSCAASGFTFSSYGMHWVRQAPGKGLEWVAFIRYDGSNKYYADSVKGRFTISRENSKNTLYLQMNSLRAEDTAVYHCAKDLGESEIEEWTSDYYDFGRDYPGQDPRGVFGTFDIWGHGTMVTVSS

SEQ ID NO: 1618 - protein, 144 aa, Artificial Sequence
  anti-HIV-1_HeavyChain
EVQLVESGGGVVKPGGSLRLSCVVSGFTFSNAWMSWVRQAPGKGLEWVAVISDDGSNKYYADSVKGRFTISRDNSKNTLYLQMNSLRAEDTAVYYCAKDLGESENEEWASDYYDFGSDYPGQDPRAVVGAFDIWGQGTMVTVSS

SEQ ID NO: 1619 - protein, 144 aa, Artificial Sequence
  anti-HIV-1_HeavyChain
QVQLVESGGGVVQPGGSLRLSCAASGFTFSTYGMHWVRQAPGKGLEWVAFIRYDGRNKNYADSVKGRFTISRDNSKNTLYLQMNSLRAEDTAVYYCAKDLGESENEEWATDYYDFSIGYPGQDPRGVVGIFDIWGQGTMVTVSS

SEQ ID NO: 1620 - protein, 144 aa, Artificial Sequence
  anti-HIV-1_HeavyChain
QVHLVESGGGVVQPGGSLRLSCAASGFSFSIYGMHWVRQAPGKGLEWVTFTRYDGSNKYYTDSVKGRFTISRDNSKNTLYLQMNSLRTEDTAVYYCAKDLGESENEEWASDYYDFGSDYPGQDPRAVVGAFDIWGQGTMVTVSS

SEQ ID NO: 1621 - protein, 144 aa, Artificial Sequence
  anti-HIV-1_HeavyChain
QVQLVESGGGVVQPGGSLRLSCAASGFTFSSYGMHWVRQAPGKGLEWVAFIRYDGSNKYYADPVKGRFTISRDNSKNTLYLQMNSLRAEDTAVYYCAKDLGESENEEWASDYYDFGRDYPGQDPRGVVGVFDIWGQGTMVTASS

SEQ ID NO: 1622 - protein, 144 aa, Artificial Sequence
  anti-HIV-1_HeavyChain
EMQLVESGGGLVQPGGSLRLSCAASGFTFSSYWMSWVRQAPGKGLEWVAVISYDGNNKYYADSVKGRFTISRENSKNTLYLQMNSLRAEDTAVYYCAKDLGESENEEWASDYYDFGSDYPGQDPRGVVGTFDIWGHGTMVTVSS

SEQ ID NO: 1623 - protein, 144 aa, Artificial Sequence
  anti-HIV-1_HeavyChain
QVQLVESGGGVVQPGRSLRLSCAASGFTFSSCAMHWVRQAPGKGLEWVAVISYDGNNKHYADSVKGRFTISRDNSKNTLYLQMNSLRAEDMAVYYCAKDLGESENEEWASDYYDFWRDYPGQDPRGWVGTFDIWGQGTMVTVSS

SEQ ID NO: 1624 - protein, 144 aa, Artificial Sequence
  anti-HIV-1_HeavyChain
QVQLVESGGGVVQPGRSLRLSCAASGFTFSNYGMHWVRQAPGKGLEWVTVISSDGSKKYYADSVKGRFTISRDNSKNTLYLQMNGLRADDTAVYYCAKDLGDSENEEWASDYYDFGRDYPGQDPRGVVGAFDIWGHGTMVTVSS

SEQ ID NO: 1625 - protein, 144 aa, Artificial Sequence
  anti-HIV-1_HeavyChain
QVQLVESGGGVVQPGGSLRLSCAASGFTFSSYGMHWVRQAPGKGLEWVAFIRYDGSNKYYADSVKGRFTISRDNSKNTLYLQMNSLRAVDTAVYYCAKDLGEGENEEWATDYYDFSIGYPGQDPRGVVGAFDIWGQGTMVTVSS

SEQ ID NO: 1626 - protein, 144 aa, Artificial Sequence
  anti-HIV-1_HeavyChain
QVQLVESGGGVVQPGRSLRLSCAASGFTFRNYGMHWVRQSPGKGLEWVAVISYDGKIINYIDFVKGRFTISRENSKNTLYLQMNSLRAEDTAVYYCAKDLGESENEEWASDYYDFGSDYPGQDPRGVVGTFDIWGHGTMVTVSS

SEQ ID NO: 1627 - protein, 144 aa, Artificial Sequence
  anti-HIV-1_HeavyChain
EVQLLESGGGLVQPGRSLRLSCAASGFTFSSYVMHWVRQAPGKGLEWVAVISYDGSNKHYADSVKGRFTISRDNSKNTLYLQMNSLRAEDTAVYYRAKDLGESENEEWASDYYDFGRDYPGQDPRGVVGVLYIWGQGTMVTVSS

SEQ ID NO: 1628 - protein, 144 aa, Artificial Sequence
  anti-HIV-1_HeavyChain
EVQLVESGGGLVKPGGSLRLSCAASGFTFSTYSMHWVRQAPGKGLEWVAVISYDGNNKYYADSVKGRFTISRENSKNTLYLQMNSLRAEDTAVYHCAKDLGESENEEWASDYYDFGRDYPGQDPRGVVGTFDIWGHGTMVTVSS

SEQ ID NO: 1629 - protein, 144 aa, Artificial Sequence
  anti-HIV-1_HeavyChain
QVQLVDSGGGVVQPGRSLRLFCAVSGFTFSTYTMHWVRQAPGRGLEWVAVISYDGSTKYYADSVQGRFTISRDNSKNTLYLQMNSLRAEDTAVYYCAKDLGESENEEWASDYYDFGSDYPGQDPRAVVGAFDIWGQGTMVTVSS

SEQ ID NO: 1630 - protein, 142 aa, Artificial Sequence
  anti-HIV-1_HeavyChain
QVQLVESGGGVVQPGRSLRLSCAASGFTFSSFGMHWVRQAPGKGLEWVAVISYDGNNKYYADSVKGRFTISRENSKNTLYLQMNSLRPEDTAVYYCAKDLGESENEEWASDYYDFGRDYPGQDPRGVVGTFDIWGHGTMVTV

SEQ ID NO: 1631 - protein, 144 aa, Artificial Sequence
  anti-HIV-1_HeavyChain
QVQLVESGGGVVQPGRSLRLSCAASGFMFSRYGMHWVRQAPGKGLEWVAVISHDGSNKYYADSVKGRFIISRDNSKNTLYLQMNSLRADDTAVYYCAKDLGESENEEWASDYYDFWIGYPGQDPRGVVGAFDIWGQGTMVTVSS

SEQ ID NO: 1632 - protein, 144 aa, Artificial Sequence
  anti-HIV-1_HeavyChain
QVQLVESGGGVVQPGGSLRLSCAASAFTFSSYGMHWVRQAPGKGLEWVAFIRYDGSNKYYADSVKGRFTISRDNSKNTLFLQMNSLRAEDMAVYYCAKDLGESENEEWASDYYDFWRDYPGQDPRGWVGTFDIWGQGTMVTVSS

SEQ ID NO: 1633 - protein, 142 aa, Artificial Sequence
  anti-HIV-1_HeavyChain
QVQLVESGGGVVQPGRSLRLSCAASGFTFSSFGMHWVRQAPGKGLEWVAVISYDGSNKYYVDSVKGRFTISRDNSKNTLYLQMNSLRAEDTAVYAKDLGESENEEWASDYYDFGSDYPGQDPRGVVGTFDIWSQGTMVTVSS

SEQ ID NO: 1634 - protein, 144 aa, Artificial Sequence
  anti-HIV-1_HeavyChain
QVQLVESGGGVVQPGGSLRLSCAASGFTFSTYGMHWVRQAPGKGLDWVAFIRYDGSHKYYADSVKGRFTISRENSKNTLYLQMNSLRPEDTAVYYCAKDLGESENEEWASDYYDFGRDYPGQDPRGVVGTFDIWGHGTMVTVSS

SEQ ID NO: 1635 - protein, 144 aa, Artificial Sequence
  anti-HIV-1_HeavyChain
QVQLVESGGGVVQPGRSLRLSCAASGFTFSSYAMHWVRQAPGKGLEWVAVISYDGSGDYYADSVKGRFTISRDNSKSTLYLQMNSLRPEDTAVYYCAKDLGESENEEWASDYYDFGRDYPGQDPRGVVGTFDIWGHGTMVTVSS

SEQ ID NO: 1636 - protein, 144 aa, Artificial Sequence
  anti-HIV-1_HeavyChain
QVHLVESGGGVVQPGGSLRLSCAASGFTFSTYGMQWVRQAPGKGLEWVAFIKNDGTNEFYGDSVKGRFTISRDNSKNTVSLHMDSLRPEDTALYYCAKDLGESENEEWASDYYDFGSDYPGQDPRAVVGAFDIWGQGTMVTVSS

SEQ ID NO: 1637 - protein, 144 aa, Artificial Sequence
  anti-HIV-1_HeavyChain
QVQLVESGGGVVQPGGSLRLSCVASGFTFSSYGMHWVRQAPGKGLEWVAFIRYDGRNKYYADSVKGRFTISRDKSKNTLCLQMNSLRVEDTAVYYCAKDLGDSENEEWASDYYDFGRDYPGQDPRGVVGAFDIWGHGTMVTVSS

SEQ ID NO: 1638 - protein, 144 aa, Artificial Sequence
  anti-HIV-1_HeavyChain
QVQLVESGGGVVQPGRSLRLSCAASGFTFSSYGMHWVRQAPGKGLEWVAVISYDGSNKYYRDSVKGRFTISRDNSKNTVYLQMNSLRAEDTAVYYCAKDLGESESEEWASDYYDFGRDYPGQDPRGVVGALDIWGQGIMVTVSS

SEQ ID NO: 1639 - protein, 144 aa, Artificial Sequence
  anti-HIV-1_HeavyChain
EVQLVESGGGMVQPGRPLRLSCAASGFIFSGFGLHWVRQAPGKGLEWVASISYDGGNKYYADSVRGRFTISRDNSKNTLYLQMNSLRAEDTAVYYCAKDLGESENEEWASDYYDFGSDYPGQDPRAVVGAFDIWGQGTMVTVSS

SEQ ID NO: 1640 - protein, 144 aa, Artificial Sequence
  anti-HIV-1_HeavyChain
EVQLVESGGGVVRPGGSLRLSCAASGFTFNDYGMAWVRQAPGKGLEWVADISYDGSNKYYADSVKGRFTISRDNSKNTLYLQMNSLRAEDTAVYYCAKDLGESENEEWASDYYDFGRDYPGQDPRGVVGAFDIWGQGTMVTVSS

SEQ ID NO: 1641 - protein, 143 aa, Artificial Sequence
  anti-HIV-1_HeavyChain
QVQLVESGGGVVQPGRSLRLSCAASGFTFSSYGMHWVRQAPGKGLEWVAVVSYDESKYYADSVKGRFTISRDNSKNTLYLQMNSLRAEDMAVYYCAKDLGESENEEWASDYYEFWRDYPGQDPRGWVGTFDIWGQGTMVTVSS

SEQ ID NO: 1642 - protein, 144 aa, Artificial Sequence
  anti-HIV-1_HeavyChain
QVQLVEPGRGVVHPGGSLRLSCVTSGFTFENFPMHWVRQAPGKGLEWVALISYDGSDKYYSDSVKGRFTISRDNSKNTLYLQMNSLRAEDTAVYYCAKDLGESENEEWASDYYDFGSDYPGQDPRGVVGTFDIWGHGTMVTVSS

SEQ ID NO: 1643 - protein, 144 aa, Artificial Sequence
  anti-HIV-1_HeavyChain
QAQLVESGGGVVQPGRSLRLSCAASGFSFATHAMHWVRRSPGKGLEWVATISYGGKNEYYADSVKGRFTISRENSKNTLYLQMNSLRAEDTAVYYCAKDLGESENEEWASDYYDFGSDYPGQDPRGVVGTFDIWGHGTMVTVSS

SEQ ID NO: 1644 - protein, 144 aa, Artificial Sequence
  anti-HIV-1_HeavyChain
AVQLVESGGGLVKPGGSLRLSCAASGFTFFNTWMSWVRQSPGKGLEWVADISYDGSNKYYADSVKGRFTISRDNSKNTLYLQMNSLRAEDTAVYYCAKDLGESENEEWASDYYDFGRDYPGQDPRGVVGVFDIWGQGTMVTVSS

SEQ ID NO: 1645 - protein, 144 aa, Artificial Sequence
  anti-HIV-1_HeavyChain
QVQLVESGGGVVQPGRSLRLSCAASGFTFSSYGMHWVRQAPGKGLEWVAVISYDGSNKYYADSVKGRFTISRDNSKNTLYLQMNSLRAEDTAVYYCAKDLGESENEEWASDYYDFGSDYPGQDPRAVVGAFDIWGQGTMVTVSS

SEQ ID NO: 1646 - protein, 144 aa, Artificial Sequence
  anti-HIV-1_HeavyChain
QVRLVESGGRVVQPGGSLRLSCVASGFTFSSYGIHWVRQAPGKGLEWVTFIWHDGRDTYYADAVKGRFTISRDNSKNTLYLQMNSLRAEDTAVYYCAKDLGESENEEWATDYYDFWTGYPGQDPRAVVGAFDIWGQGTMVTVSS

SEQ ID NO: 1647 - protein, 144 aa, Artificial Sequence
  anti-HIV-1_HeavyChain
QVHLVESGGGVVQPGRSLRIYCAVSEFTFRNYAMHWVRLAPGKGLQWVAVISYDGSNKYYGDSVKGRFTISRDNSKNTLYLQMDSLRAEDTAVYYCAKDLGESENEEWASDYYDFGRDYPGQDPRGVVGTFDIWGHGTMVTVSS

SEQ ID NO: 1648 - protein, 144 aa, Artificial Sequence
  anti-HIV-1_HeavyChain
EVQLVESGGGLVKPGGSLRLSCAASGFTFSDAWMSWVRQAPGKGMEWVAVISYDGSNKYYADSVKGRFTISRDNSKNTLYLQMNSLRAVDTAVYYCAKDLGEGENEEWATDYYDFSIGYPGQDPRGVVGAFDIWGQGTMVTVSS

SEQ ID NO: 1649 - protein, 144 aa, Artificial Sequence
  anti-HIV-1_HeavyChain
EVQVVESGGGLVKPGGSLRLSCEASGFTFSNAWMSWVRQAPGKGLEWVAVISYDGNNKYYADSVKGRFTISRENSKNTLYLQMNSLRAEDTAVYHCAKDLGESENEEWASDYYDFGRDYPGQDPRGVVGTFDIWGHGTMVTVSS

SEQ ID NO: 1650 - protein, 144 aa, Artificial Sequence
  anti-HIV-1_HeavyChain
QVQLVESGGGVVQPGGSLRLSCAASGFTFSSYGIHWVRQAPGKGLEWVAFIRSDATNKYYADSVKGRFTISRENSKNTLYLQMNSLRAEDTAVYYCAKDLGESENEEWASDYYDFGSDYPGQDPRGVVGTFDIWGHGTMVTVSS

SEQ ID NO: 1651 - protein, 144 aa, Artificial Sequence
  anti-HIV-1_HeavyChain
QVQLVESGGGVVQPGRSLRLSCAASGFTFSSFGMHWVRQAPGKGLEWVAVISYDGNNKYYADSVKGRFTISRENSKNTLYLQMNSLRAEDTAVYYCAKDLGESENEEWASDYYDFGSDYPGQDPRGVVGTFDIWGHGTMVTVSS

SEQ ID NO: 1652 - protein, 144 aa, Artificial Sequence
  anti-HIV-1_HeavyChain
QVQLVESGGGVVQPGRSLRLSCAASGFTFSNYAMDWVRQAPGKGLEWVAVISYDGSNKYYADSVKGRFTISRDNSKNTLYLQMNSLRAEDTAVYYCAKDLGESENEEWATDYYDFWTGYPGQDPRAVVGAFDIWGQGTMVTVSS

SEQ ID NO: 1653 - protein, 144 aa, Artificial Sequence
  anti-HIV-1_HeavyChain
QVQLVESGGGVVQPGRSLRLSCAASGFTFSSYGMHWVRQAPGKGLEWVAVVSYDESNKYYAGSVKGRFTISRDNSKNTLYLQMNSLRTEDMAVYYCAKDLGESENEEWASDYYDFGREYPGQDPRGWVGTFDIWGQGTMVTVSS

SEQ ID NO: 1654 - protein, 144 aa, Artificial Sequence
  anti-HIV-1_HeavyChain
QVQLVESGGGVVQPGRSLRLSCAASGFTFSSYGMHWVRQAPGKGLEWVAVISYDGSNKYYVDSVKGRFTISRDNSKNTLYLQMNSLRAEDTAVYYCAKDLGESENEEWATDYYDFSIGYPGQDPRGVVGIFDIWGQGTMVTVSS

SEQ ID NO: 1655 - protein, 144 aa, Artificial Sequence
  anti-HIV-1_HeavyChain
QVQLVESGGGVVQPGRSLRLSCAASGFTFSTSGMHWVRQAPGKGMEWVAVISYDGSNKYYADSVKGRFTISRDNSKNTLYLQMNSLRAVDTAVYYCAKDLGEGENEEWATDYYDFSIGYPGQDPRGVVGAFDIWGQGTMVTVSS

SEQ ID NO: 1656 - protein, 121 aa, Artificial Sequence
  anti-HIV_C38-VRC18.02_HeavyChain
QVRLVQSGNQVRKPGASVRISCEASGYKFIDHFIHWVRQVPGHGLEWLGWINPRGGGVNYSRSFQGKLSMTMTRDNFEETAYLDLSKLNPGDTAVYFCARGFAGYEWSFIWGQGTLVIVSS

SEQ ID NO: 1657 - protein, 132 aa, Artificial Sequence
  anti-HIV_44-VRC13.02_HeavyChain
QVQLVQSGTALKSPGSSAKLSCTVLGDEFGTYFISWIRQAPGQGLEWVGGIVPHSQLQSSAQKFHGRIIISAGAGVTPPVVSLQLTNLTFEDTGTYFCARERGRHRDPKTGDALRGRYFDFWGRGTGLRVST

SEQ ID NO: 1658 - protein, 107 aa, Artificial Sequence
  anti-HIV-1_LightChain
DIKLTQSPAFLSASVGERVTFTCRASQDISHDLVWFQQKAGRAPSLLMFYGSTLERGVPPRFSGRRSGTEFTVTIDSLQPEDVGTYYCQQLSAFPLTFGGGTTVDIK

SEQ ID NO: 1659 - protein, 107 aa, Artificial Sequence
  anti-HIV-1_LightChain
DIKMTQSPAFLSASVGERVTFTCRASQDISHDVVWFQQKSGSAPKLLMFYGSTLERGVPPRFSGRRSGTEFTVTIDGLQPEDVGTYYCQQLSAFPLTFGGGTTVDIK

SEQ ID NO: 1660 - protein, 107 aa, Artificial Sequence
  anti-HIV-1_LightChain
DIKLTQSPAFLSASVGERVTFTCRASQDIRHELVWYQQKPGRGPKLLIYYGSTLEGGVPSRFSGRRSGTEFTVTISSLQPEDVGTYYCQQLNSFPLTFGGGTTVDIR

SEQ ID NO: 1661 - protein, 107 aa, Artificial Sequence
  anti-HIV-1_LightChain
DIQLTQSPSFLSASVGDRVSITCRASQGIKHELAWYQQKPGRAPSLLIYYASTLARGVPSRFSASWSGTLFTLTINGLQPEDFATYFCQQMNSLPLTFGGGTKMDVR

SEQ ID NO: 1662 - protein, 107 aa, Artificial Sequence
  anti-HIV-1_LightChain
DIQLTQSPSFLSASVGDKVTITCRASHGVRNELAWYQQKPGKAPNLLIYYASTLQSGVPSRFSATGSGTHFTLTVSSLQPEDFATYFCQHMSSYPLTFGGGTKVEIK

SEQ ID NO: 1663 - protein, 107 aa, Artificial Sequence
  anti-HIV-1_LightChain
DIQLTQSPSFLSASVGDKVTFTCRASQGVRNELAWYQQKPGKAPNLLIYYASTLQSGVPSRFSATGSGTHFSLTVSSLQPEDFATYFCQHMSSYPLTFGGGTKVEIK

SEQ ID NO: 1664 - protein, 107 aa, Artificial Sequence
  anti-HIV-1_LightChain
DIQLTQSPSFLSASVGDKVTITCRASQGVRNELAWYQQKPGKAPNLLIYYASTLQSGVPSRFSATGSGTHFTLTVSSLQPEDFATYFCQHMSSYPLTFGGGTKVEIK

SEQ ID NO: 1665 - protein, 122 aa, Artificial Sequence
  anti-HIV-1_HeavyChain
SQYLAQPGAEVAKPGASVKVSCKVHGDNFRGHYLHWVRQAPGQGLQWIGGINPFSGEAAYGKRFEGRLRLTRDTSVNTAYMELAKLTPDDTAVYFCARDKTYNDEFTAMDIWGHGTTVIVSS

SEQ ID NO: 1666 - protein, 122 aa, Artificial Sequence
  anti-HIV-1_HeavyChain
SQYLAQPGAEVAKPWASVKVSCRVHGDNFRGFYLHWVRQAPGQGLEWIGGINPFSGEAAYGRRFEGRLRLTRDTSINTAYMEVTKLTSDDTAVYFCARDKTYNDEFTAMDIWGQGTTVIVSS

SEQ ID NO: 1667 - protein, 122 aa, Artificial Sequence
  anti-HIV-1_HeavyChain
SQYLAQSGSEVKKPGASVKVSCRLHGDKFGAHYIHWVRQAPGQGLEWLGFFHPGTGDAVSAQKFQGRISLTRDTSISTGYLEVRRLSSDDTAVYYCARDKTYSDEATGMDIWGQGTTVIVSS

SEQ ID NO: 1668 - protein, 122 aa, Artificial Sequence
  anti-HIV-1_HeavyChain
SLELVQSGTEVKKPGASVKVSCKLFGDTITSGPIHWVRQAPGQGLEWMGWTNPHSGDTATAPKFQGRVYMTNDKKINTAFLDVTRLASDDTAIYFCARDMYYSNEAVGMDVWGQGTTVSVSS

SEQ ID NO: 1669 - protein, 122 aa, Artificial Sequence
  anti-HIV-1_HeavyChain
QEVLVQSGAEVKKPGASVKVSCRAFGYTFTAHALHWVRQAPGQGLEWLGWINPHSGDTTTSQKFQGRVYMTRDKSINTAYLEVTRLTSDDTAIFYCARDKYYGDEAVGMDVWGQGTSVTVSS

SEQ ID NO: 1670 - protein, 122 aa, Artificial Sequence
  anti-HIV-1_HeavyChain
QEVLVQSGAEVKKPGASVKVSCRAFGYTFTGNALHWVRQAPGQGLEWLGWINPHSGDTTTSQKFQGRVYMTRDKAINTAYLDVTRLTSDDTAIYYCARDKYYGNEAVGMDVWGQGTSVTVSS

SEQ ID NO: 1671 - protein, 122 aa, Artificial Sequence
  anti-HIV-1_HeavyChain
QEVLVQSGAEVKKPGASVKVSCRAFGYTFTGNALHWVRQAPGQGLEWLGWINPHSGDTTTSQKFQGRVYMTRDKSINTAFLDVTRLTSDDTGIYYCARDKYYGNEAVGMDVWGQGTSVTVSS

SEQ ID NO: 1672 - protein, 101 aa, Artificial Sequence
  anti-HIV_45_LightChain
SLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 1673 - protein, 101 aa, Artificial Sequence
  anti-HIV_45_LightChain
VLTQSPGTLSLSPGETATISCRTSQYGSLAWYQQRPGQAPRLVIYSGSTRAAGIPDRFSGSRSGPDYTLTISNLESGDFGVYYCQQYEFFGQGTKVQQDNK

SEQ ID NO: 1674 - protein, 101 aa, Artificial Sequence
  anti-HIV_45_LightChain
VLTQSPGTLSLSPGETAIISCRTSQYGSLAWYQQRPGQAPRLVIYSGSTRAAGIPDRFSGSRWGPDYNLTISNLESGDFGVYYCQQYEFFGQGTKVQVDIK

SEQ ID NO: 1675 - protein, 121 aa, Artificial Sequence
  anti-HIV_45_HeavyChain
QVRLSQSGGQMKKPGESMRISCRASGYEFIDCTLNWIRLAPGRRPEWMGWLKPRGGAVNYARVFQGRVTMTRDVYSDTAFLELRSLTADDTAVYFCTRGKTVDYNWDFEHVGPGTPVTVSS

SEQ ID NO: 1676 - protein, 121 aa, Artificial Sequence
  anti-HIV_45_HeavyChain
QVRLSQSGGQMKKPGESMRISCQASGYEFIDCTLNWVRLAPGRRPEWMGWLKPRGGAVNYARIFQGRVTMTRDVYSDTAFLELRSLTADDTAVYFCTRGKNCDYNWDFEHVGPGYPVTVSP

SEQ ID NO: 1677 - protein, 125 aa, Artificial Sequence
  anti-HIV_45_HeavyChain
QVRLSQSGGQMKKPGDSMRISCRASGYEFINCPINWIRLAPGKRPEWMGWMKPRGGAVSYARQLQGRVTMTRDMYSETAFLELRSLTSDDTAVYFCTRGKYCTARDYYNWDFEHWGQGTPVTVSS

SEQ ID NO: 1678 - protein, 145 aa, Artificial Sequence
  anti-HIV_cap256-206-252885_VR-Chain
QEQLVESGGGVVPPGSSLTLSCVASRFTFSAFGMHWVRQAPGKGLEWVAGVSFVGIKKYYADSVKGRFTISRDNSKNTLFLQMNGLRGEDTGLYYCVKDMRYLECEEWASDYYDFGKPNQPCLDRRGVSGISAFWGQGTTVTVSS

SEQ ID NO: 1679 - protein, 146 aa, Artificial Sequence
  anti-HIV_cap256-206-249183_VR-Chain
QVLLVESGGGVVEPGTSLTLSCAASRFTFSNFGMHWVRQTPGGGLEWVASISNEGNKKYHAESVWGRFIISRDNSKNTVFLHMSSLRPDDSALYFCVRDRQEDDCEVWWSDYEAFGREIPCRQYRGQGLAGIFDIWGRGTMVTVSS

SEQ ID NO: 1680 - protein, 146 aa, Artificial Sequence
  anti-HIV_cap256-206-220956_VR-Chain
QMMLVESGGDVVEPGRSLTLSCATSQFTFSNYGMHWVRQAPGRGLEWVASISNEGNKKYHAESVWGRLIISRDNSKNTLFLHMSSLRADDSALYFCVRDRQEDECEEWWSNYYAFGRGGPCRKYRGQGLAGIFDVWGRGTMVTVSS

SEQ ID NO: 1681 - protein, 144 aa, Artificial Sequence
  anti-HIV_cap256-206-220629_VR-Chain
QEQLVESGGGVVPPGKSLKLSCVASRFSFGAFGMHWVRQAPGKGLEWVAGISFAGIKKYYGDSVKGRFYISRDNSQNTLFLEMNGLRGDDTARYYCVKDLRELECEEWASDYYDFGKPQPCLDSRGVSGISAMWGPGTMVTVSS

SEQ ID NO: 1682 - protein, 127 aa, Artificial Sequence
  anti-HIV_cap256-206-200599_VR-Chain
QEKLVESGGGAVQPGGSLRLSCVASGFTFNGFGMHWVRQAPGKGLEWVATISFSGVYISRENSKNTLYLQMNGLRGEDTALYYCAKDLRYLECGEWSTYYPQPCLDTRGVSGISNVWGPGTRVTVSS

SEQ ID NO: 1683 - protein, 144 aa, Artificial Sequence
  anti-HIV_cap256-206-186347_VR-Chain
QELLVESGGGVVPPGKSLTISCVASRFTFSAFGMHWVRQAPGKGLQWVASISFAGTKKYYADFVKGRFTISRDNSKNTIFLQMNGLRGEDTALYHCVKDMRQLECEEWTSDYYDFGRPQPCIDRRGVSGISAMWGPGTMVTVSS

SEQ ID NO: 1684 - protein, 146 aa, Artificial Sequence
  anti-HIV_cap256-206-186226_VR-Chain
QMLLVESGGGVVEPGRSLTLSCATSQFTFSNYGMHWVRQTPGTGLEWVASISNEGNKKYHGEAVWGRFIISRDNSKKTLFLHMSNLRADDSGLYFCVRDRQEDECEEWWSDYYSFGRGGPCRKYHGQGLAGIFDIWGRGTLVTVSS

SEQ ID NO: 1685 - protein, 145 aa, Artificial Sequence
  anti-HIV_cap256-206-179686_VR-Chain
QEQLVESGGGVVPPWKSLTLSCEASRFTFSAFGMHWVRQAPGKGLEWVAGISFAGIKKYYADSVKGRFFISRDNSKNRVLLEMNGLRREDTARYFCVKDLRELECEEWASDYYDFGKPNQPCLDRRGVSGISAMWGQGTMVTVSS

SEQ ID NO: 1686 - protein, 139 aa, Artificial Sequence
  anti-HIV_cap256-206-173707_VR-Chain
QEKLVESGGGAVQPGGSLRLSCVASGFTFKGFGMHWVRQAPGKGLEWVATISFSGVKKYYGNSAKGRFFISRDNLKNTVYLEMNGLRGEDTALYYCAKDLRYLECGEWSTYYPQPCLDTRGVSGISNVWGPGTKVTVSS

SEQ ID NO: 1687 - protein, 144 aa, Artificial Sequence
  anti-HIV_cap256-206-173339_VR-Chain
QELLVESGGGVVPPGKSLKLSCVASRFTFGAFGMHWVRQAPGKGLEWVAGISFAGTKNYYADSVKGRFTISRDNPKNTLFLQMNGLRGDDTGLYYCVKDMRELECELWTSDYYDFGRPQPCIDQRGVSGISAMWGQGTMVTISS

SEQ ID NO: 1688 - protein, 146 aa, Artificial Sequence
  anti-HIV_cap256-206-172689_VR-Chain
QMMLVESGGGVVEPGRSLTLSCATSHFTFSNYGMHWVRQAPGGRLEWVASISNAGNKKYHGDSVWGRLIISRDNSKNTLFLHMSSLRVDDSALYFCVRDRQEDECEEWWSDYYAFGRGGPCRKYRGQGLAGIFDIWGRGTMVTVSS

SEQ ID NO: 1689 - protein, 144 aa, Artificial Sequence
  anti-HIV_cap256-206-162744_VR-Chain
QEKLVESGGGVVPPGKSLRLSCVASGFTFSAFGMHWVRQAPGKGLEWVAGISFAGIKNYYADSVKGRFTISRDNSKNSLFLQMNGLRGDDTARYYCVKDMRELECEEWTSDYYDFGKPQPCIDRRGVSGISAMWGQGTMVTISS

SEQ ID NO: 1690 - protein, 146 aa, Artificial Sequence
  anti-HIV_cap256-206-146057_VR-Chain
QMQLVESGGGVVQPGTSLTLSCVASQFTFSNYGMHWIRQAPGQGLEWVASISNDGGKRYHGDAVWARFIISRDNSKNTVFLQMTSLRAEDTARYFCVRDRQEDECLEWWSDYYNFGRQLPCAKFRGLGLAGVFDIWGHGTMVTVSS

SEQ ID NO: 1691 - protein, 145 aa, Artificial Sequence
  anti-HIV_cap256-206-139519_VR-Chain
QEQLVESGGGVVPPGTSLRLSCVASRFSFGSFGMHWVRQAPGKGLEWVAGISFVGIKKYYGDSVKGRFFISRDNSKNTLFLEMNGLRGEDTARYYCVKDMRELECEEWASDYYDFGKPNQPCLDRRGVSGISAMWGPGTMLTVSS

SEQ ID NO: 1692 - protein, 144 aa, Artificial Sequence
  anti-HIV_cap256-206-136316_VR-Chain
QEQLVESGGGVVPPGKSLTLSCVASGFTFSAFGMHWVRQAPGKGLEWVAGISFVGIKKYYGDSVKGRFTISRDNSKNTLFLQMNGLRGDDTALYHCVKDMRQLECEEWTSDYYDFGKPQPCIDPRGVSGISAMWGQGTMVTVSS

SEQ ID NO: 1693 - protein, 146 aa, Artificial Sequence
  anti-HIV_cap256-206-116098_VR-Chain
QMMLVESGGGVVEPGRSLTLSCAASQFTFSNYGMHWVRQAPGRELEWVASISNAGNKKYHGEAVWGRLIISRDNSKNTLFLHMSNLRPDDSALYFCVRDRQEDECEEWWSDYYAFGRGGPCRKYHGQGLAGIFDIWGRGTMVTVSS

SEQ ID NO: 1694 - protein, 144 aa, Artificial Sequence
  anti-HIV_cap256-206-115862_VR-Chain
QEQLVESGGGVVPPGKSLRLSCVGSRFTFSAFGMHWVRQAPGKGLEWVASISFAGTKKYYVDSVKGRFFISRDNSKNTVFLEMNGLRGEDTGLYYCVKDMRELECEEWASDYYDFGKPQPCLDRRGVSGISAMWGQGTLVIISS

SEQ ID NO: 1695 - protein, 145 aa, Artificial Sequence
  anti-HIV_cap256-206-107018_VR-Chain
QEQLVESGGGVVPPGKSLTLSCVASRFSFSAFGMHWVRQAPGKGLEWVASISFVGIKKYYGDSVKGRFFISRDNSKNTVFLEMNGLRGEDTGLYYCVKDMRELECEEWASDYYDFGKPNQPCLDRRGVSGISAMWGQGTLVIVSS

SEQ ID NO: 1696 - protein, 146 aa, Artificial Sequence
  anti-HIV_cap256-206-098644_VR-Chain
QMLLVESGGGVVEPGRSLTLSCAASQFTFSNYGMHWVRQAPGGGLEWVASISNEGNKRYHGESVWGRFVISRDNSKNTLFLHMSTLRPDDSALYFCVRDRQEDECEEWWSDYYAFGRGGPCRKYHGQGLAGIFDVWGRGTMVTGLF

SEQ ID NO: 1697 - protein, 139 aa, Artificial Sequence
  anti-HIV_cap256-206-098135_VR-Chain
QEKLVESGGGAVQPGGSLRLSCVASGFTFSGFGMHWVRQAPGKGLEWVATISFSGMKKYYGTSAKGRFSIYRDNSKNTLYLQMDGLREKDTALYYCAKDLRYLECGEWSTYYPQPCLDRRGVSGISNVWGPGTMVTVSS

SEQ ID NO: 1698 - protein, 145 aa, Artificial Sequence
  anti-HIV_cap256-206-096276_VR-Chain
QEQLVESGGGVVPPGSSLRLSCVASRFTFSAFGMHWVRQAPGKGLEWVAGISFVGIKKYYADSVKGRFTISRDNSKNTLFLQMNGLRGEDTGLYYCVKDMRELECEEWRSDYYDFGKPNQPYLDRRGVSGISAFWGQGTMVTVSS

SEQ ID NO: 1699 - protein, 146 aa, Artificial Sequence
  anti-HIV_cap256-206-092794_VR-Chain
QMMLVESGGGVVEPGRSLTLSCATSQFTFSNYGMHWVRQAPGRGLEWVASISNEGNKRYHGESVWGRFIISRDNSKNTLFLHMSTLRADDSALYFCVRDRQEDECEEWWSDYYAFGRGGPCRKYHGQGLAGIFDIVGRGTLVTVSS

SEQ ID NO: 1700 - protein, 144 aa, Artificial Sequence
  anti-HIV_cap256-206-086817_VR-Chain
QEQLVESGGGVVPPGKSLRLSCAASGFSFGAFGMHWVRQAPGKGLEWVAGISFVGIKYYYADSVKGRFTISRDNSKNTVFLQMNGLRGDDTGRYYCVKDMRELECEEWTSDYYDFGKPQPCIDRRGVSGISAMWGQGTMVTISS

SEQ ID NO: 1701 - protein, 144 aa, Artificial Sequence
  anti-HIV_cap256-206-086446_VR-Chain
QEQLVESGGGVVPPGKSLRLSCVASRFTFSAFGMHWVRQAPGKGLEWVAGISFVGIKKYYSDAVKGRFYISRDNSKNTLFLEMNGLRGDDTARYYCVKDLRELECEEWASDYYDFGKPQPCLDSRGVSGISAMWGQGTMVTVSS

SEQ ID NO: 1702 - protein, 144 aa, Artificial Sequence
  anti-HIV_cap256-206-086180_VR-Chain
QEQLEESGGGVVPPGKSLRLSCVASRFTFSAFGMHWVRQAPGKGLEWVAGISFVGIKKYYADSVKGRFTISRDNSKNTLFLQMNGLRGDDTGLYFCVKDMRELECEQWTSDYYDFGKPQPCIDPRGVSGISAMWGQGTMVTVSS

SEQ ID NO: 1703 - protein, 145 aa, Artificial Sequence
  anti-HIV_cap256-206-083708_VR-Chain
QEQLVESGGGVIPPGQSLRLSCVASRFTFSAFGMHWVRQAPGKGLEWVSSVSFAGIKKYYADSVKGRFFISRDNSKNTVFLEMNGLRGEDTGLYYCVKDMRELECEEWASDYYDFGKPDQPCLDRRGVSGISAMWGQGTLVIVSS

SEQ ID NO: 1704 - protein, 144 aa, Artificial Sequence
  anti-HIV_cap256-206-079556_VR-Chain
QEQLVESGGGVVPPGKSLRLSCVASGFTFSGFGMHWVRQAPGKGLEWVAGISFVGIKYYYADSVKGRFSISRDNSKNTLFLQMNGLRGDDTALYYCVKDMRELECEEWTSDYYDFGKPQPCIDRRGVSGISAMWGQGTMVTVSS

SEQ ID NO: 1705 - protein, 146 aa, Artificial Sequence
  anti-HIV_cap256-206-078657_VR-Chain
QMLLVESGGGVVEPGRSLTLSCATSQFTFSNYGMHWVRQAPGRGLEWVASISNEGSKKYHGEPVWGRFIISRDNSKKTLFLHMSNLRVDDSALYFCVRDRQEDECEEWWSDYYAFGRGGPCRKYHGQGLAGIFDIWGRGTMVTVSS

SEQ ID NO: 1706 - protein, 146 aa, Artificial Sequence
  anti-HIV_cap256-206-075802_VR-Chain
QMLLVESGGDVVEPGKSLTLSCATSRFTFSNYGMHWVRQAPGGGLEWVASISNEGNKKYHGESVWGRFIISRDNSKNTLFLHMSALRTDDSALYFCVRDRQEDECEEWWSDYYAFGRGGPCRKYHGQGLAGIFDIWGRGTMVTVSS

SEQ ID NO: 1707 - protein, 146 aa, Artificial Sequence
  anti-HIV_cap256-206-069097_VR-Chain
QMLLVESGGGVVEPGRSLTLSCATSRFTFSNYGMHWVRQAPGRELEWVASISNEGNKKYHAESVWGRFIISRDNSKNTLFLHMSNVRGDDSALYFCVRDRQEDECEEWWSDYYAFGRGGPCRKYHGQGLAGIFDVWGRGTVVTVSS

SEQ ID NO: 1708 - protein, 146 aa, Artificial Sequence
  anti-HIV_cap256-206-067758_VR-Chain
QMLLVESGGGVVEPGRSLTLSCAASQFTFSHYGMHWVRQAPGRGLEWVASISNEGNKRYHGESVWGRFIISRDNSKNTLFLHMSALRTDDSALYFCVRDRQEDECEEWWSDYYAFGRGGPCRKWHGQGLAGIFDIWGRGTVVTVSS

SEQ ID NO: 1709 - protein, 139 aa, Artificial Sequence
  anti-HIV_cap256-206-057019_VR-Chain
QEKLVESGGGAVQPGGSLRLSCVASGFSFSGYGMHWVRQAPGKGLEWLATISFSGVKKYYGTSAKGRFYIYRDNTKNTMYLEMNGLRGEDTALYYCAKDLRYLECGEWSTYYPQPCLDTRGVSGISNVWGPGTMVTVSS

SEQ ID NO: 1710 - protein, 146 aa, Artificial Sequence
  anti-HIV_cap256-206-055385_VR-Chain
QMMLVESGGGVVEPGRSLTLSCAASKFTFSNYGMHWVRQAPGRGLEWVASISNEGNKKYHGEPVWGRLIISRDNSKNTLFLHMSDLRADDSALYFCVRDRQEDECEEWWSNYYAFGRGGPCRKWRGQGLAGIFDVWGRGTMVTVSS

SEQ ID NO: 1711 - protein, 145 aa, Artificial Sequence
  anti-HIV_cap256-206-053187_VR-Chain
QEQLVESGGGVVPPGSSLRLSCVASRFTFSAFGMHWVRQAPGKGLEWVAGISFVGIKYYYADSVKGRFTISRDNSKNTLFLQMNGLRGEDTGLYYCVKDMRELECEEWASDYYDFGKPNQPCLDRRGVSGISAFWGQGTMVTVSS

SEQ ID NO: 1712 - protein, 146 aa, Artificial Sequence
  anti-HIV_cap256-206-053139_VR-Chain
QMLLVESGGDVVEPGRSLTLSCATSQFTFSNYGMHWVRQAPGRGLEWVASISNEGSKKYHGESVWGRFIISRDNSKNTLFLHMTTLRPDDSALYFCVRDRQEDECEEWWSDYYAFGRGGPCRKYHGQGLAGIFDIWGRGTMVTVSS

SEQ ID NO: 1713 - protein, 144 aa, Artificial Sequence
  anti-HIV_cap256-206-050350_VR-Chain
QEQLVESGGGVVPPGKSLKLSCVASRFSFGAFGMHWVRQAPGKGLEWVAGISFVGIKKYYADSVKGRFYISRDNSKNTVFLEMNALRGEDTALYHCVKDMRELECEEWASDYYDFGKPQPCLDRRGVSGISAMWGPGTMVIVSS

SEQ ID NO: 1714 - protein, 144 aa, Artificial Sequence
  anti-HIV_cap256-206-046207_VR-Chain
QEQLVESGGGVVPPGTSLRLSCVASRFTFSAFGMHWVRQAPGKGLEWVAGISFAGIKKYYADSVKGRFTISRDNSKNSLFLEMNGLRGDDTALYYCVKDLRYLECELWTSDYYDFGRPQPCIDSRGVSGISAMWGPGTMVTVSA

SEQ ID NO: 1715 - protein, 139 aa, Artificial Sequence
  anti-HIV_cap256-206-043389_VR-Chain
QEKLVESGGGAVQPGGSLRLSCVASGFTFSGFGMHWFRQAPGKGLEWVATISFSGIKKYYNTSAKGRFFISRDNTKDTLYLQMDGLQEKDTALYLCAKDLRYLECGYWSTYYPQPCLDTRGVSGISNVWGPGTMVTVSS

SEQ ID NO: 1716 - protein, 144 aa, Artificial Sequence
  anti-HIV_cap256-206-042555_VR-Chain
QEQLVESGGGVVPPGKSLRLSCVVSGFTFSAFGMHWVRQAPGKGLEWVAGISFAGTKSYYAESVKGRFTISRDNSKNSLFLQMNGLRGDDTALYYCVKDMRELECELWTSDYYDFGRPQPCIDRRGVSGISAMWGQGTMVTISS

SEQ ID NO: 1717 - protein, 144 aa, Artificial Sequence
  anti-HIV_cap256-206-029720_VR-Chain
QEKLVESGGGVVQPGRSLTLSCVASHFTFSGVGMHWVRQAPGKGLEWVAGISFAGTRKYYADSVKGRFTISRDNSKNTVYLQMNGLRGEDTALYHCAKDLRELECELWTSDYYDFGRPQPCIDRRGVSGICDMWGQGTMVIVSS

SEQ ID NO: 1718 - protein, 144 aa, Artificial Sequence
  anti-HIV_cap256-206-028848_VR-Chain
QEQLVESGGGVVPPGKSLRLSCVASGFTFSGFGMHWVRQAPGKGLQWVAGISFAGTKYYYEDSVKGRFTISRDNSKNTVFLQMNGLRGDDTALYYCVKDMRELECEEWTSDYYDFGKPQPCIDRRGVSGISAMWGQGTMVTISS

SEQ ID NO: 1719 - protein, 144 aa, Artificial Sequence
  anti-HIV_cap256-206-027652_VR-Chain
QEQLVVSGGDVVPPGKSLRLSCVASGFTFSAFGMHWVRQAPGKGLEWVASISFAGTKYYYADSVKGRFAISRDNSKNTLFLQMNGLRREDTGLYYCVKDMRQLECEEWTSDYYDFGRPQPCIDRRGVSGISAMWGQGTMVTISS

SEQ ID NO: 1720 - protein, 139 aa, Artificial Sequence
  anti-HIV_cap256-206-024075_VR-Chain
QEKLVESGGGAVQPGGSLRLSCVASGFTFSGFGMHWVRQAPGKGLEWLATISFSGVKKYYGTSAKGRFYISRDNTKNTVYLQMDGLRGDDTAIYYCAKDLRFLECGLWSTYYPQPCLDTRGVSGISNVWGPGTMVTVSS

SEQ ID NO: 1721 - protein, 139 aa, Artificial Sequence
  anti-HIV_cap256-206-008748_VR-Chain
QEKLVESGGGAVQPGGSLRLSCVASGFTFNGFGMHWVRQAPGKGLEWVATISFSGVKKYYGTSAKGRFFISRENSKNTLYLQMNGLRGEDTALYYCAKDLRYLECGEWSTYYPQPCLDTRGVSGISNVWGPGTRVTVSS

SEQ ID NO: 1722 - protein, 144 aa, Artificial Sequence
  anti-HIV_cap256-206-008530_VR-Chain
QEQLVESGGGVVPPGKSLRLSCVASGFSFGAFGMHWVRQAPGKGLEWVAGISFVGIKYYYADSVKGRFTISRDNSKKTLFLQMNGLRGDDTALYYCVKDMRELECEEWTSDYYDFGKPQPCIDRRGVSGISAFWGQGTMVTISS

SEQ ID NO: 1723 - protein, 144 aa, Artificial Sequence
  anti-HIV_cap256-176-723043_VR-Chain
QEQLVESGGGVVPPGKSLRLSCVASGFTFSAFGMHWVRQAPGKGLEWVAGVSFAGIKYYYADSVKGRFTISRDNSKNTLFLQMNGLRGDDTALYYCVKDLRELECEEWTSDYYDFGRPQPCIDPRGVSGISAMWGQGTVVTISS

SEQ ID NO: 1724 - protein, 144 aa, Artificial Sequence
  anti-HIV_cap256-176-600049_VR-Chain
EVQLVQSGGGVVQPGRSLRLSCAAPYFEFGRYGFHWVRQAPGKGLEWVASISFAGRGYYHSPSVWGRFTISRDNSKNTLYLQMNSLRIEDTALYFCARDLRESECEEWESDYYDFGKKGPCVKPRGVAGGLDLWGQGTMVIVSS

SEQ ID NO: 1725 - protein, 144 aa, Artificial Sequence
  anti-HIV_cap256-176-531926_VR-Chain
QVQLVESGGGVVPPGKSLTLSCVASRFTFSAFGMHWVRQAPGKGLEWVAGISFVGIRKYYADSVKGRFSISRDNSKNTVFLEMNGLRGEDTGLYYCVKDMRELECEEWASDYYDFGKPQPCLDRRGVSGISAMWGQGTLVIISS

SEQ ID NO: 1726 - protein, 144 aa, Artificial Sequence
  anti-HIV_cap256-176-504134_VR-Chain
EVQLVESGGGVVPPGKSLRLSCVTSRLAFGAFGMHWVRQAPGKGLEWVASISFAGIKKYYADSVKGRFTISRDNSKDTVFLEMNGLRGDDTGLYYCVKDMRYLECEEWASDYYDFGRPQPCLDPRGVSGISAMWGQGTLVIISS

SEQ ID NO: 1727 - protein, 144 aa, Artificial Sequence
  anti-HIV_cap256-119-186229_VR-Chain
QMQLVESGGGVVQPGGSLRLLCSASGFTFSTYGMHWVRQAPGKGLEWVASISYDGSDKYHAGLVWGRFIISRDNSKNTLYLQMNSLRAEDTALYYCVRDERESECELWESDYYNFGKKLPCVKPRGVAGTLDIWGQGTTVIVSS

SEQ ID NO: 1728 - protein, 144 aa, Artificial Sequence
  anti-HIV_cap256-119-183891_VR-Chain
QVQLVESGGGVVQPGGSLRLSCAASGFTFSSYGMHWVRQAPGKGLEWVAFTRYDGSDKYYLDSVKGRFTISRDNSKYTLFLQMVSLRTEDTALYFCARDLRESECEEWESYYYDFGKKGPCVKPRGVVGVLDIWGQGTLVTVSS

SEQ ID NO: 1729 - protein, 145 aa, Artificial Sequence
  anti-HIV_cap256-119-183631_VR-Chain
QVQLVQSGGGVVQPGRSLRLSCAASKFTFSTYTLHWVRQAPGKGLEWVAVISHDGGNRFYADSVKGRFTISRDNSKNNLFLQMNSLRVEDTALYYCARDLREMECEEWTLYNYYDFGSRGPCVDPRGVVGSFDVWGQGTMVTVSS

SEQ ID NO: 1730 - protein, 144 aa, Artificial Sequence
  anti-HIV_cap256-119-182676_VR-Chain
QVQLVESGGGVVQPGKSLRLSCVVSGFTFSNYPMHWVRQAPGKGLEWVASISFAGIKKYYGDSVKGRFTISRDNSKNTLYLQMDGLRGEDTALYYCAKDLRELECEEWASDYYDFGRPQPCLDPRGVSGISNVWGQGTMVTVSS

SEQ ID NO: 1731 - protein, 144 aa, Artificial Sequence
  anti-HIV_cap256-119-180772_VR-Chain
QVQLVESGGGVVQPGRSLRLSCAASEFTFSNYAMHWVRQAPGKGLEWVASISFDGRDKYHSSLVWGRLTISRDNSKSTLFLQMNSLRPEDTALYYCARDVRESECEEWQSDYYAFYRKLPCVKPRGVAGTLDIWGQGTMVTVSS

SEQ ID NO: 1732 - protein, 145 aa, Artificial Sequence
  anti-HIV_cap256-119-180508_VR-Chain
QVHLVESGGGVVQPGRSLRLSCAASHFSLSSYGMHWVRQTPGKGLEWVAGISFAGVKTYYGTSVKGRFTISRDNSKNNLYLQMNSLRPEDTALYYCARDLREMECEEWKLYNYYDFRTRGPCVDPRGVVGSFDVWGQGTVVTVSS

SEQ ID NO: 1733 - protein, 144 aa, Artificial Sequence
  anti-HIV_cap256-119-180260_VR-Chain
EVQLVESGGGVVRPGGSLRLSCAASQFTFSNFGMHWVRQAPGKGLEWVASISFVGIKTHYANSVRGRFTISRDQSKNTLYLQMNSVRVEDTGRYYCARDMREYECELWASDYYDFGKPQPCEDPRGVVGTFDMWGLGTLVTVSS

SEQ ID NO: 1734 - protein, 144 aa, Artificial Sequence
  anti-HIV_cap256-119-180173_VR-Chain
EVQLVESGGGLVQPGGSLRLSCAASGFTVSSNYMSWVRQAPGKGLEWVASISFAGTKKHYGNSVKGRFTISRDNSKNTLYLQMNSLRGEDTALYYCAKDLREYECEEWTSDYYDFGRPQPCIDSRGVVGILDIWSQGTMVTVSS

SEQ ID NO: 1735 - protein, 144 aa, Artificial Sequence
  anti-HIV_cap256-119-179839_VR-Chain
QVQLVESGGGVVQPGRSLRLSCAASGFSFGTSDVHWVRQAPGEGLEWVALISFDGRQKDLADSVRGRFTISRDSSKNTLYLEMNSLRPEDTALYYCAKDMRGYECEEWTSDYYDFGRPQPCIDSRGVVGTFDVWGQGTMVTVSS

SEQ ID NO: 1736 - protein, 141 aa, Artificial Sequence
  anti-HIV_cap256-119-179262_VR-Chain
QVQLVESGGRVVQSGGSLRLSCGASGFSFTTSAMHWVRQAPGKGLEWVAINGANKHYAESVKGRFTISRDNSKNTLFLEMNSLRPDDTALYFCVKDQREDECEEWWSDYYDFGREQPCLDPRGVVGIFDLWGQGTMVTVSS

SEQ ID NO: 1737 - protein, 144 aa, Artificial Sequence
  anti-HIV_cap256-119-178995_VR-Chain
QVQLVESGGGVVQPGKSLRLSCAASGFTLTRFAMHWVRQAPGKGLEWVAVIWYDGSNKYYADSVKGRFTVSRDNSKNTLYLQMNSLRTEDTALYYCVRDRRESECELWESDYYNFGRRLPCVKPRGVAGILDIWGQGTTVTVSP

SEQ ID NO: 1738 - protein, 144 aa, Artificial Sequence
  anti-HIV_cap256-119-178455_VR-Chain
EVQLVESGGGLVQPGGSLRLSCVVSGFTFSNFWMSWVRQAPGKGLEWVASISYDGRDKYHSSLVWGRLTISRDNSKSTLFLQMNSLRAEDTALYYCARDLRESECEEWQSDYYAFYKKLPCVKPRGVAGTLDIWGQGTMVTVSS

SEQ ID NO: 1739 - protein, 146 aa, Artificial Sequence
  anti-HIV_cap256-119-177993_VR-Chain
QVHLVESGGGVVQPGKSLRIYCAVSEFTFSNYAMHWVRLAPGRGLQWLAVISYDGSKKYYADSLEGRFTISKDNSKNTLFLQMNSLRVEDTALYFCVKDQREDECEEWWSDYYDFGERAPLPKVPGPGPGWNLDMWGHGTMVTVSS

SEQ ID NO: 1740 - protein, 146 aa, Artificial Sequence
  anti-HIV_cap256-119-177727_VR-Chain
QVQLVESGGGVVQPGRSLRLSCAASGFTLSRYDMHWVRQAPGKGLEWVASISKDGTKKYHGDSVWGRFIISRDNSKNTLFLQMSSLRAEDTALYFCVRDQREAECEEWWSDYYDFGRELPCRKFRGLGLAGIFDIWGHGTMVTVSS

SEQ ID NO: 1741 - protein, 144 aa, Artificial Sequence
  anti-HIV_cap256-119-176746_VR-Chain
EVQLVESGGGLVQPGGSLRLSCAASDFTFDDYAMHWVRQAPGKGLEWVGGISYDGSDKYHTNSVWGRFIVSRDNSKNTLYLQMNSLRPEDTALYYCVRDRRESECEERWSDYYDFGKQLPCVKPRGVAGIFDIWGQGTMVTVSS

SEQ ID NO: 1742 - protein, 144 aa, Artificial Sequence
  anti-HIV_cap256-119-176241_VR-Chain
QVQLVESGGGVVQPGRSLRLSCAASGFTFSNYAMHWVRQAPGKGLEWVAVISYDGSNKYYADSVKGRFTISRDNSKNTLYLQMDGLRGEDTALYYCAKDLRELECEEWASDYYDFGRPQPCLDPRGVSGISNVWGQGTMVTVSS

SEQ ID NO: 1743 - protein, 144 aa, Artificial Sequence
  anti-HIV_cap256-119-175215_VR-Chain
QVQLVESGGGVVQPGRSLRLSCAVSQFTFGRYGMYWVRQAPGKGLEWVAGISYDGSDKYHTNSVWGRFIVSRDNSKNMLYLQMNNLRPEDTALYYCVRDRRESECEERWSDYYDFGKQLPCVKPRGVAGIFDIWGQGTMVTVSS

SEQ ID NO: 1744 - protein, 144 aa, Artificial Sequence
  anti-HIV_cap256-119-173928_VR-Chain
GVELLESGGGLVEPGGSLRLSCVGSQFSFDRYGMHWVRQAPGKGLEWVAAVSFDGTDKYHADDVWGRFTISRDNSKNTLYLQMNSLRAEDTALYYCAKDLREDECEEWWSDYYDLGKQLPCRKSRGVAGVLDKWGLGTMVTVSS

SEQ ID NO: 1745 - protein, 144 aa, Artificial Sequence
  anti-HIV_cap256-119-173495_VR-Chain
QVQLVESGGGVVQPGKSLRLSCAASRFTFNRYGMHWVRQAPGKGLEWVAAISFDGTDKYHSDDVWGRFTISRDNSKNTLYLQMNSLRAEDTAVYYCAKDLREDECEERWSDYYDFGKQLPCRKSRGVAGIFDNWGQGTMVTVSS

SEQ ID NO: 1746 - protein, 144 aa, Artificial Sequence
  anti-HIV_cap256-119-172882_VR-Chain
QVQLVESGGGVVQPGRSLTLSCEVSGFTFKTYGMHWVRQAPGKGLEWVASISYDGSDKYHADRVWGRFTISRDNSKNTLYLQMNSLRAEDTALYYCVRDARESECELWESDYYNFGRKLPCVKPRGVAGTLDIWGQGTMVTVSS

SEQ ID NO: 1747 - protein, 144 aa, Artificial Sequence
  anti-HIV_cap256-119-172429_VR-Chain
EVQLVETGGGLIQPGGSLRLSCVASQFTFSGCGLHWVRQAPGKGLEWVASISFAGTKKHYGNSVKGRFTISRDNSKNTLYLEMNTLRAEDTALYYCAKDLREYECEEWTSDYYDFGRPQPCIDSRGVVGILDIWGQGTMVSVSS

SEQ ID NO: 1748 - protein, 144 aa, Artificial Sequence
  anti-HIV_cap256-119-172223_VR-Chain
QVQLVESGGGVVQPGRSLRLSCAASGFTFSSYAMHWVRQAPGKGLEWVAVISYDGRDFYHARSVWGRFTISRDNSKNTLHLQMNSLRPEDTALYFCARDLRESECEEWESYYYDFGKKDPCVKPRGVVGVLDIWGQGTLVTVSS

SEQ ID NO: 1749 - protein, 144 aa, Artificial Sequence
  anti-HIV_cap256-119-171838_VR-Chain
QVQLGESGGGVVQPGRSLRLSCAASGFTFSTFAMHWVRQAPGKGLEWVAVISYDGSNKYYADSVKGRFAISRDNAKNLLHLQMNSLRPEDTALYYCAKDLQEDECEEWWSDYYDFGKQLPCRKSRGVAGIFDDWGQGTMVTVSS

SEQ ID NO: 1750 - protein, 144 aa, Artificial Sequence
  anti-HIV_cap256-119-171587_VR-Chain
EVQLVESGGGLVQPGGSLRLSCAASGFTFSDYYMSWIRQAPGKGLEWVASISFAGTKQHYGNSVKGRFTISRDNSKNTVYLQMNSLRLEDTALYYCAKDLREYECEEWTSDYYDFGRPQPCIDSRGVVGILDIWGQGTMVTVSS

SEQ ID NO: 1751 - protein, 144 aa, Artificial Sequence
  anti-HIV_cap256-119-169596_VR-Chain
LVQLVESGGGVVQPGRSLRLSCTASGFTFSSFAMHRVRQTPGKGLEWVASISYDGSDKYHADRVWGRFTISRDNSKNTLYLQMNSLRAEDTALYYCVRDARESECELWESDYYNFGRKLPCVKPRGVAGTLDIWGQGTMVTVSS

SEQ ID NO: 1752 - protein, 144 aa, Artificial Sequence
  anti-HIV_cap256-119-169523_VR-Chain
QVQLVESGGGVVQPGESLRLSCAASGFSFGTSDVHWVRQAPGEGLEWVASISFAGIKKYYGDSVKGRFTISRDNSKNTLYLQMDGLRGEDTALYYCAKDLRELECEEWASDYYDFGRPQPCLDPRGVSGISNVWGQGTMVTVSS

SEQ ID NO: 1753 - protein, 144 aa, Artificial Sequence
  anti-HIV_cap256-119-169462_VR-Chain
EVQLVESGGGLVQPGGSLRLSCAASGFTFTTYSLHWVRQSPGKGLEWVAAISFAGTKENYANSVRGRFTISRDNSKNTLYLQMNSLRAEDTALYYCTKDMREYECEEWTSDYYDFGRPQPCIDSRGVVGTFDVWGQGTMVTVSS

SEQ ID NO: 1754 - protein, 144 aa, Artificial Sequence
  anti-HIV_cap256-119-169092_VR-Chain
EVQLVESGGGLVQPGGSLRLSCVISGFTFSSYEMNWVRQAPGKGLEWVAGISYDGRDKYHAHFVWGRITISRDNSKNTLYLQMNSLRAEDTALYHCVRDLRESECELWESDYYDFGKKLPCVKPRGVAGIFDLWGQGTMVTVSS

SEQ ID NO: 1755 - protein, 144 aa, Artificial Sequence
  anti-HIV_cap256-119-168680_VR-Chain
QVQLVESGGGVVQPGRSLRVSCAASHFTFSRYGMHWVRQAPGKGLEWVASISYDGRDFYHARSVWGRFAISRDNSKNTLHLQMNSLRTEDTALYHCVRDLRESECELWESDYYDFGKKLPCVKPRGVAGTFDLWGQGTMVTVSS

SEQ ID NO: 1756 - protein, 146 aa, Artificial Sequence
  anti-HIV_cap256-119-166385_VR-Chain
QVQLVESGGGVVHPGRSLRLSCAASGFSFGNFGMHWVRQAPGKGLEWVASISNDGTKKYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1757 - protein, 144 aa, Artificial Sequence
  anti-HIV_cap256-119-165943_VR-Chain
EVQLVESGGGLVQPGRSLRLSCAVSGFTVSSNYMSWVRQAPGKGLEWVASISFAGIKKYYGDSVKGRFTISRDNSKNTLYLQMDGLRGEDTALYYCAKDLRELECEEWASDYYDFGRPQPCLDPRGVSGISNVWGQGTMVTVSS

SEQ ID NO: 1758 - protein, 144 aa, Artificial Sequence
  anti-HIV_cap256-119-165738_VR-Chain
EVQLVESGGGLVQPGRSLRLSCAASGFTFDDYAMNWVRQAPGKGLEWVATISFDGTDKYHADDVWGRFTISRDNSKKTLYLQMNSLRAEDTALYYCAKDLREDECEEWWSDYYDLGKQLPCRKSRGVAGVLDKWGLGTMVTVSS

SEQ ID NO: 1759 - protein, 144 aa, Artificial Sequence
  anti-HIV_cap256-119-164913_VR-Chain
QDHLVESGGGGVQPGKSLRLSCAASGFTFSAHAMHWVRQAPGKGPEWVAVISHDGGQQFYRESVKGRFTISRDNSKNTLYLQMDGLRGEDTALYYCAKDLRELECEEWASDYYDFGRPQPCLDPRGVSGISNVWGQGTMVTVSS

SEQ ID NO: 1760 - protein, 144 aa, Artificial Sequence
  anti-HIV_cap256-119-164167_VR-Chain
EVRLVESGGGLIQPGGSLRLSCAASGLTVSSNHMSWVRQAPGKGLEWVASISYDGRDFYHARSVWGRFTISRDNSKNTLHLQMNSLRPEDTALYFCARDLRESECEEWESYYYDFGKKGPCVKPRGVVGVLDIWGQGTLVTVSS

SEQ ID NO: 1761 - protein, 144 aa, Artificial Sequence
  anti-HIV_cap256-119-163558_VR-Chain
QMQLVESGGGVVQPGRSLTLSCAASQFNFANYGMHWVRQAPGKGLEWVASISYDGSDKYHADRVWGRFTISRDNSKNTLYLQMNSLRAEDTALYYCVRDARESECELWESDYYNFGRKLPCVKPRGVAGTLDIWGQGTMVTVSS

SEQ ID NO: 1762 - protein, 144 aa, Artificial Sequence
  anti-HIV_cap256-119-162043_VR-Chain
QVQLVESGGGVVQPGRSLRVSCAASHFTFSRYGMHWVRQAPGKGLEWVTGISFAATKTYYGDSVRGRFTVSRDISKNTLYLQMNSLRPEDTAMYYCARDQRYYECEEWASDYYDFGREQPCQDPRGVVGILDLWGQGTMVTVSS

SEQ ID NO: 1763 - protein, 144 aa, Artificial Sequence
  anti-HIV_cap256-119-161718_VR-Chain
QVQLVESGGGVVQPGKSLRLSCAASHFSFNRYGMHWVRQAPGKGLEWVAAISYDGTDKYHADQVWGRFTISRDNSKNTLYLQMNSLRPEDTALYYCAKDLREDECEEWWSDYYDLGKQLPCRKSRGVAGIFDKWGQGTMVTVSS

SEQ ID NO: 1764 - protein, 144 aa, Artificial Sequence
  anti-HIV_cap256-119-161675_VR-Chain
QVQLVESGGGVVQPGRSLRLSCTASGFTFSIYSMNWVRQAPGKGLDWVAGISFAATKTYYGGSVKGRFTVSRDISKNTLYLQMNSLRPEDTAMYYCARDQRYYECEEWASDYYDFGREQPCQDPRGVVGVFDMWGQGTMVTVSS

SEQ ID NO: 1765 - protein, 144 aa, Artificial Sequence
  anti-HIV_cap256-119-161053_VR-Chain
QVHLVESGGGVVQPGTSLRLSCVASGFTFSNFAMHWVRQAPGKGLEWAAIISTRGNNRNYADSVRGRFTVSRDISKNTLYLQMNSLRPEDTAMYYCARDQRYYECEEWASDYYDFGREQPCQDPRGVVGILDLWGQGTMVTVSS

SEQ ID NO: 1766 - protein, 144 aa, Artificial Sequence
  anti-HIV_cap256-119-159499_VR-Chain
QVQLVESGGGVVQPGRSLRLSCAASGFAFSHYGIFWVRQAPGKGLEWVASISFDGRDYYHSPHVWGRLTISRDNSKNTLYLQMNSLRAEDTALYYCARDLRESEREEWESDYYDFGKKGPCVKPRGVAGSLDMWGQGTMVIVSS

SEQ ID NO: 1767 - protein, 144 aa, Artificial Sequence
  anti-HIV_cap256-119-159114_VR-Chain
EVQLVESGGGLVQPGGSLRLACAASGLTFRKHGMHWVRQAPGKGLEWVSYISSDGVNNYLIDSVRGRFTVSRDNSKNTLYLQMDGLRGEDTALYYCAKDLRELECEEWASDYYDFGRPQPCLDPRGVSGISNVWGQGTMVTVSS

SEQ ID NO: 1768 - protein, 144 aa, Artificial Sequence
  anti-HIV_cap256-119-156751_VR-Chain
EVQLLESGGGLVQPGGSLRLSCAASGFAFSSYGMHWVRQAPGKGLEWVASISYDGRDFYHARSVWGRFTISRDNSKNTLHLQMNSLRPEDTALYFCARDLRESECEEWESYYYDFGKKGPCVKPRGVVGVLDIWGQGTLVTVSS

SEQ ID NO: 1769 - protein, 144 aa, Artificial Sequence
  anti-HIV_cap256-119-155656_VR-Chain
EVQLVESGGGLVQPGGSLRLSCAASGITFSSYGMHWVRQAPGKGLEWVAFIRYDGSSKYYADSVKGRFTISRDNSKNTLYLQMDGLRGEDTALYYCAKDLRELECEEWASDYYDFGRPQPCLDPRGVSGISNVWGQGTMVTVSS

SEQ ID NO: 1770 - protein, 144 aa, Artificial Sequence
  anti-HIV_cap256-119-154420_VR-Chain
QVRLVESGGGVVQPGRSLRISCAASQFMFSRYGMHWVRQAPGKGLEWVASISYDGTDKYHADLVWGRFTISRDNSKNTLYLQMNSLRAEDTALYYCARDLRESECEEWESDYYDFGKKGPCVKPRGVAGSLDMWGQGTMVIVSS

SEQ ID NO: 1771 - protein, 144 aa, Artificial Sequence
  anti-HIV_cap256-119-153954_VR-Chain
EVQVLESGGGLVQPGGSLRLSCVASQFTFSGCGLHWVRQAPGKGLEWVASISFAGTKKHYGNSVKGRFTISRDNSKNTVYLEMNSLRAEDTALYYCAKDLREYECEEWTSDYYDFGRPQPCIDSRGVVGILDIWGQGTMVTVSS

SEQ ID NO: 1772 - protein, 144 aa, Artificial Sequence
  anti-HIV_cap256-119-153864_VR-Chain
QVHLVESGGGVVQPGGSLRLSCAASGFTFSGCGLHWVRQAPGKGLEWVASISFAGTKKHYGSSVRGRFSISRDNSKNTLYLQMNSLRTEDTALYFCAKDLREYECEEWTSDYYDFGRPQPCIDSRGVVGILDIWGQGTMVTVSS

SEQ ID NO: 1773 - protein, 144 aa, Artificial Sequence
  anti-HIV_cap256-119-153793_VR-Chain
EVQLVESGGGVVQPGGSLRLSCATSGFTFGTFGMHWVRQAPGKGLDWVAYIRYDGKTKNYGESVKGRFTISRDNSKNTMSLQMNSLRPEDTALYYCAKDLREDECEERWSDYYDFGKQLPCRKSRGVAGVFDNWGQGTMVTVSS

SEQ ID NO: 1774 - protein, 144 aa, Artificial Sequence
  anti-HIV_cap256-119-153462_VR-Chain
QVQLVESGGGVVQPGGSLRLSCAASGFTFSNYGMQWVRQAPGKGLEWVAAISYDGRNEYYAESVKGRFTISRDNFKSTLFLQMNSLRAEDTALYYCARDLRESECEEWESDYYAFYRKLPCVKPRGVAGTLDIWGQGTMVTVSS

SEQ ID NO: 1775 - protein, 146 aa, Artificial Sequence
  anti-HIV_cap256-119-153124_VR-Chain
QVQLVESGGGVVQPGRSLTLSCIASQFNFASYGMHWVRQAPGKGLEWVASISHDGTKKYHAESVWGRFTISKDNSKNTLFLQMNSLRVEDTALYFCVKDQREDECEEWWSDYYDFGRELPCRKSRGLGLAGIFDMWGHGTMVTVSS

SEQ ID NO: 1776 - protein, 146 aa, Artificial Sequence
  anti-HIV_cap256-119-153025_VR-Chain
QMQLVESGGGVVQPGKSLTLSCAASQFTFSNYGMHWVRQAPGKGLEWVASISNDGNKKYHGDSVWGRLTISRDNSKNTLFLQMNSLRPEDTALYFCVKDQREDECEEWWSDYYDFGRELPCRKFRGLGLAGIFDIWGHGTMVTVSS

SEQ ID NO: 1777 - protein, 144 aa, Artificial Sequence
  anti-HIV_cap256-119-152713_VR-Chain
EVQLVESGGGLVRPGGSLRLSCATSGFTFSSHWMSWVRQAPGKGLEWVAGISFAGTKTYYGDSVKGRFTVSTDISKNTLYLQVNSLRPEDTAMYYCARDQRYYECEEWASDYYDFGKEQPCLDPRGVVGIFDIWGQGTMVTVSS

SEQ ID NO: 1778 - protein, 146 aa, Artificial Sequence
  anti-HIV_cap256-119-151794_VR-Chain
HVQLVESGGGVVQPGTSLRLSCVASEFSFKNYGMHWVRQAPGKGLEWVASISNDGTKKYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1779 - protein, 146 aa, Artificial Sequence
  anti-HIV_cap256-119-150980_VR-Chain
QVQLVESGGGVVQPGKSLRLSCAASGFILSNYAMHWVRQAPGKGLEWVASISNDGSKKYHGDSVWARFIISRDNSKNTLFLQMSSLRAEDTALYFCVRDHREDECEEWWSDYYDFGRELPCRKFRGLGLAGIFDIWGHGTMVTVSS

SEQ ID NO: 1780 - protein, 144 aa, Artificial Sequence
  anti-HIV_cap256-119-148895_VR-Chain
QVQLVESGGGVVQPGRSLRLSCAASGFTFRSYGMHWVRQAPGKGLEWVAVISSDGDIEYYTQSVKGRFTISRDNSKNTLYLQMNALRPEDTAMYYCARDQRYYECEEWASDYYDFGREQPCQDPRGVVGVFDMWGQGTMVTVSS

SEQ ID NO: 1781 - protein, 146 aa, Artificial Sequence
  anti-HIV_cap256-119-148848_VR-Chain
QMQLVESGGGVVQPGRSLTLSCAASQFSFTSYGMHWVRQAPGKGLEWVASISNDGTKKYHGESVWDRFSISRDNSKNTLFLQMNSLRVEDTALYFCVKDQREDECEEWWSDYYDFGKELPCRKWKTRGVAGILDNWGQGTMLTVSS

SEQ ID NO: 1782 - protein, 144 aa, Artificial Sequence
  anti-HIV_cap256-119-148743_VR-Chain
QVQLVESGGGVVQPGRSLTLSCAASQFNFANYGMHWVRQAPGKGLEWVASISNDGTKKYHAESVWDRFSISKDNSKNTLFLQMNSLRVEDTALYFCVKDQREDECEEWWSDYYDFGKKLPCRKSRGLAGIFHVWGHGTMVTVSS

SEQ ID NO: 1783 - protein, 144 aa, Artificial Sequence
  anti-HIV_cap256-119-148595_VR-Chain
EVQLVESGGGLVQPGGSLRLSCAASRFTFDNYGMHWVRQAPGKGLEWVALLNYDGSKKYYVDSVKGRFIIFRDNSKNTLFLQMNSLRPEDTALYFCVKDQREDACEEWWSDYYDFGKKLPCRKSRGLAGIFHVWGHGTMVTVSS

SEQ ID NO: 1784 - protein, 144 aa, Artificial Sequence
  anti-HIV_cap256-119-148490_VR-Chain
QVQLVESGGGVVQPGRSLRLSCVASGFTFSDYAMHWVRQAPGKGLEWVATISFDGADKYHADDVWGRFTISRDNSKNTLYLQMNSLRPEDTALYYCAKDLREDECEERWSDYYDFGKQLPCRKSRGVAGVFDNWGQGTMVTVSS

SEQ ID NO: 1785 - protein, 146 aa, Artificial Sequence
  anti-HIV_cap256-119-148470_VR-Chain
QVQLVESGGGVVQPGRSLRLSCVASGFTFSSYGIHWVRQAPGKGLEWVAVISDDGSKKYHEESVWGRFTISKDNSKNTLFLQMNSLRIEDTALYFCVKDQREDECEEWWSDYYDFGRELPCRKSRGLGLAGIFDMWGHGTMVTVSS

SEQ ID NO: 1786 - protein, 144 aa, Artificial Sequence
  anti-HIV_cap256-119-148107_VR-Chain
EVQLVESGGGLVQPGGSLRLSCAASGFTVSSNYMTWVRQAPRKGLEWVGSISYDGSDKYHTNSLWGRFIVSRDNSKNTLYLQMNNLRPEDTALYYCVRDRRESECEERWSDYYDFGKQLPCVKPRGVAGIFDIWGQGTMVTVSS

SEQ ID NO: 1787 - protein, 144 aa, Artificial Sequence
  anti-HIV_cap256-119-147933_VR-Chain
ELQLVESGGGLVQPGWSLRLSCEASGFPFSAFWMTWVRQAPGKGLGWVAFIRYDGSNKYYADSVKGRFTISRDNSMTTLYLQMNSLRAEDAAVYYCAKDLREDECEEWWSDYYDFGKRLPCRKSRGVAGVFDKWGQGTMVTVSS

SEQ ID NO: 1788 - protein, 144 aa, Artificial Sequence
  anti-HIV_cap256-119-147434_VR-Chain
QVQLVESGGGVVQAGRSLRLSCAASQFTFGRYGMHWVRQAPGKGLEWVGSISYDGSDKYHTNSVWGRFIVSRDNSKNTLYLQMNSLRPEDTAMYYCARDQRYYECEEWASDYYDFGREQPCQDPRGVVGVFDMWGQGTMVTVSS

SEQ ID NO: 1789 - protein, 145 aa, Artificial Sequence
  anti-HIV_cap256-119-146106_VR-Chain
QVQLVESGGGVVQPGRSLRLSCAASGFTFSSSGMHWVRQAPGKGLQWVAVISYDGGNKYYADSVKGRFTISRDNSKNNLYLQMNSLRPEDTALYYCARDLREMECEEWKLYNYYDFRTRGPCVDPRGVVGSFDVWGQGTVVTVSS

SEQ ID NO: 1790 - protein, 146 aa, Artificial Sequence
  anti-HIV_cap256-119-145604_VR-Chain
DVQLAESGGGLVQPGGSLRLSCVASGFTFSSFEMHWVRQAPGKGLEWVASISNDGTKRYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1791 - protein, 146 aa, Artificial Sequence
  anti-HIV_cap256-119-143998_VR-Chain
QVQLVESGGGVVQPGRSLRLSCAASGFTFRNYGMHWVRQAPGKGLEWVASISNDGSKKYHGDSVWARFIISRDNSKNTLFLQMSSLRAEDTALYFCVKDQREDECEEWWSDYYDFGRELPCRKSRGLGLAGIFDMWGHGTMVTVSS

SEQ ID NO: 1792 - protein, 146 aa, Artificial Sequence
  anti-HIV_cap256-119-143441_VR-Chain
EVHLVESGGGLAQPGRSLRLSCAASQFNFASYGMHWVRQAPGKGLEWVASISNDGTKRYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1793 - protein, 144 aa, Artificial Sequence
  anti-HIV_cap256-119-141307_VR-Chain
QVHLVESGGGVVQPGRSLRLSCAASQFTFNRYGLHWVRQAPGKGLEWVAGISYDGRDKYHAHFVWGRFIISRDNSKNTLYLQMNSLRAEDTALYYCVRDLRESECELWESDYYDFGKRLPCVKPRGVAGTFDLWGQGTMVTVSS

SEQ ID NO: 1794 - protein, 144 aa, Artificial Sequence
  anti-HIV_cap256-119-140896_VR-Chain
EVKLVESGGGLVQPGGSLKLSCAASGFTFSYYAMHWVRQAPGKGLEWVAVISYDGSDKYYADSVKGRFTISRDNSKNTLHLQMNSLRPEDTALYFCARDLRESECEEWESYYYDFGKKGPCVKPRGVVGVLDIWGQGTLVTVSS

SEQ ID NO: 1795 - protein, 144 aa, Artificial Sequence
  anti-HIV_cap256-119-140090_VR-Chain
EVQLVESGGGLVQPGGSLRLSCAASGFAFSSYWMTWVRQAPGKGLEWVAVISYDGSNKYYADSVRGRFTISRDSSKNTLYLEMNSLRPEDTALYYCAKDMRGYECEEWTSDYYDFGRPQPCIDSRGVVGTFDVWGQGTMVTVSS

SEQ ID NO: 1796 - protein, 146 aa, Artificial Sequence
  anti-HIV_cap256-119-140037_VR-Chain
QVQLVESGGGLVQPGRSLRLSCAASGFTFDDYVMHWVRQAPGKGLEWVASISNDGTKKYHEESVWGRFTISKDNSKSTLFLQMNSLRIEDTALYFCVKDQREDECEEWWSDYYDFGRELPCRKSRGLGLAGIFDMWGHGTMVTVSS

SEQ ID NO: 1797 - protein, 144 aa, Artificial Sequence
  anti-HIV_cap256-119-139135_VR-Chain
EVQLVESGGGVVRPGGSVRLSCVASGFSFRSYGMHWVRQAPGKGLEWVASISYDGRDFYHARSVWGRFTISRDNSKNTLHLQMNSLRPEDTALYFCARDLRESECEEWESYYYDFGKKGPCVKPRGVVGVLDIWGQGTLVTVSS

SEQ ID NO: 1798 - protein, 146 aa, Artificial Sequence
  anti-HIV_cap256-119-137881_VR-Chain
QVQLVESGGGLVKPGRSLTLSCAASQFTFSNYGMHWVRQAPGKGLEWVASISNDGNKKYHGDSVWARFTISRDNSKNTLFLQMSSLRTEDTALYFCVRDRREDECEEWWSDYYDFGRELPCRKFRGLGLAGIFDIWGHGTMVTVSS

SEQ ID NO: 1799 - protein, 144 aa, Artificial Sequence
  anti-HIV_cap256-119-137643_VR-Chain
EVQLVESGGDLVQPGGSLRLSCAASGFSFSSYGMHWVRQAPDKGLEWVTVISYDGSNKHYADSVKGRFTISRDNSKNTLYLEMNTLRAEDTALYYCAKDLREYECEEWTSDYYDFGRPQPCIDSRGVVGILDIWGQGTMVSVSS

SEQ ID NO: 1800 - protein, 146 aa, Artificial Sequence
  anti-HIV_cap256-119-137170_VR-Chain
QVQLVESGGGVVQPGRSLRLSCAASEFTFSRYSMHWVRQAPGKGLEWVAVISSDGSNQFHADSVWGRFTISKDNSKNTLFLQMNSLRIEDTALYFCVKDQREDECEEWWSDYYDFGRELPCRKSRGLGLAGIFDMWGHGTMVTVSS

SEQ ID NO: 1801 - protein, 144 aa, Artificial Sequence
  anti-HIV_cap256-119-136616_VR-Chain
QVQLVESGGGVVQPGRSLRLSCAASGFTFSRNAINWVRQAPGRGLEWVAVISDDGSLKYYADSVKGRFTISRDNSKNTLYLQMNNLRPEDTALYYCVRDRRESECEERWSDYYDFGKQLPCVKPRGVAGIFDIWGQGTMVTVSS

SEQ ID NO: 1802 - protein, 144 aa, Artificial Sequence
  anti-HIV_cap256-119-136206_VR-Chain
QVQLVESGGGVVQPGRSLRLSCAASQFTFGRYGMHWVRQAPGKGLEWVAAISFAGTKKYYGDSARGRFTISRDNSKNMLFLQMNSLRAEDTALYYCARDLRDYECEEWEAYYYDFGRVGPCTDPRGVVGILDVWGQGTLVTVSS

SEQ ID NO: 1803 - protein, 146 aa, Artificial Sequence
  anti-HIV_cap256-119-135565_VR-Chain
QVHLVESGGGVVQPGKSLRLSCAASQFTFDRYGMHWVRQAPGKGLEWVASISNDGTDKYHADNVWGRFTISRDNSKNTLYLEMNSLRGEDTALYFCVKDQREDECEEWWSDYYDFGRELPCRKSRGLGLAGIFDMWGHGTMVTVSS

SEQ ID NO: 1804 - protein, 144 aa, Artificial Sequence
  anti-HIV_cap256-119-135025_VR-Chain
EVQLVESGGGLVQPGGSLRLSCEASGFTFNTYEMNWVRQPPGRGLEWVAGISFAATKTYYGGSVKGRFTVSRDISKNTLYLQMDGLRGEDTALYYCAKDLRELECEEWASDYYDFGRPQPCLDPRGVSGISNVWGQGTMVTVSS

SEQ ID NO: 1805 - protein, 144 aa, Artificial Sequence
  anti-HIV_cap256-119-133983_VR-Chain
QMQLVESGGGVVQPGRSLTLSCAASQFNFANYGMHWVRQAPGKGLEWVASISNDGTKKYHEESVWGRFTISKDNSKNTLFLQMNSLRPEDTALYYCAKDLREDECEERWSDYYDFGKQLPCRKSRGVAGVFDNWGQGTMVTVSS

SEQ ID NO: 1806 - protein, 146 aa, Artificial Sequence
  anti-HIV_cap256-119-133917_VR-Chain
QMQLVESGGGVVQPGRSLTLSCAASQFTFSNYGMHWVRQAPGKGLEWVASISNDGSKKYHGDSVWARFTISRDNSKNTLFLQMSSLRVEDTALYFCVRDQREDECEEWWSDYYDFGRELPCRKFRGLGLAGIFDIWGHGTMVTVSS

SEQ ID NO: 1807 - protein, 144 aa, Artificial Sequence
  anti-HIV_cap256-119-132663_VR-Chain
QAQLVESGGGVVQPGRSLRISCAVSQFTFSRYGMHWVRQAPGKGLEWVASISFDGRDKYHSPLVWGRLTISRDNSKNTLFLEMNSLRAEDTAVYYCARDLRESECEEWQSDYYAFYKKLPCVKPRGVAGSLDIWGQGTVVTVSS

SEQ ID NO: 1808 - protein, 146 aa, Artificial Sequence
  anti-HIV_cap256-119-132113_VR-Chain
QVQLVESGGGLVKPGGSLRLSCAASQFNFANYGMHWVRQAPGKGLEWVASISNDGTKKYHEESVWGRFTISKDNSKSTLFLQMNSLRIEDTALYFCVKDQREDECEEWWSDYYDFGRELPCRKSRGLGLAGIFDMWGHGTMVTVSS

SEQ ID NO: 1809 - protein, 144 aa, Artificial Sequence
  anti-HIV_cap256-119-131839_VR-Chain
QVQLVESGGGVVQPGRSLRLSCAASGFTFSSYAMHWVRQAPGKGLEWVAVISYDGSNKYYADSVKGRFTISRDNSKNTLYLQMNSLRAEDTAVYYCARDQRYYECEEWASDYYDFGREQPCQDPRGVVGVFDMWGQGTMVTVSS

SEQ ID NO: 1810 - protein, 145 aa, Artificial Sequence
  anti-HIV_cap256-119-130626_VR-Chain
EVQLVESGGGLIHPGGCLRLSCAVSGFTFSDYPMHWVRQSPGKGLEWVAVISYDGINYYYADSVKGRFTISRDNSKNNLFLQMNSLRLEDTALYYCARDLRELDCEEWTLYNYYDFGSRGPCVDPRGVGGSFDVWGQGTMVTVSS

SEQ ID NO: 1811 - protein, 146 aa, Artificial Sequence
  anti-HIV_cap256-119-130191_VR-Chain
EVQLVESGGGLIQPGRSLRLSCAASGFTVSSNFMTWVRQAPGKGLEWVASISNDGTKKYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1812 - protein, 146 aa, Artificial Sequence
  anti-HIV_cap256-119-129798_VR-Chain
QVQLVESGGGVVQPGKSLRLSCAASGFIFSSYFMHWVRQAPGKGLEWVAVVTDDGSKKYYADSVKGRFTISRDYSKNTLFLQMNRLRVEDTALYFCVKDQREDECEEWWSDYYDFGRELPCRKFRGLGLAGIFDMWGHGTMVTVSS

SEQ ID NO: 1813 - protein, 144 aa, Artificial Sequence
  anti-HIV_cap256-119-128745_VR-Chain
QVQLVESGGGVVQPGRSLRLSCAASGFTFSNYAMHWVRQAPGKGLEWVASISFAGTKTHYGNSVKGRFSISRDNSINTVYLQMNSLRAEDTALYYCAKDLREYECEEWTSDYYDFGRPQPCIDSRGVVGILDIWSQGTMVTVSS

SEQ ID NO: 1814 - protein, 146 aa, Artificial Sequence
  anti-HIV_cap256-119-128593_VR-Chain
QVQLVESGGGVVQPGRSLRLSCAASGFTFSSYAMHWVRQAPGKGLEWVASISYDGRDFYHARSVWGRFTISRDNSKNTLHLQMNSLRVEDTALYFCVKDQREDECEEWWSDYYDFGRELPCRKSRGLGLAGIFDIWGHGTMVTVSS

SEQ ID NO: 1815 - protein, 146 aa, Artificial Sequence
  anti-HIV_cap256-119-128152_VR-Chain
QVQLVESGGGVVQPGRSLRLSCAVSGFTFTSYPMHWVRQAPGKGLEWVASVSNDGTKKYHGDSVWDRFTISRDNSKNTLFLQMSSLRAEDTAVYFCVRDEREDECEEWWSDYYDFGRELPCRKFRGLGLAGIFDIWGHGTLVTVSS

SEQ ID NO: 1816 - protein, 146 aa, Artificial Sequence
  anti-HIV_cap256-119-127693_VR-Chain
EVQLLESGGGLVQPGGSLRLSCAASGFTFSSYAMAWVRQAPGKGLEWVASISNDGSKKYHGDSVWARFIISRDNSKNTLFLQMSSLRVEDTALYFCVRDHREDECEEWWSDYYDFGRELPCRKFRGLGLAGIFDIWGHGTMVTVSS

SEQ ID NO: 1817 - protein, 144 aa, Artificial Sequence
  anti-HIV_cap256-119-126684_VR-Chain
QVQLVESGGGAVRPGRSLRLSCATSGFTFSNYAMHWVRQAPGKGLEWVTGISFAGTKTYYGDSVRGRFTVSRDISKNTLFLQMNSLRPDDTAMYYCARDQRYYECEEWASDYYDFGREQPCLDPRGVVGIFDLWGQGTMVTVSS

SEQ ID NO: 1818 - protein, 146 aa, Artificial Sequence
  anti-HIV_cap256-119-126056_VR-Chain
EVQLVESGGGLVQPGGSLRLSCADSGFTFSSYWMSWVRQAPGKGLEWVASISNDGTKKYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1819 - protein, 144 aa, Artificial Sequence
  anti-HIV_cap256-119-125765_VR-Chain
QVQLVQSGGGVVQPGRSLRLSCAASGFTFSSYVMHWVRQAPGKGLEGVAVISFDGNNEYYADSVKGRFTISRDNSKNTVYLQMNSLRVEDTALYYCAKDMREYECEEWTSDYYDFGRPQPCIDSRGVVGILDIWGQGIMVTVSS

SEQ ID NO: 1820 - protein, 146 aa, Artificial Sequence
  anti-HIV_cap256-119-125106_VR-Chain
QVQLVESGGGVVQPGRSLRLSCAASGFIFRSYGMHWVRQAPGKGLEWVASISNDGTKRYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1821 - protein, 145 aa, Artificial Sequence
  anti-HIV_cap256-119-124026_VR-Chain
QVQLVESGGGVVQSGRSLRLTCSGSAFRFSSYTVHWVRQAPGKGLEWLALISYDGQKKHFADSVKGRFTISRDNSKNNLFLQMNSLRLEDTALYYCARDLRELDCEEWTLYNYYDFGSRGPCVDPRGVGGSFDVWGQGTMVTVSS

SEQ ID NO: 1822 - protein, 144 aa, Artificial Sequence
  anti-HIV_cap256-119-121783_VR-Chain
LGRLVASGGGVVPPGGSLTLSCVTSQFTFSGCGLHWVRQAPGKGLEWVASISFAGTKKHYGSSVRGRFSISRDNSKNTLYLQMNSLRTEDTALYFCAKDLREYECEEWTSDYYDFGRPQPCIDSRGVVGILDIWGQGTMVTVSS

SEQ ID NO: 1823 - protein, 144 aa, Artificial Sequence
  anti-HIV_cap256-119-121208_VR-Chain
LGRLVASGGGVVPPGKSLTLSCVASQFTFSGCGLHWVRQAPGKGLEWVASISFAGTKKHYGNFVRGRFTISRDNSKNTLYLQMNSLRAEDTALYYCAKDLREYECEEWTSDYYDFGRPQPCIDSRGVVGILDIWGQGTMVTVSS

SEQ ID NO: 1824 - protein, 144 aa, Artificial Sequence
  anti-HIV_cap256-119-120945_VR-Chain
QVQLVESGGGVVQPGGSLRLSCVASGFTFSNYGMHWVRQAPGKGLAWVAFIRYDGSNKYYVDSVWGRFTISRDNSKNTLHLQMNSLRPEDTALYFCARDLRESECEEWESYYYDFGNKGPCVKPRGVVGVLDIWGQGTLVTVSS

SEQ ID NO: 1825 - protein, 144 aa, Artificial Sequence
  anti-HIV_cap256-119-118229_VR-Chain
QVQVVESGGGVVQPGRSLRLSCAASGFTFSNYAIHWVRQAPGKGLEWVALISYDGYNKYYADSVRGRFTISRDNSNNTVYLQMNSLKPEDTAVYYCARDLRESECEEWESYYYDFGKKGPCVKPRGVVGVLDIWGQGTLVTVSS

SEQ ID NO: 1826 - protein, 144 aa, Artificial Sequence
  anti-HIV_cap256-119-118025_VR-Chain
EVQLVESGGGVVQPGKSLRLSCTASQFTFSNFGMHWVRQAPGKGLEWVASISFVGIKTHYANSVRGRFTISRDQSKNTLYLQMNSVRIEDTARYFCARDMREYECELWASDYYDFGKPQPCEDPRGVVGTFDMWGLGTLVTVSS

SEQ ID NO: 1827 - protein, 144 aa, Artificial Sequence
  anti-HIV_cap256-119-117418_VR-Chain
QVQLVESGGGVVQPGRSLRLSCAASGFNFRNYDINWVRQVPGKGLEWVAAISFDGADKYHADNVWGRLSISRDNSKSTLYLQMNSLRPEDTAVYFCAKDLREDECEERWSDYYDFGKQLPCRKSRGVAGIFDNWGQGTMVTVSA

SEQ ID NO: 1828 - protein, 144 aa, Artificial Sequence
  anti-HIV_cap256-119-117250_VR-Chain
QVRLVESGGGVVQPGGSLRLSCAASQFTFSAYGMHWVRQAPGKGLEWVASISFDGTDKFHADKVWGRLVISRDNSKNTLYLQMNSLRPEDTAVYYCAKDLREDECEERWSDYYDFGKQLPCRKSRGVAGVFDNWGQGTMVTVSS

SEQ ID NO: 1829 - protein, 144 aa, Artificial Sequence
  anti-HIV_cap256-119-117230_VR-Chain
QVQLVESGGGGVQPGRSLRLSCAASGFTLSSYGMHWVRQAPGKGLEWVASISFDGRDYYHSPHVWGRLTISRDNSKNTLYLQMNSLRAEDTALYYCARDLRESECEEWESDYYDFGKKGPCVKPRGVAGSLDMWGQGTMVIVSS

SEQ ID NO: 1830 - protein, 144 aa, Artificial Sequence
  anti-HIV_cap256-119-116999_VR-Chain
QVQLVESGGGVVQPGTSLRISCAASQFTFSRYGMHWVRQAPGKGLEWVASISYDGRDYYHAGRVWGRFTISRDNSKNTLYLQMNSLRPEDTALYFCVRDSRESECEEWESDYYDFGKKLPCVKPRGVVGVLDLWGQGTLVTVSS

SEQ ID NO: 1831 - protein, 144 aa, Artificial Sequence
  anti-HIV_cap256-119-116558_VR-Chain
QVQLVESGGGVVQPGRSLRLSCAASGFTFNRYSLHWVRQAPGKGLEWVAFTSYDGSNKYYPDSVKGRFTISRDSSKNTLYLEMNSLRPEDTALYYCAKDMRGYECEEWTSDYYDFGRPQPCIDSRGVVGTFDVWGQGTMVTVSS

SEQ ID NO: 1832 - protein, 144 aa, Artificial Sequence
  anti-HIV_cap256-119-116484_VR-Chain
DVQLLESGGDLVQPGGSLRLSCAASGFTFTKYEMTWVRQAPGKGLEWVASISYDGSDKYHTSSLWGRFIVSRDNSKNTLYLQMNSLRPEDTALYYCVRDRRESECEERWSDYYDFGKQLPCVKPRGVAGIFDIWGQGTMVTVSS

SEQ ID NO: 1833 - protein, 146 aa, Artificial Sequence
  anti-HIV_cap256-119-114844_VR-Chain
EVQLVESGGDLVQPGRSLRLSCAASGFTFSSYWMSWVRQAPGKGLEWVASISNDGTKKYHEESVWGRFTISKDNSKSTLFLQMNSLRVEDTALYFCVKDQREDECEEWWSDYYDFGRELPCRKSRGLGLAGIFDMWGHGTMVTVSS

SEQ ID NO: 1834 - protein, 146 aa, Artificial Sequence
  anti-HIV_cap256-119-114141_VR-Chain
GGRSGGGGVGTTPRRGPLRLSCAASGFTLDDYAMHWVRQAPGKGLEWVASISNDGTKKYHAESVWDRFSISKDNSKNTLFLQMNSLRVEDTALYFCVKDQREDECEEWWSDYYVFWERAPCRTVPGRGPGWYFDMVGRRTMVTVSS

SEQ ID NO: 1835 - protein, 144 aa, Artificial Sequence
  anti-HIV_cap256-119-111917_VR-Chain
EVHLVESGGGLVQPGGSLRLSCAASGFTFSSYGMHWVRQAPGKGLEWVATISFDGADKYHADDVWGRFSISRDNSKNTLYLQMNNLRPEDTALYYCAKDLREDECEERWSDYYDFGKQLPCRKSRGVAGVFDNWGQGTMVTVSS

SEQ ID NO: 1836 - protein, 144 aa, Artificial Sequence
  anti-HIV_cap256-119-111862_VR-Chain
QVQLVESGGGVVQPGGSLRLSCAASGFTYSDYGMHWVRQAPGKGLEWVASISFAGTKQHYGNSVKGRFTISRDNSKNTVYLQMNSLRVEDTALYYCAKDMREYECEEWTSDYYDFGRPQPCIDSRGVVGILDIWGQGIMVTVSS

SEQ ID NO: 1837 - protein, 144 aa, Artificial Sequence
  anti-HIV_cap256-119-110064_VR-Chain
LGRLVASGGGVVPPGRSLRLSCVASQFTFSGCGLHWVRQAPGKGLEWVASISFAGTKQHYGNSVKGRFTISRDNSKNTVYLQMNSLRVEDTALYYCAKDMREYECEEWTSDYYDFGRPQPCIDSRGVVGILDIWGQGTMVTVSF

SEQ ID NO: 1838 - protein, 144 aa, Artificial Sequence
  anti-HIV_cap256-119-109192_VR-Chain
QVQLVESGGGVVQPGRSLRLSCAASGFTFSNYAMHWVRQAPGKGLEWVAVIAYDGDNKYYADSVKGRFTISRDNSKNTLYLQMNSLRAEDTALYYCAKDLREDECEEWWSDYYDLGKQLPCRKSRGVAGVLDKWGLGTMVTVSS

SEQ ID NO: 1839 - protein, 145 aa, Artificial Sequence
  anti-HIV_cap256-119-108793_VR-Chain
QFQLVESGGGVVQPGRSLRLSCAASGFTFSSYPMHWVRQAPGKGLEWVALISYDGTDKYYADSVKGRFTISRDNSKNTLYLQMNSLRVEDTAVYHCAKDLGGSKSDEWATDYYYDWSKAYPVHDPRAVVGVFDIWGQGTLVTVSS

SEQ ID NO: 1840 - protein, 144 aa, Artificial Sequence
  anti-HIV_cap256-119-108127_VR-Chain
QVQLVESGGGVVQPGRSLRISCAASQFTFNRYGMHWVRQAPGKGLEWVASISYDGSDKYHAGLVWGRFIISRDNSKNTLYLQMNSLRAEDTALYYCVRDRRESECEERWSDYYDFGKQLPCVKPRGVAGIFDIWGQGTMVTVSS

SEQ ID NO: 1841 - protein, 146 aa, Artificial Sequence
  anti-HIV_cap256-119-107758_VR-Chain
EVQLVESGGGLVKPGGSLRLSCAASGFTFSNAWMSWVRQAPGKGLEWVASISNDGTKKYHEESVWGRFTISKDNSKNTLFLQMNSLRIEDTALYFCVKDQREDECEEWWSDYYDFGRELPCRKSRGLGLAGIFDMWGHGTMVTVSS

SEQ ID NO: 1842 - protein, 144 aa, Artificial Sequence
  anti-HIV_cap256-119-107209_VR-Chain
EVQLVESGGGLVQPGRSLRLSCTASGFTFGDYGMHWVRQAPGKGLEWVAAISFDGADKYHADNVWGRLSISRDNSKSTLYLQMNSLRPEDTAVYFCAKDLREDECEERWSDYYDFGKQLPCRKSRGVAGIFDNWGQGTMVTVSA

SEQ ID NO: 1843 - protein, 144 aa, Artificial Sequence
  anti-HIV_cap256-119-107184_VR-Chain
QAQLVESGGGVVQPGRSLGLSCAASKFSLSSYGMHWVRQAPGRGLEWVAGISFAGTKKYYADSVRGRFSVSTDISKNTLYLQMNSLRPADTALYFCARDLRYYECEEWASDYYDFGKEQPCLDPRGVVGIFDLWGQGTMVTVSS

SEQ ID NO: 1844 - protein, 146 aa, Artificial Sequence
  anti-HIV_cap256-119-106827_VR-Chain
AVQLVESGGGLVQPGGSLRLSCSVSQFTFGRYGMYWVRQAPGKGLEWVAVISYDGGNRYYADSVKNRFSISRDNSKNTLFLQMSSLRAEDTALYFCVRDHREDECEEWWSDYYDFGRELPCRKFRGLGLAGIFDIWGHGTMVTVSS

SEQ ID NO: 1845 - protein, 144 aa, Artificial Sequence
  anti-HIV_cap256-119-106511_VR-Chain
QVQLVESGGGVVQPGRSLRLSCVASQFSFDRYGMHWVRQAPGKGLEWVASISFDGTDKYHADKVWGRFTISRDNSKNTLYLQMNSLRPEDTALYYCAKDMREDECEAWWSDYYDLGKQLPCRESRGVAGIFDEWGQGTMVTVSS

SEQ ID NO: 1846 - protein, 144 aa, Artificial Sequence
  anti-HIV_cap256-119-106327_VR-Chain
QVQLVESGGGVVQPGRSLRLSCAASGFTFSSYAMHWVRQAPGKGLEWVAAISGGGGNTYVADSVKGRFTISRDNSKNTVYLQMNSLRLEDTALYYCAKDLREYECEEWTSDYYDFGRPQPCIDSRGVVGILDIWGQGTMVTVSS

SEQ ID NO: 1847 - protein, 146 aa, Artificial Sequence
  anti-HIV_cap256-119-105486_VR-Chain
QVQLVESGGGVVQPGGSLRLSCAASGFTVSGYGMHWVRQAPAKGLDWVAFISHDGSNKYYADSVRGRFIISRDNSNNTLYVQMSSLRAEDTALYFCVRDHREDECEEWWSDYYDFGRELPCRKFRGLGLAGIFDIWGHGTMVTVSS

SEQ ID NO: 1848 - protein, 144 aa, Artificial Sequence
  anti-HIV_cap256-119-105197_VR-Chain
QVQLVESGGGVVQPGRSLRLSCAVSQFTFGRYGMHWVRQAPGKGLEWVGSISYDGSDKYHTNSLWGRFIVSRDNSKNTLYLQMNNLRPEDTALYYCVRDRRESECEERWSDYYDFGKQLPCVKPRGVVGVLDIWGQGTLVTVSS

SEQ ID NO: 1849 - protein, 144 aa, Artificial Sequence
  anti-HIV_cap256-119-104946_VR-Chain
QEQLVESGGGVVQPGRSLRLSCVASRFTFSAFGMHWVRQAPGKGLEWVASISFAGIKKYYGDSVKGRFTISRDNSKNTLYLQMDGLRGEDTALYYCAKDLRELECEEWASDYYDFGRPQPCIDSRGVVGILDIWGQGIMVTVSS

SEQ ID NO: 1850 - protein, 144 aa, Artificial Sequence
  anti-HIV_cap256-119-103667_VR-Chain
QVHLVESGGGVVQPGKSLRLSCAASQFTFNRFGMHWVRQAPGKGLEWVAGISYDGSDKYHADKVWGRFTISRDNSKNTLYLQMNSLRAEDTALYYCAKDLREDECEEWASDYYDFGKEQPCLDPRGVVGIFDIWGQGTMVTVSS

SEQ ID NO: 1851 - protein, 146 aa, Artificial Sequence
  anti-HIV_cap256-119-103385_VR-Chain
EVQLVESGGGLVQTGGSLRLSCAASGFTFSRYDMNWVRQAPGKGLEWVASISNDGSKKYHGDSVWARFTISRDNSKNTLFLQMSSLRVEDTALYFCVRDQREDECEEWWSDYYDFGRELPCRKFRGLGLAGIFDIWGHGTMVTVSS

SEQ ID NO: 1852 - protein, 146 aa, Artificial Sequence
  anti-HIV_cap256-119-103267_VR-Chain
EVPSVESGGGLVQTGGSLTLSCAASQFTFSNYGMHWVRQAPGKGLEWVASISNDGSKKYHGDSVWARFIISRDNSKNTLFLQMSSLRAEDTALYFCVRDHREDECEEWWSDYYDFGRELPCRKFRGLGLAGIFDIWGHGTMVTVSS

SEQ ID NO: 1853 - protein, 144 aa, Artificial Sequence
  anti-HIV_cap256-119-103011_VR-Chain
QVQLVESGGGVVQPGGSLRLSCATSGFTFGTFGMHWVRQAPGKGLDWVAAISFAGTKKNYADSVRGRFTISRDSSKNTLYLQMNSLRPEDTALYYCVKDMRGYECEEWTSDYYDFGRPQPCIDSRGVVGTFDVWGQGTMVTVSS

SEQ ID NO: 1854 - protein, 146 aa, Artificial Sequence
  anti-HIV_cap256-119-102072_VR-Chain
EVQLVESGGGLVQPGGSLRVSCAVSGFTFSNYEMNWVRQAPGKGLEWVASISNDGTKKYHAESVWDRFSISKDNSKNTLFLQMNSLRVEDTALYFCVKDQREDECEEWWSDYYDFGRELPCRKSRGLGLAGIFDIWGHGTMVTVSS

SEQ ID NO: 1855 - protein, 146 aa, Artificial Sequence
  anti-HIV_cap256-119-101945_VR-Chain
EVQLVESGGGLVQPGGSLRLSCAASGFTFSSYVMHWVRQAPGKGLEWVASISNDGTKKYHEESVWGRFTISKDNSKNTLFLQMNSLRIEDTALYFCVKDQREDECEEWWSDYYDFGRELPCRKSRGLGLAGIFDMWGHGTMVTVSS

SEQ ID NO: 1856 - protein, 144 aa, Artificial Sequence
  anti-HIV_cap256-119-101319_VR-Chain
QVQLVESGGGVVQPGKSLRLSCVGSGFTFDDYGMHWVRQAPGKGLEWVASISYDGRDFYHARSVWGRFTISRDNSKNTLHLQMNSLRPEDTALYFCARDLRESECEEWESYYYDFGKKGPCVKPRGVVGVLDIWGQGTLVTVSS

SEQ ID NO: 1857 - protein, 144 aa, Artificial Sequence
  anti-HIV_cap256-119-100871_VR-Chain
QVQLVESGGGVVQPGESLRISCAASQFTFSRYGMHWVRQAPGKGLEWVASISFDGRDKYHSSLVWGRLTISRDNSKSTLFLQMNSLRAEDTALYYCARDLRESECEEWESDYYDFGKPQPCEDPRGVVGTFDMWGLGTLVTVSS

SEQ ID NO: 1858 - protein, 144 aa, Artificial Sequence
  anti-HIV_cap256-119-100838_VR-Chain
EVQLVESGGGVVQPGGSLRLSCAASGFTFSSYGMHWVRQAPGKGLEWVAFIRYDGSNKYYADSVKGRFTISRDNSNHTLYMQLDSLRAEDTALYYCAKDLREYECEEWTSDYYDFGRPQPCIDSRGVVGILDIWSQGTMVTVSS

SEQ ID NO: 1859 - protein, 146 aa, Artificial Sequence
  anti-HIV_cap256-119-100025_VR-Chain
QVQLVESGGGVVQPGRSLRLSCAASVFTFSYYGMHWVRQAPGKGLEWVAFISHDGSNKYYADSVRGRFIISRDNSNNTLYVQMNSLRAEDTALYFCVKDQREDECEEWWSDYYDFGRELPCRKFRGLGLAGTFDIWGHGTMLIVSS

SEQ ID NO: 1860 - protein, 144 aa, Artificial Sequence
  anti-HIV_cap256-119-100000_VR-Chain
QMQLVESGGGVVQPGRSLTLSCAASQFTFSNYGMHWVRQAPGKGLEWVASISNDGNKKYHGDSVWARFTISRDNSKNTLFLQMSSLRTEDTALYFCVRDRRESECEERWSDYYDFGKQLPCVKPRGVAGIFDIWGQGTMVTVSS

SEQ ID NO: 1861 - protein, 144 aa, Artificial Sequence
  anti-HIV_cap256-119-098890_VR-Chain
QVQLVESGGGVVQPGESLRISCVASQFTFGRYGMHWVRQAPGKGLEWVASISFDGRDKYHSPLVWGRLTISRDNSKNTLFLQMNSLRTEDTALYYCARDLRESECEEWESDYYAFWRKLPCVKPRGVAGTLDIWGQGTMVSVSS

SEQ ID NO: 1862 - protein, 145 aa, Artificial Sequence
  anti-HIV_cap256-119-098715_VR-Chain
QVQLVESGGGVVQPGRSLRLSCAASGFSFNNHGMHWVRQAPGKGLEWVAGISFAGIKKYYGTSVKGRFTISRDNSKNNLFLQMNSLRVEDTALYYCARDLREMECEEWTLYNYYDFGSRGPCVDPRGVVGSFDVWGQGTMVTVSS

SEQ ID NO: 1863 - protein, 146 aa, Artificial Sequence
  anti-HIV_cap256-119-098632_VR-Chain
QMQLVESGGGVVQPGRSLTLSCAASQFNFANYDMHWVRQAPGKGLEWVAFIRYDGNNKYYADSVKGRFTISRDNSKSTLFLQMNSLRIEDTALYFCVKDQREDECEEWWSDYYDFGRELPCRKSRGLGLAGIFDMWGHGTMVTVSS

SEQ ID NO: 1864 - protein, 144 aa, Artificial Sequence
  anti-HIV_cap256-119-097199_VR-Chain
QVQLVESGGGVVQPGRSLRLSCAASGFAFSSYAFHWVRQAPGKGLEWVAYIPFHGNQQYYGDSVKGRFTISRDNSRDTLFLEMNSLRPEDTALYFCARDQRYYECEEWASDYYDFGREQPCLDPRGVVGIFDLWGQGTMVTVSS

SEQ ID NO: 1865 - protein, 144 aa, Artificial Sequence
  anti-HIV_cap256-119-096189_VR-Chain
QVQLVESGGGVVQPGRSLRLSCAASGFKFGSFGMHWVRQAPGKGLEWVAVISYDGSDKYYGSSVRGRFSISRDNSKNTLYLQMNSLRTEDTALYFCAKDLREYECEEWTSDYYDFGRPQPCIDSRGVVGILDIWGQGTMVTVSS

SEQ ID NO: 1866 - protein, 144 aa, Artificial Sequence
  anti-HIV_cap256-119-094581_VR-Chain
QVHLVESGGGVVQPGRSLRLSCAASGFNFSNYAIHWVRQTPGKGLEWVTLISNDGSNKYYADSLKGRFTISRDNSKNTLYLQMNSLRAEDTALYYCAKDLREDECEEWWSDYYDFGKQLPCRKSRGVAGIFDGWGQGTMVTVSS

SEQ ID NO: 1867 - protein, 144 aa, Artificial Sequence
  anti-HIV_cap256-119-094200_VR-Chain
EVQLVESGGGLVQPGGSLRLSCAASGFIFSSYALHWVRQAPGKGLEWVASISFAGTKNHYGNSVKGRFTISRDNSKNTVYLQMNSLRAEDTALYYCAKDLREYECEEWTSDYYDFGRPQPCIDSRGVVGILDIWSQGTMVTVSS

SEQ ID NO: 1868 - protein, 144 aa, Artificial Sequence
  anti-HIV_cap256-119-094158_VR-Chain
QMQLVESGGGVVQPGSSLTLSCAASQFTFSNYGMHWVRQAPGKGLEWVASISNDGTKKYHGDSVWDRFTISRDNSKNTLFLQMNSLRAEDTALYFCVKDQREDECEEWWSDYYDFGKQLPCRKSRGVAGIFDSWGQGTMVTVSS

SEQ ID NO: 1869 - protein, 144 aa, Artificial Sequence
  anti-HIV_cap256-119-092814_VR-Chain
QVQLVEFGGGVVQPGGSLRLSCAASGFYFTDYGMHWVRQAPGEGLQWVAFISYDGNTKTTADSVRGRFTLSRDNSKNTLYLQMNSVRVEDTARYFCARDMREYECELWASDYYDFGKPQPCEDPRGVVGTFDMWGLGTLVTVSS

SEQ ID NO: 1870 - protein, 144 aa, Artificial Sequence
  anti-HIV_cap256-119-092808_VR-Chain
QVQLVESGGGVVQPGRSLRLSCAASQFSFGNYGMHWVRQAPGKGLEWVAAISFAGTKTNYADSVKGRFTISRDNSKNTVYLQMNSLRAEDTALYFCAKDIREYECEYWTSDYYDFGRPQPCIDSRGVVGTFDVWGQGTMVTVSS

SEQ ID NO: 1871 - protein, 144 aa, Artificial Sequence
  anti-HIV_cap256-119-092573_VR-Chain
QEQLVESGGGVVQPGTSLRLSCSASGFTFSNFAMNWVRQAPGKGLEWVSFISSDGKNKNYVDSVKGRFTISRDNYKNTLYLQMNSLRTEDTAVYYCAKDLGGTKDDEWATDYYDWSTAYPVQDPRAVAGGFDLWGLGTMVTVSS

SEQ ID NO: 1872 - protein, 144 aa, Artificial Sequence
  anti-HIV_cap256-119-090815_VR-Chain
QVQLVESGGGVVEPGRSLRLSCAASQFSFSSYGMHWVRQAPGKGLEWVAAISFDGADKYHADNVWGRLSISRDNSKSTLYLQMNSLRPEDTAVYFCAKDLREDECEERWSDYYDFGKQLPCRKSRGVAGIFDNWGQGTMVTVSA

SEQ ID NO: 1873 - protein, 146 aa, Artificial Sequence
  anti-HIV_cap256-119-090368_VR-Chain
QVQLVESGGGVVQPGRSLRLSCAASGFAFSHYGIFWVRQAPGKGLEWVASISNDGTKKYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1874 - protein, 144 aa, Artificial Sequence
  anti-HIV_cap256-119-089710_VR-Chain
QVQLVESGGGVVQPGRSLRLSCTASGFGFSNYAMHWVRLAPGKGLEWVASISYDGRDYHHAGAVWGRFIISRDNSKNSLHLQMNSLRPEDTALYFCARDLRESECEEWESDYYNFWKKLPCVKPRGVVGILDIWGQGTVVTVSS

SEQ ID NO: 1875 - protein, 144 aa, Artificial Sequence
  anti-HIV_cap256-119-088555_VR-Chain
QVQLVESGGGVVQAGRSLRLSCAASQFTFSRYGMHWVRQAPGKGLEWVAGISYDGRDKYHAHFVWGRFIISRDNSKNTLYLQMNSLRAEDTALYYCVRDLRESECELWESDYYDFGKRLPCVKPRGVAGTFDLWGQGTMVTVSS

SEQ ID NO: 1876 - protein, 144 aa, Artificial Sequence
  anti-HIV_cap256-119-087962_VR-Chain
EMQLVESGGGLVKPGRSLRLSCAASGFTFSSYAIHWVRQAPGKGLEWVAVISYDGSNKYYADSVKGRFTISRDNSKNTVYLQMNSLRVEDTALYYCAKDLREYECEEWTSDYYDFGKPQPCIDSRGVVGILDIWGQGIMVTVSS

SEQ ID NO: 1877 - protein, 144 aa, Artificial Sequence
  anti-HIV_cap256-119-086903_VR-Chain
QVHLVESGGGVVQPGKSLRLSCAASQFTFDRYGMHWVRQAPGKGLEWVASISNDGTDKYHADNVWGRFTISRDNSKNTLYLEMNSLRGEDTALYYCAKDMREDECEEWWSDYYDFGRPQPCIDSRGVVGTFHVWGQGTMVTVSS

SEQ ID NO: 1878 - protein, 144 aa, Artificial Sequence
  anti-HIV_cap256-119-086804_VR-Chain
EVQLVESGGGVVQPGRSLRLFCAGSGFTFSSYGLHWVRQAPGKGLEWVSFISYDGSTTKYADSLKGRFTVSRDNSKNTVYLEMNSLRAEDTALYYCAKDLREYECEEWTSDYYDFGRPQPCIDSRGVVGILDIWGQGTMVTVSS

SEQ ID NO: 1879 - protein, 144 aa, Artificial Sequence
  anti-HIV_cap256-119-085910_VR-Chain
EVQLLESGGGLVQPGGSLRLSCAASGFTFSSYGMHWVRQAAGKGLEWVASISYDGRDYHHAGAVWGRFIISRDNSKNSLHLQMNSLRPEDTALYFCARDLRESECEEWESDYYNFWKKLPCVKPRGVVGILDIWGQGTVVTVSS

SEQ ID NO: 1880 - protein, 144 aa, Artificial Sequence
  anti-HIV_cap256-119-085772_VR-Chain
EVRLVESGGGLIQPGGSLRLSCAASGLTVSSNHMSWVRQAPGKGLEWVAVISYDGSNTFYGDSVKGRFTVSRDISKNTLYLQMNSLRPEDTAMYYCARDQRYYECEEWASDYYDFGREQPCQDPRGVVGVFDMWGQGTMVTVSS

SEQ ID NO: 1881 - protein, 144 aa, Artificial Sequence
  anti-HIV_cap256-119-084603_VR-Chain
QVQLVESGGGVVQSGRSLRLSCAASGFPFSDFAMHWVRQAPGKGLEWVASISFVGIKTHYANSVRGRFTISRDQSKNTLYLQMNSVRVEDTGRYYCARDMREYECELWASDYYDFGKPQPCEDPRGVVGTFDMWGLGTLVTVSS

SEQ ID NO: 1882 - protein, 144 aa, Artificial Sequence
  anti-HIV_cap256-119-084276_VR-Chain
QVQLVESGGGVVQPGRSLRLSCAASRFTFSSYAMHWVRQAPGKGLEWVAVIWYDGSNKYYADSVRGRFSVSTDISKNTLYLQMNSLRPADTALYFCARDLRYYECEEWASDYYDFGKEQPCLDPRGVVGIFDLWGQGTMVTVSS

SEQ ID NO: 1883 - protein, 144 aa, Artificial Sequence
  anti-HIV_cap256-119-082288_VR-Chain
QVYLVESGGGVVQPGRSLRLSSAASHFSLSSYGMHWVRQAPGKGLEWVAGISFAGTKTYYGDSVKGRFTVSTDISKNTLYLQVNSLRPEDTAMYYCARDQRYYECEEWASDYYDFGKEQPCLDPRGVVGIFDIWGQGTMVTVSS

SEQ ID NO: 1884 - protein, 144 aa, Artificial Sequence
  anti-HIV_cap256-119-080383_VR-Chain
QVQLVESGGGVVQPGRSLRISCAASQFTFSRYGMHWVRQAPGKGLEWVASISYDGTDKYHARLVWGRFTISRDNSKNTLYLQMNSLRAEDTALYYCVRDERESECELWESDYYDFGKKLPCVKPRGVTGSLDMWGQGTQVTVSS

SEQ ID NO: 1885 - protein, 146 aa, Artificial Sequence
  anti-HIV_cap256-119-079333_VR-Chain
EVQLVESGGRLVQPGSPLRLSCAASQFNFASYGMHWVRQAPGKGLEWVASISNDGTKKYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1886 - protein, 147 aa, Artificial Sequence
  anti-HIV_cap256-119-078618_VR-Chain
QMQLVESGGGVVQPGRSLTLSCAASQFNFASYGMHWVRQAPGKGLEWVASISNDGTKKYHAESVWDRFSISKDNSKNTLFLQMNSLRVEDTTLYFCVKDQREDECEEWWSDYYDFGRELPCRKSRGLGLAGNFCICGADGTMVTVSS

SEQ ID NO: 1887 - protein, 144 aa, Artificial Sequence
  anti-HIV_cap256-119-077466_VR-Chain
QVQLVESGGGVVQPGSPLRISCAVSQFTFSRYGMHWVRQAPGKGLEWVASISFDGRDKYHSSLVWGRLTISRDNSKSTLFLQMNSLRAEDTALYYCARDLRESECEEWESDYYAFYRKLPCVKPRGVAGTLDIWGQGTMVTVSS

SEQ ID NO: 1888 - protein, 141 aa, Artificial Sequence
  anti-HIV_cap256-119-076284_VR-Chain
QVQLVESGGGVVQPGRSLRLSCAASNTYAMHWVRQAPGKGLEWMALISYEGSDKYYVDSVKGRFTISRDNSKSTLYLQMNSLSAEDTAVYFCAKDLGGNKDDEWTTDYYYDWSKARPVQDPRVVAGTFDIWGQGTMVTVSS

SEQ ID NO: 1889 - protein, 144 aa, Artificial Sequence
  anti-HIV_cap256-119-074680_VR-Chain
EVQLVESGGGLVQPGRSLRLSCAGSGFTFVDYAMHWVRQVPGKGLEWVGSISYDGSDKYHTNSVWGRFIVSRDNSKNTLYLQMNSLRPEDTALYYCVRDRRESECEERWSDYYDFGKQLPCVKPRGVAGIFDIWGQGTMVTVSS

SEQ ID NO: 1890 - protein, 144 aa, Artificial Sequence
  anti-HIV_cap256-119-074081_VR-Chain
EVQLVESGGGLVQPGGSLRLSCVVSGVTVSSNYMSWVRQAPGKGLEWVASISYDGSDKYHADRVWGRFTISRDNSKNTLYLQMNSLRAEDTALYYCVRDARESECELWESDYYNFGRKLPCVKPRGVAGTLDIWGQGTMVTVSS

SEQ ID NO: 1891 - protein, 144 aa, Artificial Sequence
  anti-HIV_cap256-119-071704_VR-Chain
QMQLVESGGGVVQPGGSLRLSCAVSQFTFTSYGMHWVRQAPGKGLEWVATISSDGSKKYHGDSVWGRLTISRDNSKNTLFLQMNNLRAEDTALYFCVKDQREDECEEWWSDYYDFGKKLPCRKSPGLAGIFDVWGHGTMVTVSP

SEQ ID NO: 1892 - protein, 144 aa, Artificial Sequence
  anti-HIV_cap256-119-071266_VR-Chain
QVQLVESGGGVVQPGESLRLSCAASGFTFSSFGMHWVRQAPGKGLEWVGSISYDGSDKYHTNSVWGRFIVSRDNSKNTLYLQMNSLRPEDTALYYCVRDRRESECEERWSDYYDFGKQLPCVKPRGVAGIFDIWGQGTMVTVSS

SEQ ID NO: 1893 - protein, 144 aa, Artificial Sequence
  anti-HIV_cap256-119-069667_VR-Chain
EVQLVESGGGLVQPGRSLRLSCAASGFSFNTYGMHWVRQAPGKGLEWVAFIRYDGSNKYYADSVKGRFTISRDNSKNTLYLQMDGLRGEDTALYYCAKDLRELECEEWASDYYDFGRPQPCLDPRGVSGISNVWGQGTMVTVSS

SEQ ID NO: 1894 - protein, 144 aa, Artificial Sequence
  anti-HIV_cap256-119-069591_VR-Chain
QVQLVESGGGVVQPGRSLRLSCAASGFTFSSYAMHWVRQAPGKGLEWVAGISYDGSDKYHADKVWGRFTISRDNSKNTLYLQMNSLRAEDTALYYCAKDLREDECEEWWSDYYDFGKRLPCRKSRGVAGVFDKWGQGTMVTVSS

SEQ ID NO: 1895 - protein, 144 aa, Artificial Sequence
  anti-HIV_cap256-119-068691_VR-Chain
QGHLVASGGGVVPPGRSLTLSCLASQFTFSGYGFHWVRQAPGKGLEWVASISFAGTKKHYGNSVKGRFTISRDNSKNTLYLEMNSLRPEDTALYYCAKDRREYECEEWTSDYYDFGRPQPCIDSRGVVGILDIWGRGTMVTVSS

SEQ ID NO: 1896 - protein, 144 aa, Artificial Sequence
  anti-HIV_cap256-119-068488_VR-Chain
QMQLVESGGGVVQPGMSLTLSCAASQFTFSNYGMHWVRQAPGKGLEWVASISNDGSKKYHGDSVKGRFTISRDNSKNTLYLQMDGLRGEDTALYYCAKDLRELECEEWASDYYDFGRPQPCLDPRGVSGISNVWGQGTMVTVSS

SEQ ID NO: 1897 - protein, 144 aa, Artificial Sequence
  anti-HIV_cap256-119-067536_VR-Chain
QVQLVESGGGVVQPGRSLRISCASSQFTFSRYGMHWVRQAPGKGLEWVASISYDGRDYHHAGAVWGRFIISRDNSKNSLHLQMNSLRPEDTALYFCARDLRESECEEWESDYYAFYRKLPCVKPRGVAGTLDIWGQGTMVTVSS

SEQ ID NO: 1898 - protein, 144 aa, Artificial Sequence
  anti-HIV_cap256-119-065852_VR-Chain
QVHLVESGGGAVPSGRSLRLSCVASGFTFGVYDIHWVRQAPGKGLEWVASISYDGRDKYHSSLVWGRLTISRDNSKSTLFLQMNSLRAEDTALYYCARDLRESECEEWQSDYYAFYKKLPCVKPRGVAGTLDIWGQGTMVTVSS

SEQ ID NO: 1899 - protein, 144 aa, Artificial Sequence
  anti-HIV_cap256-119-065457_VR-Chain
LGRLVASGGGVVPPGRSPRLSCVASQFTFSGCGLHWVRQAPGKGLEWVAAISFDGTDKYHSDDVWGRFTISRDNSKNTLYLQMNSLRPEDTALYYCAKDLQEDECEEWWSDYYDFGKQLPCRKSRGVAGIFDDWGQGTMVTVSS

SEQ ID NO: 1900 - protein, 144 aa, Artificial Sequence
  anti-HIV_cap256-119-064501_VR-Chain
QVQLVESGGGVVQPGRSLRLSCAASGFTFSSYAMHWVRQAPGKGLEWVAGISYDGRDKYHAHSVWGRLSISRDNSKNTLYLQMNSLRTEDTALYHCVRDLRESECELWESDYYDFGKKLPCVKPRGVAGTFDLWGQGTMVTVSS

SEQ ID NO: 1901 - protein, 144 aa, Artificial Sequence
  anti-HIV_cap256-119-063568_VR-Chain
QVQPVESGGGVVWPGRSLRLSCTTSGFTFSNYAIHWVRQAPGKGLQWVAVISYDGSNKFYADSVKGRFTISRDNSKNTLYLQMNSLRPEDTALYYCAKDLREDECEERWSDYYDFGKQLPCRKSRGVAGVFDNWGQGTMVTVSS

SEQ ID NO: 1902 - protein, 145 aa, Artificial Sequence
  anti-HIV_cap256-119-063103_VR-Chain
QVQLVESGGGLVQPGKSLRLSCAASGFTFSTYGMHWVRQAPGKGLEWVALISYDGSYTYYADSVKGRFTISRDNSKSTLDLQLNTLRPEDTALYYCARDLREMECEEWKLYNYYDFRTRGPCVDPRGVVGSFDVWGQGTVVTVSS

SEQ ID NO: 1903 - protein, 144 aa, Artificial Sequence
  anti-HIV_cap256-119-061027_VR-Chain
QVQLVESGGGVVQPGRSLRLSCSASGFTLSSYGIHWVRQAPGKGLEWVAVMSNDGSNQFYGDSVKGRFTISRDISKNTLYLQMNSLRPEDTAMYYCARDQRYYECEEWASDYYDFGREQPCQDPRGVVGVFDMWGQGTMVTVSS

SEQ ID NO: 1904 - protein, 144 aa, Artificial Sequence
  anti-HIV_cap256-119-058232_VR-Chain
QVQLVESGGGVVQPGKSLRLSCKASQFTFNRYGMHWVRQAPGKGLEWVAAISFDGTDKYHADKVWGRFTISRDDSKSTLYLQMNSLRAEDTALYYCAKDLREDECEEWWSDYYDFGKQLPCRKSRGVAGIFDGWGQGTMVTVSS

SEQ ID NO: 1905 - protein, 144 aa, Artificial Sequence
  anti-HIV_cap256-119-057341_VR-Chain
QVQLVESGGGVVQPGRSLRLSCAASHFSLSSYGMHWVRQAPGKGLEWVAGESFAATNKYYADSVKGRFIVSRDISKNTLYLEVNSLRAEDTALYYCARDQRYYECEEWASDYYDFGREQPCQDPRGVAGIFDIWGQGTMVTVSS

SEQ ID NO: 1906 - protein, 146 aa, Artificial Sequence
  anti-HIV_cap256-119-056895_VR-Chain
QMQLVESGGGVVQPGRSLRLSCAASQFTFGSYGMHWVRQIPGKGLEWVATISYDGTKKYHADSVWDRFIISRDNSKNTLFLQMNSLRPEDTALYFCVKDQRQDECEEWWSDYYDFGRELPCRKSRGLGLAGIFDMWGHGTMVTVSS

SEQ ID NO: 1907 - protein, 144 aa, Artificial Sequence
  anti-HIV_cap256-119-056402_VR-Chain
QVKLVESGGGVVQPGKSLRLSCTASQFTFSNFGMHWVRQAPGKGLEWVASISFVGIKKHYANSVRGRFTISRDQSKNTLYLQMNSVRVEDTARYFCARDMREYECELWASDYYDFGKPQPCEDPRGVVGTFDMWGLGTLVTVSS

SEQ ID NO: 1908 - protein, 144 aa, Artificial Sequence
  anti-HIV_cap256-119-056034_VR-Chain
QVQLVESGGGVVQPGRSLRLSCAASGFTFSSYAMHWVRQAPGKGLEWVAAISFAGTKTHYADSVKGRFTISRDNSKNALYLQMNNLRAEDTALYYCAKDLREDECEERWSDYYDFGKQLPCRKSRGVAGVFDNWGQGTMVTVSS

SEQ ID NO: 1909 - protein, 144 aa, Artificial Sequence
  anti-HIV_cap256-119-055042_VR-Chain
QVQLVESGGGVAQPGRSLRLSCAASGFTFRSYGMHWVRQAPGKGLEWVAVISLDGSNKYYADSVKGRFSISRDNSKNTLYLQMNSLRPEDTAVYYCAKDLREDECEERWSDYYDFGKQLPCRKSRGVAGVFDNWGQGTMVTVSS

SEQ ID NO: 1910 - protein, 146 aa, Artificial Sequence
  anti-HIV_cap256-119-054776_VR-Chain
QVQLMESGGGVVQPGRSLRLSCTASGFTFSSYSMHWVRQAPGKGLEWVAIISYDESNKYYADSVQGRFTISRDNSKNTLFLQMSSLRAEDTALYFCVRDHREDECEEWWSDYYDFGRELPCRKFRGLGLAGIFDIWGHGTMVTVSS

SEQ ID NO: 1911 - protein, 144 aa, Artificial Sequence
  anti-HIV_cap256-119-054539_VR-Chain
QMQLVESGGGVVQPGGSLRLSCAASQFTFGSYAMHWVRQPPGERPEWVATISFDGTKKYHADSVWGRFTISRDNSKNTLFLQMNSLRPEDTALYFCVKDQREDACEEWWSDYYDFGKNCLAESPGAWLEFFYVWGHGTMVTVSS

SEQ ID NO: 1912 - protein, 144 aa, Artificial Sequence
  anti-HIV_cap256-119-054112_VR-Chain
QVQLVESGGGVVQAGRSLRLSCAASGFTFSTYAMHWVRQAPGKGLEWVAVISYDGSNKYYADSVRGRFTISRDNSKNTLYLQMNSLRAEDTALYYCAKDMREYECEEWTSDYYDFGRPQPCIDSRGVVGTFHVWGQGTMVTVSS

SEQ ID NO: 1913 - protein, 144 aa, Artificial Sequence
  anti-HIV_cap256-119-053339_VR-Chain
QVHLVESGGGVVQPGRSLRLSCAASHFSLSSYGMHWVRQAPGKGLEWVTGISFAGTKTYYGDSVRGRFTVSRDISKNTLLLQMNSLRPDDTAIYYCARDQRYYECEEWASDYYDFGKEQPCLDPRGVVGIFDLWGQGTMVTVSS

SEQ ID NO: 1914 - protein, 144 aa, Artificial Sequence
  anti-HIV_cap256-119-052404_VR-Chain
QMQLVESGGGVVQPGRSLTLSCIASQFNFASYGMHWVRQAPGKGLEWVASISHDGTKKYHAESVWGRFTISKDNSKNTLFLQMNSLRVEDTALYFCVKDQREDECEEWWSDYYDFGKQLPCRKSRGVAGVFDNWGQGTMVTVSS

SEQ ID NO: 1915 - protein, 144 aa, Artificial Sequence
  anti-HIV_cap256-119-051123_VR-Chain
QVQLVESGGGVVQPGGSLRLSCVGSQFILYRYGMHWVRQAPGKGLEWVAAVSFDGTDKYHADDVWGRFTISRDNSKNILYLQMNSLRAEDTALYYCAKDLREDECEEWWSDYYDLGKQLPCRKSRGVAGVFDKWGLGTMVTVSS

SEQ ID NO: 1916 - protein, 146 aa, Artificial Sequence
  anti-HIV_cap256-119-051077_VR-Chain
EVQLVESGGGVVQSGRSLRLSCAASHFTFSRYGMHWVRQAPGKGLEWVASISYDGRDFYHARSVWGRFTISRDNSKNTLFLQMNSLRIEDTALYFCVKDQREDECEEWWSDYYDFGRELPCRKSRGLGLAGIFDMWGHGTMVTVSS

SEQ ID NO: 1917 - protein, 144 aa, Artificial Sequence
  anti-HIV_cap256-119-050442_VR-Chain
QAQMVESGGGVVQPGRSLRLSCAASGFSFSYFAMHWVRQAPGKGLEWVAGISFAATKTYYGGSVKGRFTVSRDISKNTLYLQMNSLRPEDTAMYYCARDQRYYECEEWASDYYDFGREQPCQDPRGVVGVFDMWGQGTMVTVSS

SEQ ID NO: 1918 - protein, 144 aa, Artificial Sequence
  anti-HIV_cap256-119-049433_VR-Chain
QVQLVESGGGVVQPGRSLRVSCRASGFAFSSYAMHWVRQAPVKGLEWVALTSSDGADKYHADDVWGRFTISRDNSKNTLYLQMNSLRPEDTALYYCAKDLREDECEERWSDYYDFGKQLPCRKSRGVAGVFDNWGQGTMVTVSS

SEQ ID NO: 1919 - protein, 144 aa, Artificial Sequence
  anti-HIV_cap256-119-047532_VR-Chain
LGRLVASGGGVVPPGRSLTLSCVASQFTFSGCGLHWVRQAPGKGLEWVASISFAGTKKHYTNSVRGRFTISRDNSKNTVYLQMNSLRAEDTALYYCAKDMGEYECEEWTSDYYDFGRPQPCIDSRGVVGILDIWGQGTMVTVSS

SEQ ID NO: 1920 - protein, 144 aa, Artificial Sequence
  anti-HIV_cap256-119-047489_VR-Chain
QVHLVESGGGVVQPGKSLRLSCAASQFTFNRFGMHWVRQAPGKGLEWVAGISYDGSDKYHADKVWGRFTISRDNSKNTLYLQMNSLRAEDTALYYCAKDLREDECEEWWSDYYDFGKRLPCRKSRGVAGVFDKWGQGTMVTVSS

SEQ ID NO: 1921 - protein, 146 aa, Artificial Sequence
  anti-HIV_cap256-119-046020_VR-Chain
EVQLLQSGGGLVQPGGSLRLSCAASGFSFSSYAMSWIRQAPGKGLEWVASISHDGTKKYHAESVWGRFTISKDNSKNTLFLQMNSLRVEDTALYFCVKDQREDECEEWWSDYYDFGRELPCRKSRGLGLAGIFDMWGHGTMVTVSS

SEQ ID NO: 1922 - protein, 144 aa, Artificial Sequence
  anti-HIV_cap256-119-044746_VR-Chain
QVQLVESGGGVVQPGRSLRLSCAASGFTFSSYAMHWVRQAPGKGLEWVAVISYDGSNKYYADSVKGRFTISRDNSKNTVYLEMNSLRAEDTALYYCAKDLREYECEEWTSDYYDFGRPQPCIDSRGVVGILDIWGQGTMVTVSS

SEQ ID NO: 1923 - protein, 144 aa, Artificial Sequence
  anti-HIV_cap256-119-044740_VR-Chain
QMHLVESGGGVVQPGMSLRLSCAASQFNFGSFGMHWVRQAPGKGLEWVATISYDGTKKYHSDSVWGRLSISRDNSKNTLFLQMNSLRTEDTALYFCVRDQREDDCEEWWSDYYDFGKKLPCRKSRGLAGIFDIWGHGTMVTVSS

SEQ ID NO: 1924 - protein, 144 aa, Artificial Sequence
  anti-HIV_cap256-119-043790_VR-Chain
LLQLVESGGGVVQPGNSLRLSCAAAGFTFSDYSLHWVRQAPGKGLEWVAMISDDGNLDFYAASVKGRFTISRDNSINTVYLQMNSLRAEDTALYYCAKDLREYECEEWTSDYYDFGRPQPCIDSRGVVGILDIWSQGTMVTVSS

SEQ ID NO: 1925 - protein, 144 aa, Artificial Sequence
  anti-HIV_cap256-119-042880_VR-Chain
EVRLVESGGGLVQPGGSLRLSCAASGFTLSDYYMSWIRQAPGKGLEWVAAISFAGTKKHYGNSVKGRFTISRDNSKNTLYLEMNSLRVEDTALYYCAKDLREYECEEWTSDYYDFGRPQPCIDSRGVVGILDIWGQGTMVTVSS

SEQ ID NO: 1926 - protein, 144 aa, Artificial Sequence
  anti-HIV_cap256-119-042606_VR-Chain
QMQLVESGGGVVQPGRSLRLSCAASQFTFGSYGMHWVRQIPGKGLEWVTGISFAATKTYYGDSVRGRFTVSRDISKNTLYLQMNSLRPEDTAMYYCARDQRYYECEEWASDYYDFGREQPCQDPRGVVGILDLWGQGTMVTVSS

SEQ ID NO: 1927 - protein, 144 aa, Artificial Sequence
  anti-HIV_cap256-119-042444_VR-Chain
QVQLVESGGDVVHPGGSLRLSCAASGFTFSSYGIHWVRQAPGKGLEWVAAISYDGSDKYHTNSVWGRFTVSRDNSKNTVYLQMNSLRAEDTALYFCVRDRRESECELWESDYYDFGKRLPCVKPRGVAGVFDIWGQGTMVTVSS

SEQ ID NO: 1928 - protein, 144 aa, Artificial Sequence
  anti-HIV_cap256-119-040328_VR-Chain
QVQLVESGGGVVQPGGSLRLSCAASGFTFSSYSMNWVRQAPGKGLEWVASISFAGTKQHYGNSVKGRFTISRDNSKNTVYLQMNSLRLEDTALYYCAKDLREYECEEWTSDYYDFGRPQPCIDSRGVVGILDIWGQGTMVTVSS

SEQ ID NO: 1929 - protein, 144 aa, Artificial Sequence
  anti-HIV_cap256-119-040164_VR-Chain
QMHLVESGGGVVQPGMSLRLSCAASQFNFGSFGMHWVRQAPGKGLEWVATISYDGTKKYHSDSVWGRFSISRDNSKNTLYLQMNSLRTEDTALYFCAKDLREYECEEWTSDYYDFGRPQPCIDSRGVVGILDIWGQGTMVTVSS

SEQ ID NO: 1930 - protein, 144 aa, Artificial Sequence
  anti-HIV_cap256-119-039130_VR-Chain
EEQLVESGGGLVQPGRSLRLSCTGSGFRFGDYAMNWVRQAPGKGLEWVTFISYDGSNKHYADSVKGRFTVSRDNSKNTLHLQMNSLRPEDTALYFCARDLRESECEEWESYYYDFGKKGPCVKPRGVVGVLDIWGQGTLVTVSS

SEQ ID NO: 1931 - protein, 144 aa, Artificial Sequence
  anti-HIV_cap256-119-038138_VR-Chain
QVQLVESGGGVVQTGRSLRLSCTGSQFTFGRYGMYWVRQAPGKGLEWVASISYDGRDFYHARSVWGRFTISRDNSKNTLHLQMNSLRPEDTALYFCARDLRESECEEWESYYYDFGKKGPCVKPRGVVGVLDIWGQGTLVTVSS

SEQ ID NO: 1932 - protein, 144 aa, Artificial Sequence
  anti-HIV_cap256-119-037868_VR-Chain
QVQLVESGGGVVQPGRSLRLSCAASQFTFSKYGMHWVRQAPGKGLQWVAGISYDGSDKYHAHFVWGRFSISRDNSKNALYLQMNSLRTEDTALYFCVRDLRESECEEWKSDYYDFGRKGPCLKPRGVAGSFDIWGQGTVVTVSS

SEQ ID NO: 1933 - protein, 144 aa, Artificial Sequence
  anti-HIV_cap256-119-037102_VR-Chain
QVKLVESGGGVVQPGKSLRLSCTASQFTFSNFGMHWVRQAPGKGLEWVASISFVGIKKHYANFVRGRFTISRDQSKNTLYLQMNSVRVEDTARYYCARDMREYECELWASDYYDFGKPQPCEDPRGVVGTFDMWGLGTLVTVSS

SEQ ID NO: 1934 - protein, 146 aa, Artificial Sequence
  anti-HIV_cap256-119-036683_VR-Chain
GVQLVESGGAVVRPGGSLTLSCAASQFILSSYGMHWVRQAPGKGLEWVASISNDGTKKYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1935 - protein, 144 aa, Artificial Sequence
  anti-HIV_cap256-119-036495_VR-Chain
QVQLVESGGGVVQPGRSLRLSCAASGFSFSSYGMHWVRQAPGKGLEWVASISFVGIKTHYANSVRGRFTISRDQSKNTLYLQMNSVRIEDTARYFCARDMREYECELWASDYYDFGKPQPCEDPRGVVGTFDMWGLGTLVTVSS

SEQ ID NO: 1936 - protein, 146 aa, Artificial Sequence
  anti-HIV_cap256-119-035375_VR-Chain
EVQLVESGGGLVQPGRSLRLSCAASGFTLEDYGMHWVRQAPGKGLEWVASISNDGTKKYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1937 - protein, 146 aa, Artificial Sequence
  anti-HIV_cap256-119-035165_VR-Chain
QVHLVESGGGVGQPARSLRLSCAASGFILSSYGLHWVRQAPGKGLEWVALISYDGNNEYYAESVWGRFTISKDNSKNTLFLQMNSLRVEDTALYFCVKDQREDECEEWWSDYYDFGRELPCRKSRGLGLAGIFDMWGHGTMVTVSS

SEQ ID NO: 1938 - protein, 144 aa, Artificial Sequence
  anti-HIV_cap256-119-035109_VR-Chain
QVQLVESGGGVVQPGRSLRLSCATAGFTFSSYAMHWVRQAPGKGLEWVASISYDGSDKYHADLVWGRFTISRDNSKNTLYLQMNSLRAEDTALYYCVRDARESECELWESDYYNFGRKLPCVKPRGVAGTLDIWGQGTMVTVSS

SEQ ID NO: 1939 - protein, 113 aa, Artificial Sequence
  anti-HIV_cap256-119-033789_VR-Chain
QVYLVESGGGVVQPGRSLRLSCAASHFSLSSYGMHWVRQAPDISKNTLYLQVNSLRPEDTAMYYCARDQRYYECEEWASDYYDFGKEQPCLDPRGVVGIFDIWGQGTMVTVSS

SEQ ID NO: 1940 - protein, 144 aa, Artificial Sequence
  anti-HIV_cap256-119-033641_VR-Chain
QVQLVESGGGVVQTGRSLRLSCTGSQFTFGRYGMYWVRQAPGKGLEWVAAISYDGSDKYHTNSVWGRFTVSRDNSKNTVYLQMNSLRAEDTALYFCVRDRRESECELWESDYYDFGKRLPCVKPRGVAGVFDIWGQGTMVTVSS

SEQ ID NO: 1941 - protein, 144 aa, Artificial Sequence
  anti-HIV_cap256-119-032113_VR-Chain
QVQLVESGGGVVQPGRPLRLSCVGSGFSFITSAMHWVRQAPDKGLEWVAIISDGGNNRHYADSVKGRFTISRDNSKNTVFLEVNNLRPEDTAMYYCARDQRYYECEEWASDYYDFGREQPCQDPRGVVGVFDMWGQGTMVTVSS

SEQ ID NO: 1942 - protein, 144 aa, Artificial Sequence
  anti-HIV_cap256-119-031739_VR-Chain
QVQLVESGGGVVQPGRSLRISCAASQFTFNRYGMHWVRQAPGKGLEWVASISYDGSDKYHAGLVWGRFIISRDNSKNTLYLQMNSLRAEDTALYYCVRDERESECELWESDYYDFGKKLPCVKPRGVAGTLDIWGQGTRVTVSS

SEQ ID NO: 1943 - protein, 144 aa, Artificial Sequence
  anti-HIV_cap256-119-030932_VR-Chain
EVQLLESGGGVVQPGRSLRLSCAASGFAFSHYGIFWVRQAPGKGLEWVTVISGDGSTQWYADSVQGRFTISRDSSKNTLYLQMDGLRGEDTALYYCAKDLRELECEEWASDYYDFGRPQPCLDPRGVSGISNVWGQGTMVTVSS

SEQ ID NO: 1944 - protein, 146 aa, Artificial Sequence
  anti-HIV_cap256-119-030740_VR-Chain
QVQLVEFGGGVVQTGRSLRLSCAASGFTFSDYGMHWVRQAPGKGLEWVASISNDGSKKYHGDSVWARFIISRDNSKNTLFLQMSSLRAEDTALYFCVRDHREDECEEWWSDYYDFGRELPCRKFRGLGLAGIFDIWGHGTMVTVSS

SEQ ID NO: 1945 - protein, 146 aa, Artificial Sequence
  anti-HIV_cap256-119-030197_VR-Chain
QVHLVESGGGVVQPGKSLRLSCAASQFTFCRYGMHWVRQAPGKGLEWVASISNDGTDKYHADNVWGRFTISRDNSKNTLYLEMNSLRGEDTALYYCAKDMREDECEEWWSDYYDFGKELPCRKWKTRGVAGILDNWGQGTMVTVSS

SEQ ID NO: 1946 - protein, 146 aa, Artificial Sequence
  anti-HIV_cap256-119-027047_VR-Chain
QMQLVESGGGVVQPGRSLTLSCAASQFTFRNYGMHWVRQAPGKGLEWVASISKDGTKKYHGDSVWGRFIISRDNSKNTLFLQMSSLRAEDTALYFCVRDQREAECEEWWSDYYDFGRELPCRKFRGLGLAGIFDIWGHGTMVTVSS

SEQ ID NO: 1947 - protein, 144 aa, Artificial Sequence
  anti-HIV_cap256-119-026950_VR-Chain
QVQLVESGGGVVQPGKSLRISCAASRFTFGRFGMHWVRQAPGKGLEWVASISYDGSDKYHAGLVWGRFIISRDNSKNTLYLQMNSLRAEDTALYYCVRDERESECELWESDYYNFGKNYPCVKPRGVAGTLDIWGQGTTVIVSS

SEQ ID NO: 1948 - protein, 146 aa, Artificial Sequence
  anti-HIV_cap256-119-026279_VR-Chain
QMQLVESGGGVVQPGTSLTLSCAASQFSFTSYGMHWVRQAPGKGLEWVASISNDGTKKYHAESVWGRFTISKDNSKNTLFLQMNSLRVEDTALYFCVKDQREDECEEWWSDYYDFGRELPCRKSRGLGLAGIFDIWGHGTVVIVSS

SEQ ID NO: 1949 - protein, 144 aa, Artificial Sequence
  anti-HIV_cap256-119-025355_VR-Chain
EVQLVESGGGLVQPGRSLRLSCAASGFSFSDYAMHWVRQAPGQGLEWVAFISYDGTKKYHSDSVWGRLTISRDNSRNTLFLQMNSLRTEDTALYFCVRDQREDDCEEWWSDYYDFGKKLPCRKSRGLAGIFDIWGHGTMVTVSS

SEQ ID NO: 1950 - protein, 144 aa, Artificial Sequence
  anti-HIV_cap256-119-025301_VR-Chain
QVHLVASGGGVVPPGRSLRLSCVASQFTFSGFGLYWVRQAPGKGLEWVAAISFAGTKKHYANSVKGRFTISRDNSKNTLYLQMNSLRPDDTALYYCAKDLREYECEEWTSDYYDFGRPQPCIDSRGVVGILDIWSQGTMVTVSS

SEQ ID NO: 1951 - protein, 146 aa, Artificial Sequence
  anti-HIV_cap256-119-025010_VR-Chain
QVQLVESGGGVVQPGRSLRLSCPASGFSFSTYGMHWVRQAPGKGLEWVASISNDGNKKYHGESVWDRFTISRDNSKNTLFLQMNRLRVEDTALYFCVKDQREDECEEWWSDYYDFGRELPCRKFRGLGLAGIFDVWGHGTMVTVSS

SEQ ID NO: 1952 - protein, 144 aa, Artificial Sequence
  anti-HIV_cap256-119-024631_VR-Chain
QVQLMESGGGVVQPGGSLRLSCAASGFTFSSYGMHWVRQAPGKGLEWVAGISYDGSDKYHAHFVWGRFIISRDNSKNALYLQMNSLRPEDTALYFCVRDLRESECEEWQSYYYDFGRKGPCLKPRGVAGSFDIWGQGTVVTVSS

SEQ ID NO: 1953 - protein, 144 aa, Artificial Sequence
  anti-HIV_cap256-119-024467_VR-Chain
EVQLVESGGGLVQPGGSLNVSCAASGFTFRTYAMHWVRQAPGKGLEWVAAISYDGDNKYSADSVKGRFTISRDQSKNTLYLQMNSVRVEDTARYYCARDMREYECELWASDYYDFGKPQPCEDPRGVVGTFDMWGLGTLVTVSS

SEQ ID NO: 1954 - protein, 144 aa, Artificial Sequence
  anti-HIV_cap256-119-023805_VR-Chain
QVQLVESGGGVVQPGKSLRLSCAASQFGFGSYGMHWVRQAPGKGLEWVATISFDGADKYHADDVWGRFSISRDNSKNTLYLQMNNLRPEDTALYYCAKDLREDECEERWSDYYDFGKQLPCRKSRGVAGVFDNWGQGTMVTVSS

SEQ ID NO: 1955 - protein, 144 aa, Artificial Sequence
  anti-HIV_cap256-119-021736_VR-Chain
QVQLVESGGGVVQPGRSVRLSCVASQFSFDRYGMHWVRQAPGKGLEWVASISYDGTDKYHADKVWGRFTISRDNSKKTLYLQMNSLRPEDAALYYCAKDLREDECEEWWSDYYDFGKQLPCRKSRGVAGIFDSWGQGTMVTVSS

SEQ ID NO: 1956 - protein, 146 aa, Artificial Sequence
  anti-HIV_cap256-119-021203_VR-Chain
QMQLVESGGGVVQPGRSLTLSCAASQFTFSNYGMHWVRQAPGKGLEWVASVSNDGTKKYHGDSVWDRFTISRDNSKNTLFLQMSSLRAEDTAVYFCVRDEREDECEEWWSDYYDFGRELPCRKFRGLGLAGIFDIWGHGTLVTVSS

SEQ ID NO: 1957 - protein, 144 aa, Artificial Sequence
  anti-HIV_cap256-119-020569_VR-Chain
QVQLVESGGGVVQPGESLRISCAASQFTFSRYGMHWVRQAPGKGLEWVASISFDGRDKYHSSLVWGRLTISRDNSKSTLFLQMNSLRPEDTALYYCARDVRESECEEWQSDYYAFYRKLPCVKPRGVAGTLDIWGQGTMVTVSS

SEQ ID NO: 1958 - protein, 144 aa, Artificial Sequence
  anti-HIV_cap256-119-019432_VR-Chain
QVQLVQSGGGVVQPGRSLRISCAAPYFTFGRYGFHWVRQAPGKGLEWVASISFDGRDYYHSPHVWGRLTISRDNSKNTLYLQMNSLRAEDTALYYCARDLRESECEEWESDYYDFGKKGPCVKPRGVAGSLDMWGQGTMVTVSS

SEQ ID NO: 1959 - protein, 144 aa, Artificial Sequence
  anti-HIV_cap256-119-018827_VR-Chain
QAQLVESGGGVVQPGRSLRLSCAASHFSFNRYGMHWVRQAPGKGLEWVAGISYDGRDFYHADIVWGRLTISRDNSKNTVYLQMNSLRADDTGLYYCARDVRESECEEWESYYYDFGRKGPCLKPRGVAGTFDMWGQGTIVSVSA

SEQ ID NO: 1960 - protein, 144 aa, Artificial Sequence
  anti-HIV_cap256-119-018483_VR-Chain
LVQLVESGGGVVQPGKSLRLSCVASQFTFNRYGMHWVRQAPGKGLEWVAGISYDGRDKYHAHFVWGRITISRDNSKNTLYLQMNSLRAEDTALYHCVRDLRESECELWESDYYDFGKKLPCVKPRGVAGIFDLWGQGTMVTVSS

SEQ ID NO: 1961 - protein, 144 aa, Artificial Sequence
  anti-HIV_cap256-119-018118_VR-Chain
QVHLVASGGGVVPPGRSLTLSCVASQFTFSGCGLHWVRQAPGKGLEWVASISFAGTKKHYGNSVKGRFTISRDNSKNTLYLQMNSLRPEDTALYYCAKDLREYECEEWTSDYYDFGRDQPCIDSRGVVGILDIWGQGTMVTVSS

SEQ ID NO: 1962 - protein, 144 aa, Artificial Sequence
  anti-HIV_cap256-119-017782_VR-Chain
QVQLVESGGGVVQPGKSLRLSCAASGFPFSNYAMHWVRQTPGRGLEWVAGISFAATKKYYRPSVRGRFTVSTDISKNTLYLEMNSLRPEDTALYFCARDQRYYECEEWASDYYDFGREQPCLDPRGVVGIFDLWGQGTMVTVSS

SEQ ID NO: 1963 - protein, 144 aa, Artificial Sequence
  anti-HIV_cap256-119-017669_VR-Chain
QVQLVESGGGVVQPGSSLRLSCAASHFAFNRYGMHWVRQAPGKGLEWVAGISFDGADKFHADKVWGRFTISRDNSKNTLSLQMNSLRPEDTALYYCAKDLREDECEEWWSDYYDFGRRLPCRKSRGVSGIFDNWGQGTMVTVSS

SEQ ID NO: 1964 - protein, 144 aa, Artificial Sequence
  anti-HIV_cap256-119-016976_VR-Chain
QVQLVESGGGVVQPGRSLRLSCAASQFSFGDFGMHWVRQAPGKGLEWVAAISFAGTKKNYADSVRGRFTISRDSSKNTLYLQMNSLRPEDTALYYCVKDMRGYECEEWTSDYYDFGRPQPCIDSRGVVGTFDVWGQGTMVTVSS

SEQ ID NO: 1965 - protein, 144 aa, Artificial Sequence
  anti-HIV_cap256-119-015432_VR-Chain
EVQLLESGGGLVQPGGSLRLSCAASGFTFSGYSLNWVRQAPGKGLEWVASISYDGSDKYHADRVWGRFTISRDNSKNTLYLQMNSLRAEDTALYYCVRDARESECELWESDYYNFGRKLPCVKPRGVAGTLDIWGQGTMVTVSS

SEQ ID NO: 1966 - protein, 144 aa, Artificial Sequence
  anti-HIV_cap256-119-015281_VR-Chain
LGRLVASGGGVVPPGRSLRLSCVASQFTFSGCGLHWVRQAPGKGLEWVASISFAGTKKHYGNSVKGRFTISRDNSKNTVYLEMNSLRAEDTALYYCAKDLREYECEEWTSDYYDFGRPQPCIDSRGVVGILDIWGQGTMVTVSS

SEQ ID NO: 1967 - protein, 144 aa, Artificial Sequence
  anti-HIV_cap256-119-014957_VR-Chain
QVQVVESGGGVVQPGTSLRLSCTVSGFSFSNYDLHWVRQTPAKGLEWVAVVSYDGSREYYTDSVKGRFIISRDQSKNTLYLQMNSVRLEDTARYYCARDMREYECELWASDYYDFGKPQPCEDPRGVVGTFDMWGLGTLVTVSS

SEQ ID NO: 1968 - protein, 144 aa, Artificial Sequence
  anti-HIV_cap256-119-014777_VR-Chain
QVHLVESGGGVVQPGRSLRLSCAASHFSLSSYGMHWVRQAPGKGLEWVAGISFAATKTYYGGSVKGRFTVSRDISKNTLYLQMNSLRPEDTAMYYCARDQRYYECEEWASDYYDFGREQPCQDPRGVVGVFDMWGQGTMVTVSS

SEQ ID NO: 1969 - protein, 144 aa, Artificial Sequence
  anti-HIV_cap256-119-014313_VR-Chain
QVQLVESGGGVVQPGRSLRISCAASQFTFSRYGMHWVRQAPGKGLEWVASISYDGRDYHHAGAVWGRFIISRDNSKNSLHLQMNSLRPEDTALYFCARDLRESECEEWESDYYNFWKKLPCVKPRGVVGILDIWGQGTVVTVSS

SEQ ID NO: 1970 - protein, 146 aa, Artificial Sequence
  anti-HIV_cap256-119-014219_VR-Chain
QMQLVESGGGVVQPGSSLTLSCAASQFTFSNYGMHWVRQAPGKGLEWVASISNDGTKKYHGDSVWDRFTISRDNSKNTLFLQMNSLRAEDTALYFCVKDQREDECEEWWSDYYDFGRELPCRKFRGLGLAGTFDIWGHGTMLIVSS

SEQ ID NO: 1971 - protein, 144 aa, Artificial Sequence
  anti-HIV_cap256-119-013631_VR-Chain
QVQLVESGGGVVQPGRSLRLSCAASQFTFGSYGMHWVRQIPGKGLEWVATISYDGTKKYHADSVWDRFIISRDNSKNTLFLQMNSLRPEDTALYFCVKDQRQDECEEWWSDYYDFGRRLPCRKSRGLAGIFDVWGHGTMVTVSS

SEQ ID NO: 1972 - protein, 144 aa, Artificial Sequence
  anti-HIV_cap256-119-012924_VR-Chain
QVTLVESGGGFVQPGGSLRLSCATSGFTFSSYAMHWVRQAPGKGLEWVAAISFDGADKYHADNVWGRLSISRDNSKSTLYLQMNSLRPEDTAVYFCAKDLREDECEERWSDYYDFGKQLPCRKSRGVAGIFDNWGQGTMVTVSA

SEQ ID NO: 1973 - protein, 144 aa, Artificial Sequence
  anti-HIV_cap256-119-011793_VR-Chain
QVQLVESGGGVVQPGGSLRLSCVASQFTFSRYGMHWVRQAPGKGLEWVASISYDGRDKYHADFVWGRLTISRDDSKKTLYLQMDSLRVDDTALYYCVRDMRESECELWESDYYDFGKRLPCVKPRGVAGIFDIWGQGTMVTVSS

SEQ ID NO: 1974 - protein, 144 aa, Artificial Sequence
  anti-HIV_cap256-119-011413_VR-Chain
QVQLVESGGDVVQPGRSLRLSCAASGFTFSTYGMHWVRQAPGKGLEWVAAISFAGTKKNYADSVRGRFTISRDSSKNTLYLEMNSLRPEDTALYYCAKDMRGYECEEWTSDYYDFGRPQPCIDSRGVVGTFDVWGQGTMVTVSS

SEQ ID NO: 1975 - protein, 144 aa, Artificial Sequence
  anti-HIV_cap256-119-011323_VR-Chain
QVKLVESGGGVVPPGKSLRLSCTASQFTFSNFGMHWVRQAPGKGLEWVASISFVGIKTHYANSVRGRFTISRDQSKNTLYLQMNSVRVEDTGRYYCARDMREYECELWASDYYDFGKPQPCEDPRGVVGTFDMWGLGTLVTVSS

SEQ ID NO: 1976 - protein, 144 aa, Artificial Sequence
  anti-HIV_cap256-119-011233_VR-Chain
QVHLVESGGGVVQPGRSVRLSCAASHFSLSSYGMHWVRQAPGKGLEWVTGISFAGTKTYYGDSVRGRFTVSRDISKNTLFLQMNSLRPDDTAMYYCARDQRYYECEEWASDYYDFGREQPCLDPRGVVGIFDLWGQGTMVTVSS

SEQ ID NO: 1977 - protein, 144 aa, Artificial Sequence
  anti-HIV_cap256-119-009038_VR-Chain
QEQLVESGGGVVQPGRSLRLSCVASRFTFSAFGMHWVRQAPGKGLEWVASISFAGIKKYYGDSVKGRFTISRDNSKNTLYLQMDGLRGEDTALYYCAKDLRELECEEWASDYYDFGRPQPCLDPRGVSGISNVWGQGTMVTVSS

SEQ ID NO: 1978 - protein, 144 aa, Artificial Sequence
  anti-HIV_cap256-119-008756_VR-Chain
QVQLVESGGGVVQPGKSLRLSCVVSQFTFGRYGMHWVRQAPGKGLEWVASISYDGSDKYHTSSLWGRFIVSRDNSKNTLYLQMNSLRPEDTALYYCVRDRRESECEERWSDYYDFGKQLPCVKPRGVAGIFDIWGQGTMVTVSS

SEQ ID NO: 1979 - protein, 146 aa, Artificial Sequence
  anti-HIV_cap256-119-008055_VR-Chain
QMQLVESGGGVVQPGRSLTLSCAASQFSFANYGMHWVRQAPGKGLEWVASISNDGTKKYHEESVWGRFTISKDNSKNTLFLQMNSLRIEDTALYFCVKDQREDECEEWWSDYYDFGRELPCRKSRGLGLAGIFDMWGHGTMVTVSS

SEQ ID NO: 1980 - protein, 145 aa, Artificial Sequence
  anti-HIV_cap256-119-006949_VR-Chain
QVHLVESGGGVVQPGRSLRLSCAASGFSVSNNYMNWVRQAPGEGLEWVALISFDGRQKDLADSVKGRFAISRDNSKNTLYLQMNSLRLEDTALYYCARDLRELDCEEWTLYNYYDFGSRGPCVDPRGVGGSFDVWGQGTMVTVSS

SEQ ID NO: 1981 - protein, 144 aa, Artificial Sequence
  anti-HIV_cap256-119-006685_VR-Chain
QVQLVESGGGVVQPGRSLRVSCAASHFTFSRYGMHWVRQAPGKGLEWVASISYDGRDFYHARSVWGRFTISRDNSKNTLHLQMNSLRPEDTALYFCARDLRESECEEWESYYYDFGKKGPCVKPRGVVGVLDIWGQGTLVTVSS

SEQ ID NO: 1982 - protein, 144 aa, Artificial Sequence
  anti-HIV_cap256-119-006015_VR-Chain
QVQLVESGGGVVQPGKSLRLSCAASRFTFNRYGMHWVRQAPGKGLEWVAAISFDGTDKYHSDDVWGRFTISRDNSKNTLYLQMNSLRPEDTALYYCAKDLQEDECEEWWSDYYDFGKQLPCRKSRGVAGIFDDWGQGTMVTVSS

SEQ ID NO: 1983 - protein, 144 aa, Artificial Sequence
  anti-HIV_cap256-119-005841_VR-Chain
QVQLVESGGGVVQPGRSLRLSCAASQFSFGNFGMHWVRQAPGKGLEWVAAISFAGTKENYANSVRGRFTISRDNSKNTLYLQMNSLRAEDTALYYCTKDMREYECEEWTSDYYDFGRPQPCIDSRGVVGTFDVWGQGTMVTVSS

SEQ ID NO: 1984 - protein, 144 aa, Artificial Sequence
  anti-HIV_cap256-119-005824_VR-Chain
QVQLVESGGGVVQPGGSLRLSCAASGFTFRRYAMHWVRQAPGKGLEWVASISYDGSDKYHTSSLWGRFIVSRDNSKNTLYLQMNSLRPEDTALYYCVRDRRESECEERWSDYYDFGKQLPCVKPRGVAGIFDIWGQGTMVTVSS

SEQ ID NO: 1985 - protein, 144 aa, Artificial Sequence
  anti-HIV_cap256-119-005494_VR-Chain
QVRLVESGGGVVQPGRSLRISCAASQFMFNKYGMHWVRQAPGKGLEWVASISYDGSDKYHADLVWGRFTISRDNSKNTLYLQMNSLRAEDTALYYCVRDARESECELWESDYYNFGRKLPCVKPRGVAGTLDIWGQGTMVTVSS

SEQ ID NO: 1986 - protein, 144 aa, Artificial Sequence
  anti-HIV_cap256-119-004949_VR-Chain
QVQLVESGGGVVQPGRSLRLSCAASKFSLSSYGMHWVRQAPGRGLEWVAGISFAATKKYYRPSVRGRFTVSTDISKNTLYLEMNSLRPEDTALYFCARDQRYYECEEWASDYYDFGREQPCLDPRGVVGIFDLWGQGTMVTVSS

SEQ ID NO: 1987 - protein, 144 aa, Artificial Sequence
  anti-HIV_cap256-119-004422_VR-Chain
HVQLVESGGGVVQPGRSLRLSCAASGLSFSSYAMHWVRQAPGKGLEWVAVVSYDGTTKFYADSVKGRFTISRDNSKNTLYLQMNSLRGEDTALYYCAKDLREYECEEWTSDYYDFGRPQPCIDSRGVVGILDIWSQGTMVTVSS

SEQ ID NO: 1988 - protein, 144 aa, Artificial Sequence
  anti-HIV_cap256-119-003932_VR-Chain
QVQLLESGGGVVQPGGSLRLSCKASHFSFDRYGMHWVRQAPGKGLEWVAAISFDGADKYHADNVWGRLSISRDNSKSTLYLQMNSLRPEDTAVYFCAKDLREDECEERWSDYYDFGKQLPCRKSRGVAGIFDNWGQGTMVTVSA

SEQ ID NO: 1989 - protein, 146 aa, Artificial Sequence
  anti-HIV_cap256-119-003577_VR-Chain
QVQLVESGGGGVQPGRSLRLSCAASGFTFRSYAMHWVRQAPGKGLEWVAVISNDGTKKYHAESVWDRFSISKDNSKNTLFLQMNSLRVEDTALYFCVKDQREDECEEWWSDYYDFGRELPCRKSRGLGLAGIFDMWGHGTMVTVSS

SEQ ID NO: 1990 - protein, 144 aa, Artificial Sequence
  anti-HIV_cap256-119-002155_VR-Chain
LGRLVASGGGVVPPGRSLRLSCVASQFTFSGCGLHWVRQVPGKGLEWVASISFAGTKTHYGNSVKGRFSISRDNSINTVYLQMNSLRAEDTALYYCAKDLREYECEEWTSDYYDFGRPQPCIDSRGVVGILDIWSQGTMVTVSS

SEQ ID NO: 1991 - protein, 144 aa, Artificial Sequence
  anti-HIV_cap256-119-002017_VR-Chain
QVQLVESGGGVVQPGRSLRLSCAASGFTFSYYGIHWVRQAPGKGLEWVASISYDERDFYHARSVWGRFAISRDNSKNTLHLQMNSLRPEDTALYFCARDLRESECEEWESYYYDFGKKGPCVKPRGVVGVLDIWGQGTLVTVSS

SEQ ID NO: 1992 - protein, 144 aa, Artificial Sequence
  anti-HIV_cap256-119-001312_VR-Chain
QVQLMESGGGVVQPGRSLRLACAASGFTFSSYAIHWVRQAPGKGLEWVAAISFAGTKKNYADSVRGRFTISRDSSKNTLYLEMNSLRPEDTALYYCAKDMRGYECEEWTSDYYDFGRPQPCIDSRGVVGTFDVWGQGTMVTVSS

SEQ ID NO: 1993 - protein, 146 aa, Artificial Sequence
  anti-HIV_cap256-119-001017_VR-Chain
QMQLVESGGGVVQPGRSLTLSCAASQFSFTNYGMHWVRQAPGKGLEWVASISNDGNKKYHGESVWDRFTISRDNSKNTLFLQMNRLRVEDTALYFCVKDQREDECEEWWSDYYDFGRELPCRKFRGLGLAGIFDVWGHGTMVTVSS

SEQ ID NO: 1994 - protein, 144 aa, Artificial Sequence
  anti-HIV_cap256-119-000594_VR-Chain
QVQLVESGGGLVQPGTSLRLSCAASAFTFKNYGMHWVRQAPGKGLDWVASISYDGRDKYHSSLVWGRLTISRDNSKSTLFLQMNSLRAEDTALYYCARDLRESECEEWQSDYYAFYKKLPCVKPRGVAGTLDIWGQGTMVTVSS

SEQ ID NO: 1995 - protein, 144 aa, Artificial Sequence
  anti-HIV_cap256-059-241099_VR-Chain
QVQLVESGGGVVQPGRSLRLSCAASGFTFSSYGMHWVRQAPGKGLEWVAVISYDGSNKYYVDSVQGRFTISRDNSKNTMFLQMNSLRTEDTAVYYCARDLGESEVEEWATDYYDFSIAYPVEGPRGVVGIFDIWGQGTMVTVSS

SEQ ID NO: 1996 - protein, 144 aa, Artificial Sequence
  anti-HIV_cap256-059-207529_VR-Chain
QVQLVESGGGVVQPGRSLRLSCAASGFTFSSYGMHWVRQAPGKGLEWVAGISFAGINKYYGNSVKGRFTISRDNSRNTLYLQMNSLRAEDTALYYCARDLREMECEEWASDYYDFGRGGPCQDPRGVVGTFDIWGQGTMVTVSS

SEQ ID NO: 1997 - protein, 145 aa, Artificial Sequence
  anti-HIV_cap256-059-205541_VR-Chain
QMQLVESGGGVVQPGGSLRLSCAASGFSFSYYAMDWVRQAPGKGLEWVAFISSDGSDKNYADSVKGRFTISRDNSKNTLYLQMNSLRAEDTAVYYCAKDVGGHKNDEWATNYYYDISIAYPIQDPRAVAGAFDVWGQGTMVTVSS

SEQ ID NO: 1998 - protein, 144 aa, Artificial Sequence
  anti-HIV_cap256-059-188439_VR-Chain
QVQLVESGGGVVQPGRSLRLSCAASQFTFSNYGMHWVRQAPGKGLEWVAAISFAGINKYYTDSVKGRFTISRDNSKNTLYLQMNSLRAEDTALYYCAKDLRGFECEEWASDYYDFGRDLPCQDPRGVVGTFDVWGQGTKVTVSS

SEQ ID NO: 1999 - protein, 144 aa, Artificial Sequence
  anti-HIV_cap256-059-187234_VR-Chain
QVQLVESGGGVVQAGRSLRLSCAASQFTFGSYGMHWVRQAPGKGLEWVAAISFAGTKIHYADSVKGRFTISRDNSKNALYLQMHSLRAEDTALYYCAKDLREYECEEWASDYYDFGRDQPCQDPRGVVGIFDIWGQGTMVTVSS

SEQ ID NO: 2000 - protein, 144 aa, Artificial Sequence
  anti-HIV_cap256-059-187047_VR-Chain
QVQLVESGGGVVQPGRSLRLSCAVSQLTFSSYGMHWVRQAPGKGLEWVAAISFVGIKKYYADSVKGRFTISRDNSKNTLYLQMNSLRVEDTALYYCAKDLREYECEEWASDYYDFGRDQPCQDARGVVGTSDIWGQGTMVTVSS

SEQ ID NO: 2001 - protein, 144 aa, Artificial Sequence
  anti-HIV_cap256-059-186068_VR-Chain
QVQLVESGGGVVQPGRSLRLSCAASQFSFSNYGMHWVRQAPGKGLEWVAGISFAATKKYYADSVKGRFSVSRDNSKNALYLQMNSLRAEDTALYYCARDLRDYECEEWASDYYDFGREYPCQDPRGVVGTFDIWGQGTMVTVST

SEQ ID NO: 2002 - protein, 145 aa, Artificial Sequence
  anti-HIV_cap256-059-182835_VR-Chain
QVQLVESGGGLVQPGRSLRLSCAASGFSFNNFAMDWVRQAPGKGLEWVAFVSSDGSNKNYADSVKGRFIISRDNSKNTVYLQMNSLRVEDTAVYYCAKDLGANKDDEWATDYYYDLSVARPVPDPRAVVGAFDVWGQGTMVTVSS

SEQ ID NO: 2003 - protein, 144 aa, Artificial Sequence
  anti-HIV_cap256-059-176659_VR-Chain
RVQLVESGGGVVQPGRSLRLSCAASQFSFSNYGMHWVRQAPGKGLEWVAGISFAAIKKYYADSVKGRFTISRDNSKNALYLQMNSLRAEDTALYYCARDLREYECEEWASDYYDFGRELPCQDPRGVVGTFDTWGQGTMVTVST

SEQ ID NO: 2004 - protein, 144 aa, Artificial Sequence
  anti-HIV_cap256-059-172956_VR-Chain
QVQLVESGGGVVQPGRSLRLSCAASQFSFSSYGMHWVRQAPGKGLEWVAAMSFAGTNQYYAASVKGRFTISRDNSKNTLYLHMNSLRPEDTALYYCARDLREYECEEWAADYYDFGREYPCQDPRGVVGIFDVWGQGTLVTVSS

SEQ ID NO: 2005 - protein, 144 aa, Artificial Sequence
  anti-HIV_cap256-059-171272_VR-Chain
QVLLVESGGGVVQPGRSLRLSCAASQFTFSNYGMHWVRQAPGKGLEWVAAISFAGMKKYYADSVKGRFTISRDNSKNTLYLQMNSLRAEDTALYYCAKDLREFECEEWASDYYDFGRAQPCQDPRGVVGTFDLWGQGTMVTVSS

SEQ ID NO: 2006 - protein, 144 aa, Artificial Sequence
  anti-HIV_cap256-059-168734_VR-Chain
QVQLVESGGGVVQPGRSLRLSCTASQFSFSSYGMHWVRQAPGKGLEWVAAISFAGTKKYYVGTVKGRFTISRDNSKNTLYLQMNSLRAEDTALYYCAKDMREYECEEWASDYYDFGREYPCQDPRGVVGTFDIWGQGTMVTVSS

SEQ ID NO: 2007 - protein, 144 aa, Artificial Sequence
  anti-HIV_cap256-059-155838_VR-Chain
QVQLVESGGGVVQPGRSLRLSCAVSQFTFSNYGMHWVRQAPGKGLEWVAAISFAGTKKSYAASVKGRFTISRDNSKNTLYLQMNSLRPEDTALYYCAKDMRGFECEEWASDYYDFGREQPCQDPRGVVGIFDLWGQGTMVSVSS

SEQ ID NO: 2008 - protein, 144 aa, Artificial Sequence
  anti-HIV_cap256-059-149799_VR-Chain
QVHLVESGGGVVQPGRSLRLSCAASQFTFSNYGFHWVRQAPGKGLEWVAAISFAGVKKHYADSVKGRFTISRDNSKNTLYLQLNSLRAEDTALYYCAKDLREYECEEWASDYYDFGRDFPCQDPRGVVGTFDIWGQGTMVTVSS

SEQ ID NO: 2009 - protein, 144 aa, Artificial Sequence
  anti-HIV_cap256-059-148168_VR-Chain
QVQLVESGGGVVQPGRSLRLSCTASQFTFSNYGMHWVRQAPGKGLEWVAGISFAATKKYYSDSVKGRFTISRDNSKNALYLQMNSLRAEDTALYHCAKDLREYECEEWASDYYDFGREQPCQDPRGVVGTFDIWGQGTMVTVST

SEQ ID NO: 2010 - protein, 145 aa, Artificial Sequence
  anti-HIV_cap256-059-144685_VR-Chain
QVHLVESGGGVVQPGRSLRLSCAASGFTFSNFAMDWVRQAPGKGLEWVAFVSSDGNNKNYGDSVKGRFTISRDNSKNTLFLQMNSLRAEDTALYYCVKDVGDYKSDEWATHYYYDLSIADPIQDPRAVVGAFDIWGRGTMVAVSS

SEQ ID NO: 2011 - protein, 144 aa, Artificial Sequence
  anti-HIV_cap256-059-140017_VR-Chain
QVQLVESGGGVVQPGRSLRLSCAASQFSFGNFGMHWVRQAPGKGLEWVAGISFAGTKKYYADSVKGRFTISRDNSKSALFLQMNSLRAEDTALYYCAKDLRYYECEEWASDYYDFGRDQPCQDPRGVVGTFDMWGQGTMVTVSS

SEQ ID NO: 2012 - protein, 144 aa, Artificial Sequence
  anti-HIV_cap256-059-137547_VR-Chain
QVQLVESGGGVVQPGRSLRLSCAASQFTFSRYGMHWVRQAPGKGLEWVAAISFAGIKKNYADSVKGRFTISRDNSKNTLYLQMNSLRAEDTALYYCARDLREFECEEWASDYYDFGRDFPCQDPRGVVGIFDIWGQGTMVTVSS

SEQ ID NO: 2013 - protein, 145 aa, Artificial Sequence
  anti-HIV_cap256-059-131908_VR-Chain
QVQLVESGGGVVQPGRSLRLSCTASGFTFSNYGIHWVRQAPGKGLEWVAAISYEGSIKYYVDSVKGRFTISRDDSKNTLFLQMNSLRTEDTAVYYCTRDVREWETEEWATNYYYDLSIAYPIRHPRGVVGIFDVWGLGTRVTVSS

SEQ ID NO: 2014 - protein, 144 aa, Artificial Sequence
  anti-HIV_cap256-059-116006_VR-Chain
QAQLVESGGGVVQPGRSLRLSCAASQFSFSSYGMHWVRQAPGKGLEWVASISFAGVKKTNADSVKGRFTISRDNSKNTLHLQMNGLRNDDTALYYCARDLRDFECEEWASDYYDFGREFPCQDPRGVVGTFDIWGQGTKVTVSS

SEQ ID NO: 2015 - protein, 137 aa, Artificial Sequence
  anti-HIV_cap256-059-115783_VR-Chain
QVQLVESGGGVVQPGRSLRLSCAASQFTFSSYGMHWVRQAPGKGLEWVAAISYADSVKGRFTISRDNSKNTLYLQMNSLRAEDTALYYCAKDLREMECEEWASDYYDFGRDLPCQDPRGVVGTLDIWGQGTMVTVSS

SEQ ID NO: 2016 - protein, 144 aa, Artificial Sequence
  anti-HIV_cap256-059-114609_VR-Chain
QVQLVESGGGVVQPGRSLRLSCAASQLTFSNFGMHWVRQAPGKGLEWVAGISFAGTKKYYADSVKGRFTISRDNSKNALYLQMNTLRAEDTALYFCAKDLREYECEEWASDYYDFGRDQPCQDPRGVVGIFDIWGQGTMVTVSS

SEQ ID NO: 2017 - protein, 144 aa, Artificial Sequence
  anti-HIV_cap256-059-113952_VR-Chain
QAQLVESGGGVVQPGRSLRLSCAASHFTFSSYGFHWVRQAPGKGLEWVAGISFAATKKYYADSVKGRFTISRDNSKDALYLQMNSLRAEDTALYYCARDLRGYECEEWASDYYDFGRDQPCQDPRGVVGIFDLWGQGTMVTVSS

SEQ ID NO: 2018 - protein, 144 aa, Artificial Sequence
  anti-HIV_cap256-059-113878_VR-Chain
QVQLVESGGGVVQPGRSLRLSCAASGFTFSTYAMHWVRQAPGKGLEWVALISYDATNKYYVDSVKGRFTISRDNSKNTLYLQMSSLTAEDTAVYYCAKDLGGIKIDEWGTDYYDISVSYPVQDPRAVAGIFDVWGHGTMVSVSS

SEQ ID NO: 2019 - protein, 144 aa, Artificial Sequence
  anti-HIV_cap256-059-113622_VR-Chain
QVQLVESGGGVVQPGRSLRLSCAASQFTFTSYGMHWVRQAPGKGLEWVAGISFAGTKKHYADSVKGRFTISRDNSKSTLYLQMNSLRAEDTALYYCAKDMREYECEEWASDYYDFGRDQPCQDPRGVVGIFDLWGQGTMVTVSS

SEQ ID NO: 2020 - protein, 144 aa, Artificial Sequence
  anti-HIV_cap256-059-109427_VR-Chain
QVQLVESGGGVVQPGRSLRLSCAASQFTFSNYGMHWVRQAPGKGLEWVASISFAGIKKHYTDSVKGRFTISRDNSKNTLFLQMNSLRAEDTALYYCARDLREYECEEWASDYYDFGRDQPCQDPRGVVGTSDIWGQGTKVTVSS

SEQ ID NO: 2021 - protein, 144 aa, Artificial Sequence
  anti-HIV_cap256-059-109081_VR-Chain
QEQLVESGGGVVQPGRSLRLSCAASQFSFSAYGMHWVRQAPGKGLEWVAGISFAATKKYYEDSVKGRFTISRDNSKNTLYLQMNSLRGEDTALYYCAKDMREMECEEWASDYYDFGRPQPCQDPRGVVGIFDMWGQGTMVTVSS

SEQ ID NO: 2022 - protein, 144 aa, Artificial Sequence
  anti-HIV_cap256-059-107590_VR-Chain
QEQLVESGGGVVQPGRSLRLSCAASQFSISAYGMHWVRQAPGKGLEWVAGISFAGTKKYYADSVKGRFTISRDNSKNTLYLQMNSLRGEDTALYYCAKDMREMECEEWASDYYDFGRDQPCQDPRGVVGIFDMWGQGTMVTVSS

SEQ ID NO: 2023 - protein, 145 aa, Artificial Sequence
  anti-HIV_cap256-059-107504_VR-Chain
QVLLVESGGGVVQPGKSLRLSCSASRFTFSNYGMHWVRQAPGKGLEWVAAVSFAGIKKTNADSVKGRFTISRDNSKNTLYLQMNSLRAEDTALYYCARDLRDFECEEWASDYYDFWGDPQPCQDPRGVVGTFDLWGQGTMVTVSS

SEQ ID NO: 2024 - protein, 144 aa, Artificial Sequence
  anti-HIV_cap256-059-099614_VR-Chain
EVLLLESGGGLVQPGRSLRLSCAASQFTFSSYGMHWVRQAPGKGLEWVAGISFVGIKKYYADSVKGRFTISRDNSKNTLYLQMNSLRAEDTALYYCARDLREYECEEWASDYYDFGRDQPCQDPRGVVGTFDIWGQGTMVTVSS

SEQ ID NO: 2025 - protein, 144 aa, Artificial Sequence
  anti-HIV_cap256-059-098972_VR-Chain
QVQLVESGGGVVQPGRSLRLSCAASQFTFSSYGMHWVRQAPGKGLEWVASISFAGIKKNYRDSVKGRFTISRDNSKNTLYLQMTSLRPEDTALYYCAKDLRGFECEEWASDYYDFGRELPCQDPRGVVGTFDMWGQGTMVTVSS

SEQ ID NO: 2026 - protein, 144 aa, Artificial Sequence
  anti-HIV_cap256-059-097236_VR-Chain
QVQLVESGGGVVQPGRSLRLSCAASGFSFSNFGFHWVRQAPGKGLEWVAAISFVGNKKYYAESVKGRFTISRENSKNMLFLQMNSLRGEDTAVYYCAKDLREFECEEWASDYYDFGREQPCQDPRGVVGSIDVWGHGSLVTVSS

SEQ ID NO: 2027 - protein, 144 aa, Artificial Sequence
  anti-HIV_cap256-059-091487_VR-Chain
QVQLVESGGGVVQPGRSLRLSCAASQFTFNRYGMHWVRQAPGKGLEWVAVISYDGTNKYYGESVKGRFTISRDNSKNTLYLQMNSLRAEDTALYYCAKDLREDECEEWWSDYYDFGRELPCRKSRGVAGIFDIWGQGTMVTVSS

SEQ ID NO: 2028 - protein, 144 aa, Artificial Sequence
  anti-HIV_cap256-059-089812_VR-Chain
QVQLVESGGGVVQPGRSLRLSCAASQLTFSSYGMHWVRQAPGKGLEWVAGISFAGTKKHYSDSVKGRFTISRDNSKNALYLQMNSLRAEDTALYYCAKDLREYECEEWASDYYDFGREQPCQDPRGVVGIFDMWGQGTMVTVSS

SEQ ID NO: 2029 - protein, 144 aa, Artificial Sequence
  anti-HIV_cap256-059-088468_VR-Chain
QVQLVESGGGVVQPGRSLRLSCAASQFTFSSYGMHWVRQAPGKGLEWVAAISFVGIKKYYANSVKGRFTISRDNSKNTLYLQMNSLRAEDTALYYCARDLREYECEEWASDYYDFGRGGPCQDPRGVVGSFDIWGQGTMVTVSS

SEQ ID NO: 2030 - protein, 144 aa, Artificial Sequence
  anti-HIV_cap256-059-088341_VR-Chain
QVQLVESGGGVVQPGRSLRLSCAASQFTFSSYGMHWVRQAPGKGLEWVAAISFAGIKKHYADSVKGRFTISRDNSKNMVFLQMNSLRAEDTALYYCARDLREYECEEWASDYYDFGRDQPCQDPRGVVGTSDIWGQGTMVTVSS

SEQ ID NO: 2031 - protein, 144 aa, Artificial Sequence
  anti-HIV_cap256-059-086533_VR-Chain
QVLLVESGGGVVQPGRSLRLSCAASQFTFSNFGMHWVRQAPGKGLEWVAGISFVGIKKYYAGSVKGRFTISRDNSKNTLYLQMNSLRAEDTALYYCAKDLREFECEEWASDYYDFGRPQPCQDPRGVVGTFDLWGLGTLVTVSS

SEQ ID NO: 2032 - protein, 144 aa, Artificial Sequence
  anti-HIV_cap256-059-086043_VR-Chain
EVHLVESGGGLVKPGGSLRLSCAASGFTFSTYSMNWVRQAPGKGLEWVAFVAFDESDKYYADSVKGRFTISRDNSKNTLSLQMNSLRVEDTAIYYCAKEVGDNKDDEWASDYYDLSIAYPIQDPRAVGRGYDIWGQGTMVTVSS

SEQ ID NO: 2033 - protein, 144 aa, Artificial Sequence
  anti-HIV_cap256-059-084191_VR-Chain
QVQLVESGGGVVQPGRSLRLSCAASQFTFSSYGMHWVRQAPGKGLEWVAAISFVGIKKYYADSVKGRFTVSRDNSKSTLYLQMNSLRAEDTALYYCARDLREYECEEWASDYYDFGRDQPCQDPRGVVGIFDIWGQGTAVTVSS

SEQ ID NO: 2034 - protein, 139 aa, Artificial Sequence
  anti-HIV_cap256-059-082135_VR-Chain
QVQLVESGGGVVQPGRSLRLSCTASGFTFRSYAIHWVRQAPGKGLEWVALISYDGSNKYYADSVKGRFTISRDNSKNTLYLQMNSLTSEDTAVYYCAKDLGGSKTDEWGTDYCYPVQDPRVVVGAFDIWGHGTMVTVSS

SEQ ID NO: 2035 - protein, 144 aa, Artificial Sequence
  anti-HIV_cap256-059-079417_VR-Chain
QVQLVESGGGVVQPGRSLRLSCAASGFSFSNYAMDWVRQAPGKGLEWVAFVSSDGNNKKYADSVKGRFTLSRDNYKNTVYLQMNSLTVEDTAVYYCAKDLGANKDDEWGTDYYDMSVSYPIPDPRAVVGAFDVWGQGTLVTVSS

SEQ ID NO: 2036 - protein, 145 aa, Artificial Sequence
  anti-HIV_cap256-059-076027_VR-Chain
QVQLVESGGGVVQPGRSLRLSCAASGFSFSKYGMHWVRQAPGKGLEWVAFVAFDESEKYYAASVKGRFTISRDNSKNTLSLQMNSLRTEDTAIYYCAKEVGDNKDDEWTSPYYYDISIAYPVHDPRAVVGVSDVWGQGTMVTVSS

SEQ ID NO: 2037 - protein, 144 aa, Artificial Sequence
  anti-HIV_cap256-059-075082_VR-Chain
QVQLVESGGGVVQPGRSLRLSCAASQFTFSSYGMHWVRQAPGKGLEWVAAISFVGIKKYYADSVKGRFTISRDNSKNTLYLQMNSLRAEDTALYYCAKDLREMECEEWASDYYDFGRDLPCQDPRGVVGTLDIWGQGTMVTVSS

SEQ ID NO: 2038 - protein, 144 aa, Artificial Sequence
  anti-HIV_cap256-059-072575_VR-Chain
QGQLVESGGGVVQPGRSLRLSCAASQFTFSNFGMHWVRQAPGKGLEWVAVISYDGTKKYYADSVKGRFTISRDNSKNTLYLQMNSLRAEDTALYYCAKDMREDECEEWGADYYDFGKDYPCQASRGVVGIFDIWGQGTMVTVSA

SEQ ID NO: 2039 - protein, 144 aa, Artificial Sequence
  anti-HIV_cap256-059-071926_VR-Chain
QVQLVESGGGVVQPGRSLRLSCAASQLSFSNYGMHWVRQAPGKGLEWVAGISFVGIKKYYRDSVKGRFTISRDNSKNTLYLQMNSLRTEDTALYYCVKDLREFECEEWASDYYDFGRDQPCLDPRGVVGTFDIWGQGTMVTVSS

SEQ ID NO: 2040 - protein, 144 aa, Artificial Sequence
  anti-HIV_cap256-059-069638_VR-Chain
QVQLVESGGGVVQPGRSLRLSCAASGFTFSKNAMHWVRQAPGRGLEWVASVAFDGSDKYYADSVKGRFTISRDNSKNTLSLQMNSLRAEDTAVYYCAKEVDLYKDDEWGSDYYDLSIAYPIQDPRAVVGGFGIWGQGTMVTVSS

SEQ ID NO: 2041 - protein, 144 aa, Artificial Sequence
  anti-HIV_cap256-059-069165_VR-Chain
LVQLVESGGGVVQPGRSLRLSCAASRFTFSNYGMHWVRQAPGKGLEWVAGISFAGTTKYYADSVRGRFTISRDNSKNTLYLQMNSLRAEDTALYYCAKDMREMECEEWASDYYDFGRPQPCQDPRGVVGIFDIWGQGTMVTVSS

SEQ ID NO: 2042 - protein, 144 aa, Artificial Sequence
  anti-HIV_cap256-059-068956_VR-Chain
QVQLVESGGGVVQPGRSLRLSCAASGFTFSTYAMHWVRQAPGRGLEWVALISYDGSNKYYVDSVKGRFTISRDNSKNTLYLQMNSLTAEDTAVYYCAKDLGGSKDDEWATDYYDLSIAYPIQDPRAVAGIFDVWGRGTVVTVSS

SEQ ID NO: 2043 - protein, 144 aa, Artificial Sequence
  anti-HIV_cap256-059-068876_VR-Chain
QVQLVESGGGVVQPGRSLRLSCAASQFTFSSYGMHWVRQAPGKGLEWVAAISFAGTKKYYANSVKGRFTISRDNSKNTLSLQMNSLRGEDTARYYCARDPREYECEEWASDYYDFGRDQPCQDPRGVIGIFDIWGQGTMVTVSS

SEQ ID NO: 2044 - protein, 144 aa, Artificial Sequence
  anti-HIV_cap256-059-067733_VR-Chain
QVQLVESGGGVVQPGRSLRLSCTASQFSFSSYGMHWVRQAPGKGLEWVAAISFAGTKKNYVDSVKGRFTISRDNSKNTLYLQMNSLRADDTALYYCAKDMREYECEEWASDYYDFGREYPCTDPRGVVGTFDVWGQGTMVTVSS

SEQ ID NO: 2045 - protein, 144 aa, Artificial Sequence
  anti-HIV_cap256-059-067450_VR-Chain
QVQLVESGGGVVQPGRSLRLSCAASQFTFSNYGMHWVRQAPGKGLEWVAGISFAGIKKYYADSVKGRFTISRDNAKNTLYLQMNSLRAEDTALYYCAKDLREYECEEWASDYYDFGRELPCQDPRGVVGTFDIWGQGTMVTVSS

SEQ ID NO: 2046 - protein, 144 aa, Artificial Sequence
  anti-HIV_cap256-059-065694_VR-Chain
QVQLVESGGGVVQPGRSLRLSCAASQLTFNNYGMHWVRQTPGKGLEWVAGISFAGINKYYADSVKGRFTISRDNSKNALYLQMTSLRAEDTALYYCVKDLREMECEEWASDYYDFGRDQPCQDPRGVVGTFDIWGQGTMVTVSS

SEQ ID NO: 2047 - protein, 144 aa, Artificial Sequence
  anti-HIV_cap256-059-065109_VR-Chain
QVQLVESGGGVVQPGKSLRLSCAASGFTFTNNAMNWVRQAPGKGLEWVAFVSSDGRNKNYADSVKGRFTISRDNSKNTVYLQMNSLRVEDTALYYCAKDLGANKDDEWATDYYDLSVAYPIPDPRAVVGAFDVWGQGTMVTVSS

SEQ ID NO: 2048 - protein, 144 aa, Artificial Sequence
  anti-HIV_cap256-059-065060_VR-Chain
QVQLVESGGGVVQPGTSLRLSCAASGFTFSNYAMGWVRQAPGKGLEWVAVVSYDGSKKSYADSVKGRFTISRDNSRNTLYLQLNSLRAEDTAMFYCAKDLGKGEIEEWATDYYDWSKAYPIEGPRDVVGAFDTWGQGTLVTVSS

SEQ ID NO: 2049 - protein, 144 aa, Artificial Sequence
  anti-HIV_cap256-059-064001_VR-Chain
QVQLVESGGGVVQPGRSLRLSCAASQFTFSNYGMHWVRQAPGKGLEWVAGISFAGTKNYYAKSVKGRFTISRDNSKNALYLQMNSLRAEDTALYYCAKDMREYECEEWASDYYDFGRDQPCQDPRGVVGTFDIWGQGTMVAVSS

SEQ ID NO: 2050 - protein, 144 aa, Artificial Sequence
  anti-HIV_cap256-059-063270_VR-Chain
QVQLVESGGGVVQPGRSLRLSCAASQFTFSNYGMHWVRQAPGKGLEWVAAISFAGTKKHYADSVKGRFTISRDNSKNALYLQMNSLRAEDTALYYCAKDLREYECEEWASDYYDFGRDQPCLDPRGVVGIFDIWGQGTLVTVSS

SEQ ID NO: 2051 - protein, 144 aa, Artificial Sequence
  anti-HIV_cap256-059-061357_VR-Chain
QVQLVESGGGVVQPGRSLRLSCAASGFTFSNFGFHWVRQAPGKGLEWVAGISFAGTKIYYADSVKGRFTISRENSKNMLYLQMNSLRGEDTAVYFCAKDLREFECEEWASDYYDFGREFPCQDPRGVVGTFDVWGHGAVVTVSS

SEQ ID NO: 2052 - protein, 145 aa, Artificial Sequence
  anti-HIV_cap256-059-059834_VR-Chain
QVQLVESGGGVVQPGRSLRLSCAASGFTFSNFGMHWVRQAPGKGLEWVAFVAFDESDKYYAASVKGRFTVSRDNSKNTVSLQMNSLRTEDTAVYYCAKEVGDNKDDEWTSPYYYDFSIAYPVHDPRAVVGGYDVWGQGTMVTVSS

SEQ ID NO: 2053 - protein, 144 aa, Artificial Sequence
  anti-HIV_cap256-059-059313_VR-Chain
QVHLVESGGGVVQPGKSLRLSCAASQFTFSNFGMHWVRQAPGKGLEWVAGISFAGTKKYYADSVKGRFTISRDNSKNTLYLQMNSVRAEDTALYYCAKDMREYECEEWASDYYDFGKPQPCQDPRGVVGTFDMWGLGTLVTVSS

SEQ ID NO: 2054 - protein, 144 aa, Artificial Sequence
  anti-HIV_cap256-059-057130_VR-Chain
QVQLVESGGGVVQPGRSLRLSCAASQFSFSSYGMHWVRQAPGKGLEWVAAISFAGIKKHYADSVKGRFTISRDNSKNTLYLQMNSLRVEDTALYYCAKDLREYECEEWASDYYDFGRPQPCQDPRGVVGTSDIWGQGTMVTVSS

SEQ ID NO: 2055 - protein, 137 aa, Artificial Sequence
  anti-HIV_cap256-059-050520_VR-Chain
QVQLVESGGGVVQPGRSLRLSCAASQFTFNRYGMHWVRQAPGKGLEWVAVISYADSVKGRFTISRDNSKNTLYLQMNSLRAEDTALYYCAKDLREDECEEWWSDYYDFGRELPCRKSRGVAGIFDIWGQGTMVTVSS

SEQ ID NO: 2056 - protein, 144 aa, Artificial Sequence
  anti-HIV_cap256-059-049839_VR-Chain
QVQLVESGGGVVQPGRSLRLSCAASGFSFSNYAMDWVRQAPGKGLEWVAVVSSDGKTKNYADSVKGRFTISRDNSKNTVYLQMNSLRPEDTAVYYCAKDLGANKDDEWTTDYYDWSVAYPVPDPRAVVGAFDVWGQGTMVTVSS

SEQ ID NO: 2057 - protein, 144 aa, Artificial Sequence
  anti-HIV_cap256-059-048503_VR-Chain
QVQLVESGGGVVQPGRSLRLSCAASQLSFSNYGMHWVRQAPGKGLEWVAGTSFAGTKKYYADSVKGRFTISRDNSKNALYLQMNSLRAEDTALYYCAKDLREYECEEWASDYYDFGRDQPCQDPRGVVGTFDIWGQGTMVTVSA

SEQ ID NO: 2058 - protein, 144 aa, Artificial Sequence
  anti-HIV_cap256-059-045516_VR-Chain
QVQLVESGGGVVQPGRSLRLSCAASQFTFSGYGMHWVRQAPGKGLEWVAAISFAGNKRYFADSVKGRFTISRDNSKNTLFLQMNSLRAEDTALYYCARDMREYECEEWASDYYDFGRPQPCQDPRGVVGVFDIWGQGTMVTVSS

SEQ ID NO: 2059 - protein, 144 aa, Artificial Sequence
  anti-HIV_cap256-059-044188_VR-Chain
QVHLVESGGGVVQPGRSLRLSCAASQFTFSSYGMHWVRQAPGKGLEWVAGISFAGTNKYYADSVKGRFTVSRDNSKNTLYVQMNSLRAEDTALYYCARDLREYECEEWASDYYDFGREQPCQDPRGVVGIFDIWGPGTMVTVSS

SEQ ID NO: 2060 - protein, 145 aa, Artificial Sequence
  anti-HIV_cap256-059-044105_VR-Chain
QGQLVESGGGVVQPGRSLSLSCAASGFSFNNYAMDWVRQAPGKGLEWVAVVSSDGNNKNYADSVKGRFTISRDNSKNTVYLQMNSLRAEDTAIYYCAKDVGANKDDEWATNYYYDWSVAYPVPDPRAVIGAFDVWGQGTMVTVSS

SEQ ID NO: 2061 - protein, 144 aa, Artificial Sequence
  anti-HIV_cap256-059-042100_VR-Chain
QVQLVESGGGVVQPGRSQRLSCAASQFTFSSYGMHWVRQAPGKGLEWVAAISFAGTNKYYGDSVKGRFTISRDNSKNTLYLQMNSLRAEDTALYHCARDMREYECEEWASDYYDFGRDQPCQDPRGVVGIFDLWGQGTMVTVSS

SEQ ID NO: 2062 - protein, 144 aa, Artificial Sequence
  anti-HIV_cap256-059-040742_VR-Chain
QVQLVETGGGVGQPGKSLRLSCAASGFTFSNFAMDWVRQAPGKGLEWVAFISSDGINKKYGDFVKGRFTISRDNSKNTLFLQMNSLRAEDTALYYCAKDVGDYKSDEWGTDYYDLSIEYPIQDPRAVVGAFDNWGQGTMVIVSS

SEQ ID NO: 2063 - protein, 144 aa, Artificial Sequence
  anti-HIV_cap256-059-040554_VR-Chain
QVQLVESGGGVVQPGRSLRLSCAASQFTFSSYGMHWVRQAPGKGLEWVAGISFAATNKYYGGSVKGRFTISRDNSKNTLYLQMNSLRAEDTALYYCTRDMREYECEEWASDYYDFGKDQPCQDPRGVVGTLDIWGQGTMVTVSS

SEQ ID NO: 2064 - protein, 144 aa, Artificial Sequence
  anti-HIV_cap256-059-039660_VR-Chain
QVQLVESGGGVVQPGRSLRLSCAASQFSFSNYGMHWVRQAPGKGLEWVASISFAGTKKKYADSVKGRFTISRDNSKNTLFLQMNSLRTEDAALYYCAKDMREFECEEWASDYYDFGREQPCQDTRDVVGIFDIWGQGTMVTVSS

SEQ ID NO: 2065 - protein, 145 aa, Artificial Sequence
  anti-HIV_cap256-059-039298_VR-Chain
QVQLVESGGGVVQPGRSLRLSCAASGFTFSKYGMHWVRQAPGKGLEWVAFVAFDESDKYYAASAKGRFIISRDNSKNTLSLQMNSLRTEDTAVYYCAKEVGDNKDDEWTSPYYYDISIAYPVQDPRAVVGGYDVWGQGTMVTVSS

SEQ ID NO: 2066 - protein, 144 aa, Artificial Sequence
  anti-HIV_cap256-059-037873_VR-Chain
QVQLVESGGGVVQPGRSLRLSCAASQFTFSNYGMHWVRQAPGKGLEWVAAISFAGINKYYADSVKGRFTLSRDNTKNTLYLQMNSLRAEDTALYYCARDLREYECEEWASDYYDFGRPQPCQDPRGVVGTSDIWGQGTMVTVSS

SEQ ID NO: 2067 - protein, 144 aa, Artificial Sequence
  anti-HIV_cap256-059-037633_VR-Chain
QVQLVESGGGVVQPGRSLRLSCAASQFTFSNFGMHWVRQAPGKGLEWVAAISFAGINKNYADSVKGRFTISRDNSKNTLHLQLNSLRAEDTALYYCAKDLREYECEEWASDYYDFGRDQPCQDPRGVVGTFDIWGQGTMVTVSS

SEQ ID NO: 2068 - protein, 144 aa, Artificial Sequence
  anti-HIV_cap256-059-036817_VR-Chain
QVQLLESGGGVVQPGRSLRLSCEASQFTFSNFGMHWVRQAPGKGLEWVAAISFAGIKKNYADSVKGRFTISRDNSKNTLYLQMNSLRVEDTALYYCAKDLREYECEEWASDYYDFGREQPCQDPRGVIGTFDIWGQGTMVTVSS

SEQ ID NO: 2069 - protein, 144 aa, Artificial Sequence
  anti-HIV_cap256-059-032787_VR-Chain
QVQLVESGGGVVQPGRSLRLSCAASGFTFSKYAMHWVRQAPGKGLEWVAFVAFDESDKYYVDSVKGRFTISRDNSKNTLSLQMNSLRAEDTAVYYCAKEVHVNKDDEWASDYYDLSIAYPIQDPRAVVGGLDIWGQGTMVTVSS

SEQ ID NO: 2070 - protein, 144 aa, Artificial Sequence
  anti-HIV_cap256-059-032427_VR-Chain
QVQLVESGGGVVQPGRSLRLSCAASQFTFSNFGMHWVRQAPGKGLEWVAGISFPGTKKYYADSVKGRFTISRDNSKNALYLQMNSLRAEDTALYYCARDLREYECEEWASDYYDFGKPQPCLDPRGVVGTFDIWGQGTMVTVSS

SEQ ID NO: 2071 - protein, 145 aa, Artificial Sequence
  anti-HIV_cap256-059-029390_VR-Chain
QVQLVESGGGVVQPGRSLRLSCAASGFTFNQHGMHWVRQAPDKGLEWVAFVGFDESEKYYADSVKGRFTISRDNSKNTLSLQMNSLRPEDTAVYYCAKEVGDNKEDEWASDYYYDLSNAYPIHDPRAVVGGYDIWGQGTMVTVCS

SEQ ID NO: 2072 - protein, 145 aa, Artificial Sequence
  anti-HIV_cap256-059-027877_VR-Chain
QVQLVESGGGVVQPGRSLRLSCSASAFSFSYFAMDWVRQAPGKGLEWVAFVSSDGNNKNYADSVKGRFTISRDNSKNTVFLQMDSLRPEDTAVYYCAKDLGGNKDDEWSTNYYYDISIADPVPDPRAVAGAFDVWGQGTMVTVSS

SEQ ID NO: 2073 - protein, 145 aa, Artificial Sequence
  anti-HIV_cap256-059-026640_VR-Chain
QVQLVESGGGVVQPGRSLRLSCAASGFSFSKYGMHWVRQAPGKGLEWVAFVAFDESDRYYAASVKGRFTISRDNSKNTLSLQMNSLRTEDTAIYYCAKEVGDNKDDEWTSPYYYDMSIAYPVQDPRAVVGGYDIWGQGTMVTVSS

SEQ ID NO: 2074 - protein, 144 aa, Artificial Sequence
  anti-HIV_cap256-059-026017_VR-Chain
QVQLVESGGGVVQPGRSLRLSCAASGFTFSTYAMHWVRQAPGKGLEWVALISYDGTNKYYVDSAKGRFTISRDNSKNTLYLQMNSLTPEDTAVFYCAKDLGGYKDDEWGTEYYDISVSYPVQDPRAVAGVFDVWGHGTMVTVSS

SEQ ID NO: 2075 - protein, 144 aa, Artificial Sequence
  anti-HIV_cap256-059-024100_VR-Chain
CQVLVESGGGVVQPGRSLRLSCAASQFTFSSYGMHWVRQAPGKGLEWVAAISFAGTKKYYADSVKGRFAISRDTSKNALYLQMNTLRAEDTALYYCARDLREFECEEWASDYYDFGRPQPCQDPRGVVGSFDIWGQGTMVTVSL

SEQ ID NO: 2076 - protein, 144 aa, Artificial Sequence
  anti-HIV_cap256-059-023966_VR-Chain
QVQLVESGGGVVQPGRSLRLSCAASQFSFSSYGMHWVRQAPGKGLEWVAAISFAGIKKHYTDSVKGRFTISRDNSKNTLYLQMNSLRAEDTALYYCAKDLRGFECEEWASDYYDFGRDQPCQDPRGVVGTFDIWGQGTLVTVSS

SEQ ID NO: 2077 - protein, 144 aa, Artificial Sequence
  anti-HIV_cap256-059-020534_VR-Chain
QVQLVESGGGVVQPGRSLRLSCAASQFTFSNYGMHWVRQAPGKGLEWVAGMSFAGTNTYYADSVKGRFTISRDNSKNTLYLQMNSLRAVDTALYYCARDMREYECEEWASDYYDFGREYPCQDPRGVVGIFDLWGQGTMVTVSS

SEQ ID NO: 2078 - protein, 145 aa, Artificial Sequence
  anti-HIV_cap256-059-019513_VR-Chain
QVQLVESGGGVVQPGRSLRLSCAASGFTFSNFAMGWVRQAPGKGLEWVAVISSDGTNKNYGDSVKGRFTISRDNSKNTLFLQMNSLRAEDTSLYYCAKDLGGYKTDEWATNYYYDISIASPIQDPRAVVGAFDIWGQGTMVTVTS

SEQ ID NO: 2079 - protein, 144 aa, Artificial Sequence
  anti-HIV_cap256-059-012963_VR-Chain
QVQLVESGGGVVQPGRSLRLSCVASGFSFSSYGMAWVRQAPGKGLEWVTVISFAGVKTYYADSVKGRFTISRDNSKGTLYLQMDGLRPEDTALYYCAKDLAERECEEWASDYYDFGRELPCQDPRGVVGTFDVWGQGTMVTVSS

SEQ ID NO: 2080 - protein, 145 aa, Artificial Sequence
  anti-HIV_cap256-059-010396_VR-Chain
QVQLVESGGGVVQPGRSLRLSCAASGFSFNNYAMNWVRQAPGKGLEWVAFVSSDGSNKNYADSVTGRFTLSRDNSKNTVFLQMNSLRVEDTAVYYCAKDVGANKDDEWTTNYYYDISIADPVPDPRAVIGAFDVWGQGTMVTVSS

SEQ ID NO: 2081 - protein, 144 aa, Artificial Sequence
  anti-HIV_cap256-059-008136_VR-Chain
QVQLVESGGGVVQPGRSLRLSCAASGFTFNTYAMHWVRQAPGKGLEWVALISYDGTEKYYADSVKGRFTISRDNSRNTLYLQMNSLRLEDAALYQCAKDLGGSKSDEWGTDYYDMSISYPIQDPRAVAGVFDIWGQGTLVTVSS

SEQ ID NO: 2082 - protein, 144 aa, Artificial Sequence
  anti-HIV_cap256-059-006147_VR-Chain
QVQVVESGGGVVQPGRSLRLSCTASGFTFSNFAMGWVRQAPGKGLEWVAFISSDGSNKNYGDSVKGRFTISRDNSKNTVFLQMNSLRVEDTALYYCAKDVGDYKSDEWGTEYYDISISYPIQDPRAMVGAFDLWGQGTMVTVSP

SEQ ID NO: 2083 - protein, 144 aa, Artificial Sequence
  anti-HIV_cap256-059-005081_VR-Chain
QVQLVESGGGVVQPGRSLRLSCAASQFTFSSYGMHWVRQAPGKGLEWVAGISFAATKKYYSESVKGRFTISRDNSKNALHLHMNSLRAEDTALYYCAKDLREFECEEWASDYYDFGRDQPCQDPRGVVGIFDMWGQGTMVTVSS

SEQ ID NO: 2084 - protein, 144 aa, Artificial Sequence
  anti-HIV_cap256-059-005006_VR-Chain
QAQLVESGGGVVQPAKSLRLSCAASGFTFNKYAMHWVRQAPGKGLEWVAFVAFDESDKYYADSVKGRFTISRDNSKNTLSLQMNNLRAEDTAVYYCAKEVGDNKDDEWASDYYDLSIAYPIQDPRAVGRGYDIWGQGTMVTVSS

SEQ ID NO: 2085 - protein, 144 aa, Artificial Sequence
  anti-HIV_cap256-059-004451_VR-Chain
QVHLVESGGGVVQPGKSLRLSCTASGFTFTNFAMDWVRQAPGKGLEWVAFISSDGSNKYYSESVKGRFTISRDNSKNTLYVQMNSLRTEDTAVYYCAKDLGGYKDDEWSTDYYDWSTAYPVQDPRAVAGAFDLWGQGTMVSVSS

SEQ ID NO: 2086 - protein, 144 aa, Artificial Sequence
  anti-HIV_cap256-059-003571_VR-Chain
QEQLVESGGGVVQPGRSLRLSCAASQFTFGAYGMHWVRQAPGKGLEWVAGVSFVGNNKYYADSVKGRFTISRDNSKNTLYLQMNSLRGEDTALYYCARDMREMECEEWASDYYDFGRPQPCQDPRGVVGIFDMWGQGTMVTVSS

SEQ ID NO: 2087 - protein, 144 aa, Artificial Sequence
  anti-HIV_cap256-059-003449_VR-Chain
QVQLVESGGGVVQPGKSLRLSCAASQVTFSSYGMHWVRQAPGKGLEWVAGISFAGTKKYYADSVKGRFTISRDNSKNALYLQMNRLRAGDTALYYCAKDLREYECEEWASDYYDFGREQPCQDPRGVVGIFDIWGLGTMVTVSS

SEQ ID NO: 2088 - protein, 144 aa, Artificial Sequence
  anti-HIV_cap256-059-002712_VR-Chain
QVQLAESGGGVVQPGRSLRLSCAASQFTFSSYGMHWVRQAPGKGLEWVAAISFAGTKKHYADSVKGRFTISRDNSKNTLNLQMNSLRAEDTALYYCARDMREYECEVWASDYYDFGREQPCQDPRGVVGTFDIWGQGTMVTVSP

SEQ ID NO: 2089 - protein, 144 aa, Artificial Sequence
  anti-HIV_cap256-059-001573_VR-Chain
QVQLVESGGGVVQPGRSLRLSCAASQFTFSSYGMHWVRQAPGKGLEWVAGISYDGTSKYYADSVKGRFTISRDNSKNTLYLQMNSLRAEDTALYYCAKDLREDECEEWWSDYYDFGRELPCRKSRGVAGTFDIWGHGTMVTVSS

SEQ ID NO: 2090 - protein, 144 aa, Artificial Sequence
  anti-HIV_cap256-059-001379_VR-Chain
QVRLVESGGGVVQPGRSLRLSCAASGFTFNSYPMHWVRQAPGKGLDWVALISYDGTNKFYVDSVKGRFTISRDNSKNTLYLQMNSLTAEDTAMYYCAKDLGGNKDDEWGTDYYDISVAYPIHDPRAVAGIFDVWGHGTMVTVSS

SEQ ID NO: 2091 - protein, 144 aa, Artificial Sequence
  anti-HIV_cap256-059-001029_VR-Chain
QEQLVQSGGGVVQPGRSLRLSCAPSQFTFSAHGMHWVRQAPGKGLEWVAGISFAGTKNYYADSVKGRFTISRDNSKNTLYLQMNSLRVEDTALYYCAKDMREMECEEWASDYYDFGRHQPCQDPRGVVGIFDIWGQGTMVTVSS

SEQ ID NO: 2092 - protein, 144 aa, Artificial Sequence
  anti-HIV_cap256-048-165087_VR-Chain
EVKLLESGGGLVQPGGYRRLSCAASGFTFSRYAMHWARQAPGKGLEWVAVVSDDGVKKYYPDSVRGRFTISRDNSRNTVSLQMNSLRPEDTAVYYCAKDVGANKDDEWATDYYDLSIAYPVPDPRAVVGAFDIWGQGTMVTVSS

SEQ ID NO: 2093 - protein, 144 aa, Artificial Sequence
  anti-HIV_cap256-048-158861_VR-Chain
EVQLVESGGGLVQPGGSLRLSCVDFGFRFSEYWMSWVRQAPGKGLEWVAVISYDGTNKYYADSVKGRFTISRDNSKNTLYLQMNSLRAEDTALYYCAKDMRESECEEWASDYYDFGKDYPCQDPRGVVGTFDIWGQGTMVTVSS

SEQ ID NO: 2094 - protein, 145 aa, Artificial Sequence
  anti-HIV_cap256-048-158280_VR-Chain
QVHLVESGGGVVQPGRSLRIYCAVSEFTFRNYAMHWVRLAPGKGLQWVAVISHDGINDYYADSVKGRFTISRDNSKNTVSLQMNSLRPEDTAVYYCAKDLGANKDDEWATDYYDLSIAYPVPDPTGPWFGAFDIWGQGTMVTVSS

SEQ ID NO: 2095 - protein, 144 aa, Artificial Sequence
  anti-HIV_cap256-048-157928_VR-Chain
QVQLMESGGGVVQPGRSLRLSCAISGFTFSNYWMSWVRQAPGKGLEWVAVISSDGSSKNYADSVKGRFTISRDNSKNTVSLQMNSLRPEDTAVYYCAKDVGANKDDEWATDYYDLSIAYPVPDPRAVVGAFDIWGQGTMVTVSS

SEQ ID NO: 2096 - protein, 144 aa, Artificial Sequence
  anti-HIV_cap256-048-157056_VR-Chain
QVQLVESGGGVVQPGRSLRLSCAASGFTLSSYAMHWVRQAPGKGLEWVAFISNDGSNKYFADSVKGRFTISRDNSKNTLYLQMNSLRAEDTAVYYCAKDLGGNKDDEWATDYYDLSIAYPVQDPRVVVGIFDIWGQGTMVTVSS

SEQ ID NO: 2097 - protein, 144 aa, Artificial Sequence
  anti-HIV_cap256-048-156422_VR-Chain
QVQLVESGGTVVQPGRSLRLSCVGSGFSLSYYAIHWVRQAPGKGLEWVAVISYDGSNYYYADSVKGRFTISRDNSKNTVYLQMNSLRGVDTAVYYCAKDLGGGEVEEWATDYYDWSIAYPVEHPRAVVGVFDIWGQGTKVTVSS

SEQ ID NO: 2098 - protein, 144 aa, Artificial Sequence
  anti-HIV_cap256-048-152863_VR-Chain
EVQLLESGGGLVQPGGSLRLSCAGSGFTFSKHGMHWVRQAPGKGLEWVAFVAFDESDKYYADSVKGRFTISRDNSKNTLSLQMNSLRAEDTAMYYCAKEVGDNKDDEWASDYYDLSIAYPVHDPRAVVGGYDIWGQGTMVTVSS

SEQ ID NO: 2099 - protein, 144 aa, Artificial Sequence
  anti-HIV_cap256-048-152770_VR-Chain
QVQLVESGGGVVQPGRSLRLSCAASGFTFRSNAMHWVRQAPGKGLEWVAVISYDGSKTYYADSVKGRFTISRDNSKNTLYLQMNSLRAEDTAVYYCAKDLGEYKSDEWATDYYDLSIAYPVQDPRGVAGAFDIWGQGTMVTVSS

SEQ ID NO: 2100 - protein, 144 aa, Artificial Sequence
  anti-HIV_cap256-048-150027_VR-Chain
EVQLVESGGGLVQPGGSLRLSCAVSGFTFSSYIMHWVRQAPGKGLEWVAVISYDGSNKDYADSVKGRFTISRDNSKNTLYLQMNSLRAEDTALYYCAKDLREYECEEWASDYYDFGRDYPCQDPRGVVGTFDIWGQGTMVTVSS

SEQ ID NO: 2101 - protein, 144 aa, Artificial Sequence
  anti-HIV_cap256-048-148246_VR-Chain
QVQLVESGGGVVQPGRSLRLSCATSGFTFSTYSMHWVRQAPGKGLEWVAVISYDGSNEYYVDSVKGRFTISRDNSKNTLYLQMNSLRVEDTALYYCAKDLGGNKDDEWGTDYYDFSVAYPVQDPRAVSGIFDVWGHGTMVTVSS

SEQ ID NO: 2102 - protein, 144 aa, Artificial Sequence
  anti-HIV_cap256-048-147428_VR-Chain
QVQLVESGGGVVQPGRSLRLSCSASGFTFSNYGMHWVRQAPGKGLEWVAVISFDGSNKVYADSVKGRFTISRDNSKNTLYLEMNSLRAEDTAEYYCAKDLGESDKEEWPSDYYDFGRDFTGQVPRAVVGIFDMWGQGTMVTVSS

SEQ ID NO: 2103 - protein, 144 aa, Artificial Sequence
  anti-HIV_cap256-048-146603_VR-Chain
EVQLVESGGGLVQPGRSLRLSCAASGFTFDDYAIHWVRQAPGKGLEWVALISYDGTDKYYADSVKGRFTISRDNSKNTLYLQMNSLRVEDTAVYHCAKDLGGTKSDEWATDYYDLSIAYPIQDPGAVVGVFDIWGQGTMVTVSS

SEQ ID NO: 2104 - protein, 144 aa, Artificial Sequence
  anti-HIV_cap256-048-145735_VR-Chain
QVQLVQSGGGVVQPGRSLRLSCGASGFTFSNYAMHWVRQAPGKGLDWVAVISYDGTNENHADSVKGRFTISRDNSKNTVYLQMNSLRAEDTAVYYCAKDVGGSKDDEWATDYYDLSIAYPVPDPRAVVGAFDIWGQGTMVTVSS

SEQ ID NO: 2105 - protein, 144 aa, Artificial Sequence
  anti-HIV_cap256-048-145116_VR-Chain
QVHLVESGGGVVQPGGSLRLSCAASGFTFSNYGMHWVRQAPGKGLEWVAAISFAGTNKYYADSVKGRFTISRDNSKNALYLQMNSLRAEDTALYYCAKDLRESECEEWASDYYDFGRDYPCQDPRGVVGTLDIWGQGTMVTVSS

SEQ ID NO: 2106 - protein, 144 aa, Artificial Sequence
  anti-HIV_cap256-048-144077_VR-Chain
QVKLVESGGGVVQPGRSLRLSCAASGFTLSSYAMHWVRQAPGKGLEWVAVISYDGSNRYTADSVKGRFTISRDNSKNTLNLQMNSLRPEDTAVYYCAKDVGANKDDEWATDYYDLSIAYPVPDPRAVVGAFDIWGQGTTVTVSS

SEQ ID NO: 2107 - protein, 144 aa, Artificial Sequence
  anti-HIV_cap256-048-142876_VR-Chain
QVQLVESGGGVVQPGGSLRLSCVASGFTFSTYGMHWVRQAPGKGLEWVAFMRFDGSNRYYGDSVKGRFTISRDNSKNTLYLQMISLRAEDTAVYHCAKDLGGNKPDEWATDYYDLSIAYPVQDPRAVVGVFDIWGQGTIITVSS

SEQ ID NO: 2108 - protein, 144 aa, Artificial Sequence
  anti-HIV_cap256-048-140582_VR-Chain
QVQLVESGGGVVQPGRSLRLSCAASGFSFSNYAMDWVRQAPGKGLEWVAFVSSDGSNKNYADSVKGRFTISRDNSKNTVYLQMNSLRVEDTAVYYCAKDLGANKDDEWATDYYDLSVAYPVPDPRAVVGAFDVWGQGTMVTVSS

SEQ ID NO: 2109 - protein, 144 aa, Artificial Sequence
  anti-HIV_cap256-048-139355_VR-Chain
QVQLVESGGGVVQPGRSLRLSCAASGFTFSSYAMHWVRQAPGKGLEWVAIISYDGSNKYYADSVKGRFTISRDNSKGTLYLQMDGPRPEDTALYYCAKDLGERECEEWASDYYDFGRDFPCQDPRGVVGTFDIWGQGTMVTVSS

SEQ ID NO: 2110 - protein, 144 aa, Artificial Sequence
  anti-HIV_cap256-048-139151_VR-Chain
QVQLVESGGGVVQPGKSLRLSCAASGFTFNTYGMHWVRQAPGKGLEWVAVISYDGSIQKYADSVKGRFTISRDNSKNTLYLQMNSLSVEDTAVYYCAKDLGKNKDDEWATDYYDISIAYPVPDPRAVVGVFDIWGQGTVVTVSS

SEQ ID NO: 2111 - protein, 144 aa, Artificial Sequence
  anti-HIV_cap256-048-137672_VR-Chain
EVQLVESGGGVARPGGSLRLSCAASGFIFTHYAMDWVRQAPGKGLEWVAVISSDGSSKNYADSVKGRFTISRDNSKNTVSLQMNSLRPEDTAVYYCAKDVGANKDDEWATDYYDLSIAYPVPDPRAVVGAFDIWGQGTMVTVSS

SEQ ID NO: 2112 - protein, 144 aa, Artificial Sequence
  anti-HIV_cap256-048-137506_VR-Chain
QVRLVDSGGGVVQPGGSLRLSCAASGFTFSTYGMHWVRQAPGKGLEWVAFIRSDGSNKYYADSVQGRFSISRDNSKNTLYLQMNSLRAEDTAVYYCAKDLGESDKEEWPSDYYDFGRDFTGQDPRAVVGVFDIWGQGTTVIVSS

SEQ ID NO: 2113 - protein, 144 aa, Artificial Sequence
  anti-HIV_cap256-048-137270_VR-Chain
QVQLVESGGGVVQPGRSLRLSCAASGFTFSSYAMHWVRQAPGKGLEWVAVMSPDGSNRYYTDSVKGRFTISRDNSKNTLSLQMNSLRPEDTAVYYCAKDVGANKDDEWATDYYDLSIAYPVPDPRAVVGAFDIWGQGTMVTVSS

SEQ ID NO: 2114 - protein, 144 aa, Artificial Sequence
  anti-HIV_cap256-048-135447_VR-Chain
EVQLVESGGAVVQPGRSLRLSCTASGFSFTSYTIHWVRQAPGKGLEWVAFISYDGTEKKYTDSVKGRFTISRDNSKNTLSLQMNSLRPEDTAVYYCAKDLGASKDDEWATDYYDFSIAYPVQDPRAVVGAFDIWGQGTMVTVSS

SEQ ID NO: 2115 - protein, 144 aa, Artificial Sequence
  anti-HIV_cap256-048-131966_VR-Chain
QEQLVESGGGVVQPGRSLRLSCAASGFTFSNYAMHWVRQAPGKGLEWVAAMSHDGSDKYYADSVKGRFTISRDNSKNTLYMQMNSLRAEDTAVYYCAKDQGESEKEEWASDYYDFGRDYPGQDPRRVVATFAIWGQGTMVTVSS

SEQ ID NO: 2116 - protein, 144 aa, Artificial Sequence
  anti-HIV_cap256-048-131008_VR-Chain
EVRLVESGGGLVKPGGSLRLSCAASGFTVSSNYMSWVRQAPGKGLEWVAAISFAGTNKYYADSVKGRFTISRDNSKNALYLQMNSLRAEDTALYYCAKDLRESECEEWASDYYDFGRDYPCQDPRGVVGTLDIWGQGTMVTVSS

SEQ ID NO: 2117 - protein, 144 aa, Artificial Sequence
  anti-HIV_cap256-048-129369_VR-Chain
QVQLVESGGGVVQPGRSLRLSCAASGFTFSNYVMHWVRQAPGKGLEWVALVSFDGSNKYYADSVKGRFTISRDNSKNTVYLQMNSLRGVDTAVYYCAKDLGGGEVEEWATDYYDWSIAYPVEHPRAVVGVFDIWGQGTKVTVSS

SEQ ID NO: 2118 - protein, 144 aa, Artificial Sequence
  anti-HIV_cap256-048-128476_VR-Chain
EVQVLESGGGLVQPGGSLRLACAASGFSFSSYGMHWVRQAPGKGLEWVSFIRYDGANKYHADSVKGRFIISRDDSKNTVSLQMNSLRPEDTAVYYCAKDLGANKDDEWATDYYDLSIAYPVPDPRAVVGAFDIWGQGTMVTVSS

SEQ ID NO: 2119 - protein, 144 aa, Artificial Sequence
  anti-HIV_cap256-048-128270_VR-Chain
QVQLVESGGGVVQPGRSLRLSCTASGFTFRSYAMHWVRQAPGKGLEWVALISYDGSNKYYADSVKGRFTISRDNSKNTLYLQMNSLTSEDTAVYYCAKDLGGSKTDEWGTDYYEFWNAYPVQDPRVVVGAFDIWGHGTMVTVSS

SEQ ID NO: 2120 - protein, 144 aa, Artificial Sequence
  anti-HIV_cap256-048-126220_VR-Chain
QVQLVESGGGVVQPGRSLRLSCAASGFIFSPYGIHWVRQAPGKGLEWVALISHDGSKKYYADSVKGRFTISRDNFKDTLYLQMNSLRGVDTAVYYCAKDLGGGEVEEWATDYYDWSTAYPVEHPRAVVGVFDIWGQGTKVTVSS

SEQ ID NO: 2121 - protein, 144 aa, Artificial Sequence
  anti-HIV_cap256-048-125713_VR-Chain
EVQLVESGGGLVQPGGSLRLSCEASGFSFSTYELNWVRQAPGKGLEWVAVISYDGSNYYYADSVKGRFTISRDNSKNTLYLQMNSLRAEDTAVYYCAKDVGANKDDEWATDYYDLSIAYPVPDPRAVVGAFDIWGQGTMVTVSS

SEQ ID NO: 2122 - protein, 144 aa, Artificial Sequence
  anti-HIV_cap256-048-123934_VR-Chain
QVQLVESGGGVVQPGRSLRLSCAASGFTFSSYGMAWVRQAPGKGLEWVTAISFAGTNKYYADSVKGRFTISRDNSKDTLYLQMDGLRPEDTALYYCAKDLGERECEEWASDYYDFGRDFPGQDQRAVAGVFDMWGQGTMVTVSS

SEQ ID NO: 2123 - protein, 144 aa, Artificial Sequence
  anti-HIV_cap256-048-122673_VR-Chain
EVQVVESGGGLVKPGGSLRLSCAASGFTFSSHVMNWVRQAPGKGLEWVSSISGGSSSKDYADSVKGRFTISRDNSKNTLSLQMNSLRPEDTAVYYCAKDVGANKDDEWATDYYDLSIAYPVPDPRAVVGAFDIWGQGTMVTVSS

SEQ ID NO: 2124 - protein, 144 aa, Artificial Sequence
  anti-HIV_cap256-048-122208_VR-Chain
RVQVVESGGGVVKPGGSLRLSCGASGFTFSNAWLSWVRQAPGKGLEWVAVISSDGSSKNYADSVKGRFTISRDNSKNTVSLQMNSLRPEDTAVYYCAKDVGANKDDEWATDYYDLSIAYPVPDPRAVVGAFDIWGQGTMVTVSS

SEQ ID NO: 2125 - protein, 144 aa, Artificial Sequence
  anti-HIV_cap256-048-121552_VR-Chain
QVQLVESGGGVVQPGGSLRLSCAASGFTFSSYAMHWVRQAPGKGLKWVADISYDASSKYYADSVKGRFTISRDNSKNTLYLEMNSLRPEDTAVYYCAKDLGERECEEWASDYYDFGRDFPCQDPRGVVGTFDIWGQGTMVTVSS

SEQ ID NO: 2126 - protein, 144 aa, Artificial Sequence
  anti-HIV_cap256-048-120643_VR-Chain
QVQLVESGGGVVQPGRSLRLSCAASGFTLSAYTMHWVRQAPGKGLEWVSVISFAGNNKYYADSVKGRFTISRENSKNMLYLQMNSLRGEDTAVYYCAKDLREFECEEWASDYYDFGRDYPCQDPRGVVGTFDVWGHGSLVTVSS

SEQ ID NO: 2127 - protein, 144 aa, Artificial Sequence
  anti-HIV_cap256-048-118458_VR-Chain
QVQLVESGGGVVQPGRSLRLSCAASGFTFSTSGMHWVRQAPGKGLEWVAFISSDRSNKFYADSVKGRFSISRDNSKYTLYLQMNSLRADDTAVYFCAKDLGVNKNDEWATDYYDLSVAYPVQDPRGVAGIFDIWGQGTMVTVSS

SEQ ID NO: 2128 - protein, 144 aa, Artificial Sequence
  anti-HIV_cap256-048-118112_VR-Chain
QEQLVESGGGVVQPGRSLRLSCAASQFTFSNYGMHWVRQAPGKGLVWVAGISFAGTNKYYAASVKGRFTISRDNSKNTLYLQMNSLRAEDTALYYCAKDMREYECEEWASDYYDFGRDYPCQDPRGVVGTFDIWGQGTMVTVSS

SEQ ID NO: 2129 - protein, 144 aa, Artificial Sequence
  anti-HIV_cap256-048-116469_VR-Chain
QVQLVESGGGVVQPGRSLRLSCAASGFTFSSYAMHWVRQAPGKGLEWVAIISYDGSNKYYADSVKGRFTISRDNPKNTLYLQMNSLRAEDTGLYYCAKDMGESEKEEWASDYYDFGRDYPGQEPRAMVGTFDIWGQGTMVTVSS

SEQ ID NO: 2130 - protein, 144 aa, Artificial Sequence
  anti-HIV_cap256-048-113917_VR-Chain
EVQLVESGGGLVQPGGSLRLSCAASGLTVSDTYMNWLRQAPGKGLEWVAVVSSDGSNKNYADSVKGRFTISRDNSKNTVYLQMNSLRAEDTAVYYCAKDLGANKDDEWATDYYDLSVAYPVPDPRAVVGAFDVWGQGTMVTVSS

SEQ ID NO: 2131 - protein, 144 aa, Artificial Sequence
  anti-HIV_cap256-048-112368_VR-Chain
QVQLVESGGGVVQPGRSLRLSCAASGFTFSRNAMHWVRQAPGKGLEWVAVISYDGSNKYYADSVKGRFTISRDNSKNTLYLQMNSLRAEDTAVYYCAKDLGGGEVEEWATDYYDWSTAYPVEHPRAVVGVFDIWGQGTKVTVSS

SEQ ID NO: 2132 - protein, 144 aa, Artificial Sequence
  anti-HIV_cap256-048-112047_VR-Chain
EVQLVESGGGLVQPGGSLRLSCAASGLTVSGYYMSWVRQAPGKGLEWLAFIHFDGSKIHYAGSVKGRITVSRDNSKNTLDLQMNSLRAEDTAVYYCAKDVGDSKSDEWATDYYDLSVAYPVPDPRAVVGAFDIWGQGTMVTVSS

SEQ ID NO: 2133 - protein, 144 aa, Artificial Sequence
  anti-HIV_cap256-048-112029_VR-Chain
QVQLVESGGGVVQPGRSLRLSCAASQFTFSSYGMHWVRQAPGKGLEWVAGISFAGIKKYYADSVKGRFTISRDNSKNTLYLQMNSLRGEDTALYYCAKDLREYECEEWASDYYDFGRDYPCQDPRGVVGIFDIWGQGTMVTVSS

SEQ ID NO: 2134 - protein, 144 aa, Artificial Sequence
  anti-HIV_cap256-048-110957_VR-Chain
QVRLVESGGGVVRSGRSLRLSCAASGFTFSNFALHWVRQAPGKGLEWVAVISYDGNSKFYADSVKGRFTISTDNSKNTLYLQMNSLTAEDTAVYYCAKDLGGNKDDEWGTDYYDFSVAYPVQDPRAVSGIFDVWGHGTMVTVSS

SEQ ID NO: 2135 - protein, 144 aa, Artificial Sequence
  anti-HIV_cap256-048-110526_VR-Chain
QVQLVESGGGVVQPGRSLRLSCAASGFTFSNFGFHWVRQAPGKGLEWVAAISFAGNNKYYADSVKGRFTISRENSKNILYLQMNSLRGEDTAVYYCAKDLREFECEEWASDYYDWSTAYPVEHPRAVVGVFDIWGQGTKVTVSS

SEQ ID NO: 2136 - protein, 144 aa, Artificial Sequence
  anti-HIV_cap256-048-109336_VR-Chain
EVQLVESGGGLVQPGGSQRLSCAASGLTVNSNYMTWVRQAPGKGLEWVAIISSDGSGQYYADSVKGRFTISRDNSKNTLSLQMNSLRPEDTAVYYCAKDLGASKDDEWATDYYDFSIAYPVQDPRAVVGAFDIWGQGTMVTVSS

SEQ ID NO: 2137 - protein, 144 aa, Artificial Sequence
  anti-HIV_cap256-048-108152_VR-Chain
QAQLVESGGGVVQPGRSLVLSSVASGFSFSTYAMHWVRQAPGKGLEWVAVISYDGGNKYYADSVKGRFSISRDNSKNTVYLQINSLRAEDTAVYYCAKDLGANKDDEWATDYYDLSVAYPVPDPRAVVGAFDVWGQGTMVTVSS

SEQ ID NO: 2138 - protein, 144 aa, Artificial Sequence
  anti-HIV_cap256-048-107799_VR-Chain
EVQVVESGGGVVQPGRSLRLSCAASGFTFSNYAMDWVRQAPGKGLEWVAFVSSDGSNKNYADSVKGRFTISRDNSKNTLSLQMNSLRAEDTAVYYCAKEVGENKDDEWASDYYDLSIAYPIHDPRAVVGGFDIWGQGTMVTVSS

SEQ ID NO: 2139 - protein, 144 aa, Artificial Sequence
  anti-HIV_cap256-048-107384_VR-Chain
EVRLVESGGALVKPGTSLRLSCAASGFTFTHYAMDWVRQAPGKGLEWVAIISSDGSTKNYADSVKGRFTISRDNSKNTLSLQMNSLRPEDTAVYYCAKDVGANKDDEWATDYYDLSIAYPVPDPRAVVGAFDIWGQGTMVTVSS

SEQ ID NO: 2140 - protein, 144 aa, Artificial Sequence
  anti-HIV_cap256-048-106530_VR-Chain
EVQLLESGGGLVQPGGSLRLSCAASGFTFSSYAMDWVRQAPGKGLEWVAVISSDGSNKNYADSVKGRFTISRDNSKNTLYLQMSSLRPEDTAVYYCAKDVGDSKSDEWATDYYDFSIAYPIQDPRAVVGAFDIWGQGTMVTVSS

SEQ ID NO: 2141 - protein, 144 aa, Artificial Sequence
  anti-HIV_cap256-048-106464_VR-Chain
EVQMVQSGGGLVQPGGSLRLSCAAFGFTFTNHAMDWVRQVPGKGLEWVAFISSDGSNKNYADSVKGRFTISRDNSKNTVYLQMSSLRPEDTAVYYCAKDVGDSKSDEWATDYYDLSVAYPVPDPRAVVGAFDIWGQGTMVTVSS

SEQ ID NO: 2142 - protein, 144 aa, Artificial Sequence
  anti-HIV_cap256-048-106411_VR-Chain
QVQLVESGGGVVQPGRSLRLSCAASGFTFSYSGMHWVRQAPGKGMEWVAVISYDGSNKYYADSVKGRFTISRDNSKNTLYLQMNSLRVEDTAVYHCAKDLGGTKSDEWATDYYDLSIAYPIQDPGAVVGVFDIWGQGTMVTVSS

SEQ ID NO: 2143 - protein, 144 aa, Artificial Sequence
  anti-HIV_cap256-048-106306_VR-Chain
EVQLVESGGGLVQPGGSLRLSCEASGFTFNNYGMVWVRQAPGKGLEWVAIISYDGTEKYYVDSVKGRFTISRDNSKNTLSLQMNSLRAEDTAVYYCAKEVGENKDDEWASDYYDLSIAYPIHDPRAVVGGFDIWGQGTMVTVSS

SEQ ID NO: 2144 - protein, 144 aa, Artificial Sequence
  anti-HIV_cap256-048-104496_VR-Chain
QVQLVESGGGLVKPGGSLRLSCAASGFTFSSYGMHWVRQAPGKGLEWVAFVSSDGNNKNYADSVKGRFTISRDNSKNTVYLQMNSLRVEDTAVYYCAKDLGANKDDEWATDYYDLSVAYPVPDPRAVVGAFDVWGQGTMVTVSS

SEQ ID NO: 2145 - protein, 144 aa, Artificial Sequence
  anti-HIV_cap256-048-103074_VR-Chain
QVHLVESGAGVVQPGGSLRLSCAVSGFTFNSYGMHWVRQAPGKGLEWVAVISYDGSDKYYADSVKGRFTISRDSSKNTLYLQMNSLRVEDTAVYYCAKDLGANKDDEWATDYYDLSVAYPVPDPRAVVGAFDVWGQGTMVTVSS

SEQ ID NO: 2146 - protein, 144 aa, Artificial Sequence
  anti-HIV_cap256-048-100832_VR-Chain
QVQLVESGGGVVQPGRSLRLSCAASGFTFSSYGMHWVRQAPGKGLEWVAVVSSDGTNKNYGDSVKGRFTISRDNSRNTVYLQMSSLRPEDTAVYYCAKDVGDTKSDEWATDYYDFSIAYPVQDPRAVVGAFDIWGQGTMVTVSS

SEQ ID NO: 2147 - protein, 144 aa, Artificial Sequence
  anti-HIV_cap256-048-100188_VR-Chain
QVHLVESGGGVVQPGRSLRIYCAVSEFTFRNYAMHWVRLAPGKGLQWVAVISYNGGKKYYADSVKGRFTISRDNSKNALYLQMNSLRAEDTGLYYCAKDLREFECEEWASDYYDFGREYPCQDPRGVVGTFDIWGQGTMVTVSS

SEQ ID NO: 2148 - protein, 144 aa, Artificial Sequence
  anti-HIV_cap256-048-099645_VR-Chain
QVQLVESGGGVVQPGRSLRLSCAASGFTFSRYALHWVRQAPGKGLEWVAVISYDGSSKYYADSVKGRFSISRDNSKYTLYLQMNSLRADDTAVYFCAKDLGVNKNDEWATDYYDLSVAYPVQDPRGVAGIFDIWGQGTMVTVSS

SEQ ID NO: 2149 - protein, 144 aa, Artificial Sequence
  anti-HIV_cap256-048-098137_VR-Chain
QVQLVESGGGVVQPGRSLRLSCAASGFTLRNYAMHWVRQAPGKGLEWVAVISSDGNNKYYADSVKGRFTVSRDNSKDTLYLQMNSLRPEDTALYYCAKDLGERECEEWASNYYDFGRDYPCQDPRGVVGTFDIWGQGTMVTVSS

SEQ ID NO: 2150 - protein, 144 aa, Artificial Sequence
  anti-HIV_cap256-048-097878_VR-Chain
QVQLLESGGGVVQPGKSLRLSCAASGFTFNTYGMHWVRQAPGKGLQWVAVISYDGTIQKYADSVKGRFTISRENSKNMLYLQMNSLRGEDTAVYYCAKDLREFECEEWASDYYDFGRDYPCQDPRGVVGTFDVWGHGSLVTVSS

SEQ ID NO: 2151 - protein, 144 aa, Artificial Sequence
  anti-HIV_cap256-048-097510_VR-Chain
QVQLVESGGGVVQPGRSLWLSCAASEFTLRSYGMHWVRQAPGKGLEWVAFVAFDESDKYYADSVKGRFTISRDNSKNTLSLQMNSLRAEDTAVYYCAKEVGDNKDDEWASDYYDLSIAYPVHDPRAVVGGFDIWGQGTMVTVSS

SEQ ID NO: 2152 - protein, 144 aa, Artificial Sequence
  anti-HIV_cap256-048-097313_VR-Chain
QVQLVESGGGLVQPGGALRLSCLVSGFTFDDYALHWVRQAPGKGPEWVAVLSSDGSYKYYTESVQGRFTISRDNSKNTVYLQMNSLRGVDTAVYYCAKDLGGGEVEEWATDYYDWSIAYPVEHPRAVVGVFDIWGQGTKVTVSS

SEQ ID NO: 2153 - protein, 144 aa, Artificial Sequence
  anti-HIV_cap256-048-096626_VR-Chain
EVQLVESGGGLVQPGESLRLSCAGSGFTFSSYWMSWVRQAPGKGLEWMALISYDGSNKYYVDSVKGRFTISRDNSKNTLYLQMNSLRAEDTAVYYCAKDLGGNKDDEWATDYYDLSIAYPVQDPRVVVGIFDIWGQGTMVTVSS

SEQ ID NO: 2154 - protein, 144 aa, Artificial Sequence
  anti-HIV_cap256-048-096483_VR-Chain
EVQLVESGGGLVQPGRSLRLSCAASGFSFEDYAMHWVRQAPGKGLEWVAGISFAGTKKYYADSVKGRFTISRDNSKNALYLQMNSLRAEDTALYYCAKDLREYECEEWASDYYDFGRDYPCQDPRGVVGTFDIWGQGTMVTVSS

SEQ ID NO: 2155 - protein, 144 aa, Artificial Sequence
  anti-HIV_cap256-048-095691_VR-Chain
QVQLVESGGGVVQPGRSLRLSCAASGFTFSSYGMAWVRQAPGKGLEWVTAISFAGTNKYYADSVKGRFTISRDNSKDTLYLQMDGLRPEDTALYYCAKDLGERECEEWASNYYDFGRDYPCQDPRGVVGTFDIWGQGTMVTVSS

SEQ ID NO: 2156 - protein, 144 aa, Artificial Sequence
  anti-HIV_cap256-048-095525_VR-Chain
QVQLVQSGGSVVQPGKSLRLSCAASGFTFSSFGMHWVRQTPGKGLEWVAVISYDGSEKSYADSVKGRFTISRDNSKNTLYLQMNSLRAEDTAVYYCAKDLGGTKDDEWATDYYDISIAYPVQDPRAVAGAFDIWGQGTMVTVSS

SEQ ID NO: 2157 - protein, 144 aa, Artificial Sequence
  anti-HIV_cap256-048-094783_VR-Chain
EVQLVESGGGLVKPGGSLRLSCAASGITFSTYEMNWVRQAPGKGMEWVAVISYDGSNKYYADSVKGRFTISRDNSKNTVYLQMNSLRGVDTAVYYCAKDLGGGEVEEWATDYYDWSIAYPVEHPRAVVGVFDIWGQGTKVTVSS

SEQ ID NO: 2158 - protein, 144 aa, Artificial Sequence
  anti-HIV_cap256-048-094356_VR-Chain
QVQLVESGGGVVQPGRSLRLSCAASGFIFTHYAMDWVRQAPGKGLEWVAVISSDGSSKNYADSVKGRFTISRDNSKNTVSLQMNSLRPEDTAVYYCAKDVGDNKSDEWATDYYDFSIAYPVPDPRAVVGAFDLWGQGTMVTVSS

SEQ ID NO: 2159 - protein, 144 aa, Artificial Sequence
  anti-HIV_cap256-048-090756_VR-Chain
QVQLVESGGGVVRPGRSLRLSCAVSGFTFSNYAIHWVRQAPGKGLEWVAVISYDGSDKYYADSVKGRFTISRENSKNMLYLQMNSLRGEDTAVYYCAKDLREFECEEWASDYYDFGRDYPCQDPRGVVGTFDVWGHGSLVTVSS

SEQ ID NO: 2160 - protein, 144 aa, Artificial Sequence
  anti-HIV_cap256-048-089065_VR-Chain
QVQLVESGGGVVQPGRSLRLSCAASGFTFSTYAMHWVRQAPGKGLEWVALISYDGTNKYYVDSVKGRFTISRDNSKNTLYLQMNSLTAEDTAVYYCAKDLGGNKDDEWGTDYYDFSVAYPVQDPRAVSGIFDVWGHGTMVTVSS

SEQ ID NO: 2161 - protein, 144 aa, Artificial Sequence
  anti-HIV_cap256-048-084986_VR-Chain
QVQLVESGGGVVQPGRSLRLSCAASGFTFSDYAMHWVRQAPGKGLEWVALISYDGSNKYYADSVKGRFTISRDNSKNTLYLQMSSLTAEDTAVYYCAKDLGGNKNDEWATDYYDLSIAYPIHDPRAVLGAFDVWGQGTMLTVSS

SEQ ID NO: 2162 - protein, 144 aa, Artificial Sequence
  anti-HIV_cap256-048-083355_VR-Chain
QVQLVESGGGVVQPGRSLRLSCAVSGFIFSSYAMRWVRQAPGKGLEWVAVISYDGSKTNYADSVKGRFTISRDNSKNTLYLQMNSLTSEDTAVYYCAKDLGGSKTDEWGTDYYEFWNAYPVQDPRVVVGAFDIWGHGTMVTVSS

SEQ ID NO: 2163 - protein, 144 aa, Artificial Sequence
  anti-HIV_cap256-048-082462_VR-Chain
QVHLVESGGGVVQPGKSLRLSCTASRFIFRNYAMDWVRQAPGKGLEWVAVISYDGVKEHYAESVKGRFTISRDNSKNTVYLQMNSLRVEDTAVYYCAKDLGANKDDEWATDYYDLSVAYPVPDPRAVVGAFDVWGQGTMVTVSS

SEQ ID NO: 2164 - protein, 144 aa, Artificial Sequence
  anti-HIV_cap256-048-082246_VR-Chain
QVHLVESGGGVVQPGRSLRISCAASGFTFSKNAMHWVRQAPGKGLEWVAFVAFDESDKYYADSVKGRFTISRDNSKNILSLQMNSLRAEDTAVYYCAKEVDEYKDDEWASDYYDLSIAYPVRDPRAVVGGFDIWGQGTMVTVSA

SEQ ID NO: 2165 - protein, 144 aa, Artificial Sequence
  anti-HIV_cap256-048-080752_VR-Chain
QVQLVESGGGVVQPGGSLRLSCAASGFTFSNYGMHWVRQAPGKGLEWVAFIRYDGDITYYVDSVKGRFTISRDNSKNALYLQMNSLRAEDTALYYCAKDLREYECEEWASDYYDFGREYPCQDPRGVVGTFDIWGQGTMVTVSS

SEQ ID NO: 2166 - protein, 145 aa, Artificial Sequence
  anti-HIV_cap256-048-078409_VR-Chain
QVQLVESGGGVVQPGRSLRLSCAASGFTFNNYAMDWVRQAPGKGLEWVALISYDGSNKYYAESVKGRFTISRDNSKNTLYLQMNSLRAEDTAVYYCAKDVGEKQSMMRWATDYYDLSIAYPVPDPRAVVGAFDLWGRGTMVTVSS

SEQ ID NO: 2167 - protein, 144 aa, Artificial Sequence
  anti-HIV_cap256-048-078273_VR-Chain
EVQLVESGGGLVQPGGSLRLSCAASGFTVSSNYMSWVRQAPGKGLEWVAVISSDGSNKNYADSVKGRFTISRDNSKNTLFLQMNSLRPEDTAVYFCAKDLGANKDDEWATDYYDLSIAYPVHDPRAVVGIFDLWGQGTMVTVSS

SEQ ID NO: 2168 - protein, 144 aa, Artificial Sequence
  anti-HIV_cap256-048-078062_VR-Chain
DVYLVESGGGLVQPGGSLRLSCTASGITFSTYEMNWVRQAPGKGLEWVAFVAFDGSDKYYADSVKGRFVISRDNSKNTLSLQMNSLRAEDTAVYYCAKEVGEDKDDEWASDYYDLSIAYPVHDPRAVVGGFDIWGQGTMVTVSS

SEQ ID NO: 2169 - protein, 144 aa, Artificial Sequence
  anti-HIV_cap256-048-077798_VR-Chain
QVQLVESGGGVVQPGRSLRLSCAASGFTFSNYGMHWVRQTPGKGLEWVAVISYDGSNKFYADSVKGRFTISRDNSKNTLYLQMNSLRVEDTAVYHCAKDLGGSKSDEWATDYYDWSIAYPVHDPRAVVGVFDIWGQGTLVTVSS

SEQ ID NO: 2170 - protein, 144 aa, Artificial Sequence
  anti-HIV_cap256-048-073853_VR-Chain
EVQLVESGGGLVKPGGSLRLSCAASGFTFSDAWMNWVRQAPGKGLEWVAGISFAGTNKYYADSVKGRFTISRDNSKNTLYLQMNSLRAEDTALYYCAKDMREYECEEWASDYYDFGRDYPCQDPRGVVGTFDIWGQGTMVTVSS

SEQ ID NO: 2171 - protein, 145 aa, Artificial Sequence
  anti-HIV_cap256-048-071661_VR-Chain
QVQLVESGGGVVQPGRSLGLSCEVSGFTFSDYFMSWIRQAPGKGLEWVAVISHDGNNKYYPDSVQGRFTISRENSKNTLYLQMNSLKPEDTAVYFCAKDLGGESEVEEWASDYYDFGRDIPGPDPRGVVGTLDIWGHGTMVTVSS

SEQ ID NO: 2172 - protein, 144 aa, Artificial Sequence
  anti-HIV_cap256-048-071360_VR-Chain
QVQLVESGGGVVQPGRSLRLSCAASGFTLTNYAMDWVRQAPGKGLEWVAVISSDGSNKNYEDSVKGRFTISRDNSKNTLYLQMSSLRPEDTAVYYCAKDVGDNKSDEWATDYYDFSIAYPVPDPRAVVGAFDLWGQGTMVTVSS

SEQ ID NO: 2173 - protein, 144 aa, Artificial Sequence
  anti-HIV_cap256-048-070955_VR-Chain
EVQLVESGGGLVQPGGSVRLSCAVSGFTFSSYWMSWVRQAPGKGLEWVAVISDSGSNKYYADSVKGRFTISRDNSKNTLYLQMNSLRAEDTAVYFCAKDLGGRETEEWASDYYDFGRDFPGQDQRAVAGVFDMWGQGTMVTVSS

SEQ ID NO: 2174 - protein, 144 aa, Artificial Sequence
  anti-HIV_cap256-048-070061_VR-Chain
EVQLLESGGGLVQPGGSLRLSCAASGFTFSSYAMHWVRQAPGKGLEWVAVTSYDGSNKYYADSVKGRFTISRDNSKNTLYMQMNSLRAEDTAVYYCAKDQGESEKEEWASDYYDFGRDYPGRDPRRVVATFAIWGQGTMVTVSS

SEQ ID NO: 2175 - protein, 144 aa, Artificial Sequence
  anti-HIV_cap256-048-069669_VR-Chain
QVQLVESGGGVVQPGRSLRLSCAVSGFTFSKFPMHWVRQAPGKGLEWVAVISYDGNKKYYVDSAKGRFTISRDNSRKTLYLQMTGLRPEDTAVYYCAKDLGGGECETWASDYYDFGKDYPCLDPRDVVGTFDIWGQGTLVTVSS

SEQ ID NO: 2176 - protein, 144 aa, Artificial Sequence
  anti-HIV_cap256-048-069205_VR-Chain
QVQLVESGGGVVQPGRSLRLSCAASGFTFSSYAMHWVRQAPGKGLEWVVVISNDGNNKYYADSVKGRFTISRDNSKNTVYLQMNSLRAEDTAVYYCAKDVGDTKKDEWATDYYDLSIAYPVQDPQAVVGAFDIWGQGTMVTVSS

SEQ ID NO: 2177 - protein, 144 aa, Artificial Sequence
  anti-HIV_cap256-048-068882_VR-Chain
QVQLVESGGGVVQPGRSLRLSCAASGFTFSTYAMHWVRQAPGKGLEWVALISYDGTDKYYADSVKGRFTISRDNSKNTVYLQMNSLRGVDTAVYYCAKDLGGGEVEEWATDYYDWSTAYPVEHPRAVVGVFDIWGQGTKVTVSS

SEQ ID NO: 2178 - protein, 144 aa, Artificial Sequence
  anti-HIV_cap256-048-067764_VR-Chain
EVQLVQSGGGLVKPGGSLRLSCAASGFTFSTYSMNWVRQAPGKGLEWVAVISSDGSSKNYADSVKGRFTISRDNSKNTVSLQMNSLRPEDTAVYYCAKDVGANKDDEWATDYYDLSIAYPVPDPRAVVGAFDIWGQGTMVTVSS

SEQ ID NO: 2179 - protein, 144 aa, Artificial Sequence
  anti-HIV_cap256-048-066845_VR-Chain
QVLLVESGGGVVQPGGSLTLSCAASGFTFSNYGMHWVRQAPGKGLEWVAFIRYDGNNKYYADSVKGRFTISRDNSKDTLYLQMDGLRPEDTALYYCAKDLGERECEEWASNYYDFGRDYPCQDPRGVVGTFDIWGQGTMVTVSS

SEQ ID NO: 2180 - protein, 144 aa, Artificial Sequence
  anti-HIV_cap256-048-065226_VR-Chain
EVQLVESGGGLVKPGGSLRLSCVASGFTFSNYGMHWVRQAPGKGLVWVAGISFAGTNKYYAASVKGRFTISRDNSKNTLYLQMNSLRAEDTALYYCAKDMREYECEEWASDYYDFGRDYPCQDPRGVVGTFDIWGQGTMVTVSS

SEQ ID NO: 2181 - protein, 144 aa, Artificial Sequence
  anti-HIV_cap256-048-063717_VR-Chain
QVQLVESGGGVVQPGRSLRLSCAASGFSFSNHAMDWVRQAPGKGLEWVAVISSDGSDKIYAESVKGRFTISRDNSKNTLYLQMNSLRVEDTAVYFCAKDLGANKDDEWATDYYDLSIAYPVPDPRAVVGAFDIWGQGTMVSVSS

SEQ ID NO: 2182 - protein, 144 aa, Artificial Sequence
  anti-HIV_cap256-048-063150_VR-Chain
EVQLVESGGGVVQPGRSLRLSCAASGFTFSSYAMHWVRQAPGKGLEWVAHIRYDGSNKYYIDSVQGRFTISRDNPKNTLYLQMNSLRTEDTAVYYCAKDLGGGEVEEWATDYYDWSIAYPVEHPRAVVGVFDIWGQGTKVTVSS

SEQ ID NO: 2183 - protein, 144 aa, Artificial Sequence
  anti-HIV_cap256-048-062431_VR-Chain
QVQLVESGGGVVQPGRSLRLSCAASGFTFSNFAMDWVRQAPGKGLEWVAVISSDGSKKNYGDSVKGRFTISRDNSKNTLFLQMNSLRPEDTALYYCAKDLGGYKSDEWATDYYDLSIAYPVQDPRPWLELLYIWGQGAMVTVSS

SEQ ID NO: 2184 - protein, 144 aa, Artificial Sequence
  anti-HIV_cap256-048-060745_VR-Chain
QVQLVESGGSVVQPGRSLRLTCTASGFTFSHYAMDWVRQAPGKGLEWVAVISSDATNKNYADSVKGRFTISRDNSKNTVYLQMDSLRAEDTAVYYCAKDVGDYKDDEWATDYYDFSIAYPVPDPRAVVGAFDFWGQGTMVTVSS

SEQ ID NO: 2185 - protein, 144 aa, Artificial Sequence
  anti-HIV_cap256-048-060420_VR-Chain
QVQLVESGGGVVQPGRSLRLSCAASGFTFSSYGMAWVRQAPGKGLEWVTVISFAGVKKYYADSVKGRFTISRDNSKGTLYLQMNSLRAEDTAVYYCAKDVGDTKKDEWATDYYDLSIAYPVQDPQAVVGAFDIWGQGTMVTVSS

SEQ ID NO: 2186 - protein, 145 aa, Artificial Sequence
  anti-HIV_cap256-048-060014_VR-Chain
QVQLVESGGGVVQPGRSLRLSCAASGFTFSNYGMHWVRQAPGKGLEWVALISHDGSNKNFADSVKGRFTISRDNSKNTLYLQMNSLRTEDTAIYYCAKDLGGESEIEEWPSDYYDFGRDYPVPDPRGVVGTFDFWGQGTMVTVSS

SEQ ID NO: 2187 - protein, 144 aa, Artificial Sequence
  anti-HIV_cap256-048-059747_VR-Chain
QVQLVESGGGVVQPGRSLRLSCAASGFTFTHYAMDWVRQAPGKGLEWVAVISSDGSSKDYADSVKGRFTISRDNSKNTLSLQMNSLRPEDTAVYYCAKDLGASKDDEWATDYYDLSIAYPVHDPRAVVGGFDIWGQGTMVTVSS

SEQ ID NO: 2188 - protein, 144 aa, Artificial Sequence
  anti-HIV_cap256-048-058393_VR-Chain
QVQLVESGGGVVQPGGSLRLSCAASGFTFNTYGMHWVRQAPGKGLEWVTFIRYDGSNEYYADSVKGRFTISRDNSKNTLYLQMNSLSVEDTAVYYCAKDLGKNKDDEWATDYYDISIAYPVPDPRAVVGVFDIWGQGTVVTVSS

SEQ ID NO: 2189 - protein, 144 aa, Artificial Sequence
  anti-HIV_cap256-048-058159_VR-Chain
QVQLVESGGGVVQPGRSLRLSCAASGFTFSSYPMHWVRQAPGKGLEWVAVISFAGTNKYYAHSVKGRFTISRDNSKNTLYLQMNSLRAEDTALYYCARDLRESECEEWASDYYDFGREYPCQDPRGVVGTFDIWGRGTMVTVSS

SEQ ID NO: 2190 - protein, 144 aa, Artificial Sequence
  anti-HIV_cap256-048-057127_VR-Chain
DVYLVESGGGLVQPGGSLRLSCVASGITFSSYGMHWVRQAPGKGLEWAAFIRYDGRNKYYADSVKGRFTISRDNSKNTLSLQMNNLRAEDTAVYYCAKEVGDNKDDEWASDYYDLSIAYPVQDPRAVVGGYDIWGQGTMVTVSS

SEQ ID NO: 2191 - protein, 144 aa, Artificial Sequence
  anti-HIV_cap256-048-056251_VR-Chain
EVQLVESGGGLVQPGRSLRLSCAGSGFTFSNFGFHWVRQAPGKGLEWVAAISFAGYNKYYADSVKGRFTISRENSNNMLYLQMSSLRAEDTAVYYCAKDLRESECEEWASDYYDFGKDYPCQDPRGVVGTFDVWGHGSLVTVSS

SEQ ID NO: 2192 - protein, 144 aa, Artificial Sequence
  anti-HIV_cap256-048-055421_VR-Chain
QVQLVESGGGVVQPARSLRLSCAASGFIFSTYGMHWVRQAPGKGLEWVAVISSDGSSKDYADSVKGRFTISRDNSKNTLSLQMNSLRPEDTAVYYCAKDLGASKDDEWATDYYDFSIAYPVQDPRAVVGAFDIWGQGTMVTVSS

SEQ ID NO: 2193 - protein, 144 aa, Artificial Sequence
  anti-HIV_cap256-048-054989_VR-Chain
QVQLVESGGGVVQPGGSLRLSCAASGFTFSTNGMHWVRQAPGKGLEWVAFIRYDGSNKYYADSVKGRFTISRDNSKNTVYLQMNSLRGVDTAVYYCAKDLGGGEVEEWATDYYDWSIAYPVEHPRAVVGVFDIWGQGTKVTVSS

SEQ ID NO: 2194 - protein, 145 aa, Artificial Sequence
  anti-HIV_cap256-048-054759_VR-Chain
QVQLVESGGGVVQPGRSLRLSCAASGFSFSKNGMHWVRQAPGKGLEWVAFVAFDESDKYYADSVKGRFTISRDNSKNTLSLQMNSLRVEDTAVYYCAKEVGENKDDEWAAPDYYDFSIAYPVQDPRAVVGGFDIWGQGTMVTVSS

SEQ ID NO: 2195 - protein, 144 aa, Artificial Sequence
  anti-HIV_cap256-048-052573_VR-Chain
QVKLVESGGGVVQPGRSLRLSCAASGFSFSNYAMDWVRQAPGKGLEWVAVVSSDGSNKNYADSVKGRFTISRDNSKNTVYLQMNSLRAEDTAVYYCAKDLGANKDDEWATDYYDWSIAYPVHDPRAVVGVFDIWGQGTLVTVSS

SEQ ID NO: 2196 - protein, 144 aa, Artificial Sequence
  anti-HIV_cap256-048-051477_VR-Chain
QEQLVESGGGVVQPGRSLRLSCAASGFTFSNYAMHWVRQAPGKGLEWVAAMSHDGSDKYYADSVKGRFTISRDNSKNTLYMQMNSLRAEDTAVYYCAKDQGESEKEEWASDYYDLSIAYPIQDPRAMVGAFDIWGQGTMVTVSS

SEQ ID NO: 2197 - protein, 144 aa, Artificial Sequence
  anti-HIV_cap256-048-051299_VR-Chain
QVQLVESGGGVVQPGRSLRLSCAASGFTFSTFGMHWVRQAPGKGLEWVALISHDGNNKYYADSLKGRFTISRENSKNTLFLQMNSLRAEDTSVYYCAKDLGDSECEEWASDYYDFGKDYPCLHPRGVVGTFDFWGHGTMVTVSS

SEQ ID NO: 2198 - protein, 144 aa, Artificial Sequence
  anti-HIV_cap256-048-050815_VR-Chain
QVQLVESGGGVVQPGGSLRLSCVVSGFTFSSYGMHWVRQAPGKGLEWVSFIRFDGNYEYYVDSVKGRFTISRDNSKNTVYLQMDSLRAEDTAVYYCAKDVGDYKDDEWATDYYDFSIAYPVPDPRAVVGAFDFWGQGTMVTVSS

SEQ ID NO: 2199 - protein, 144 aa, Artificial Sequence
  anti-HIV_cap256-048-049884_VR-Chain
QVQLVESGGGVVQPGRSLRLSCAASGFSFNTYAMHWVRQAPGKGLEWMALISYDGSNKYYVDSVKGRFTISRDNSKNTLYLQMNSLRAEDTAVYYCAKDLGGNKDDEWATDYYDLSIAYPVQDPRVVVGIFDIWGQGTMVTVSS

SEQ ID NO: 2200 - protein, 144 aa, Artificial Sequence
  anti-HIV_cap256-048-049170_VR-Chain
QVQLVESGGGVVQPGRSLRLSCAASGFIFSSYGMHWVRQAPGKGLEWVAVISGDGTKKDFADSVKGRFTISKDNSKNMVSLQMNSLRAEDAAVYYCAKDLGESDNEEWPSDYYDFGRDFTGQNPRAVVGTFDLWGQGTMVTVSS

SEQ ID NO: 2201 - protein, 145 aa, Artificial Sequence
  anti-HIV_cap256-048-048531_VR-Chain
QVQLVESGGGVVQPGRSLRLSCAASGFTFSSYGLHWVRQAPGKGLEWVAFISYDGNNKHYVDSVKGRFTISRDNSKNTLYLQMNSLRAEDTAVYYCAKDLGGESEIEEWATDYYDFSIAYPVKESRGVVGIFDMWGQGTMVTVSS

SEQ ID NO: 2202 - protein, 144 aa, Artificial Sequence
  anti-HIV_cap256-048-048259_VR-Chain
QVQLVESGGGVVQPGRSLRLSCAASGFTFSTCAMHWVRQAPGKGLEWVAVISYDGSNKYYVDSVKGRFTISRDNSKNTLYLQMNSLRAEDTAVYYCAKEVDINKEDEWASDYYDFSIAYPVQDPRAVVGGFDIWGQGTMVTVSS

SEQ ID NO: 2203 - protein, 144 aa, Artificial Sequence
  anti-HIV_cap256-048-047313_VR-Chain
QVQLVESGGGVVQPGRSLRLSCAASGFTFSTFGMHWVRQAPGKGLEWVAVISHDGNNKYYADSVKGRFTISRDNSKNTVYLQMNSLRAEDTAVYYCAKDLGANKDDEWATDYYDLSVAYPVPDPRAVVGAFDVWGQGTMVTVSS

SEQ ID NO: 2204 - protein, 144 aa, Artificial Sequence
  anti-HIV_cap256-048-046596_VR-Chain
QVQLVESGGGVVQPGGSLRLSCAASGFTFSSYGMHWVRQAPGKGLEWVAFMRFDGSNRYYGDSVKGRFTISRDNSKNTLYLQMNSLRTEDAALYYCAKDMREFECEEWASDYYDFGRDYPCQDPRGVVGIFDIWGQGTMVTVSS

SEQ ID NO: 2205 - protein, 144 aa, Artificial Sequence
  anti-HIV_cap256-048-044781_VR-Chain
QVQLVESGGGVVQPGRSLRLSCAASGFTFTSYAIHWVRQAPGKGLEWVAVISYDGSKKNYADSVKGRFTISRDNSKNTLYVQMNSLRAEDTAVYYCAKEVGEDKDDEWASDYYDLSIAYPVHDPRAVVGGFDIWGQGTMVTVSS

SEQ ID NO: 2206 - protein, 144 aa, Artificial Sequence
  anti-HIV_cap256-048-042599_VR-Chain
QVQLVESGGGVVQPGRSLRLSCAASGFTFSNYGMHWVRQTPGKGLEWVAVISYDGSNKFYADSVKGRFTISRDNSKNTLYLQMSSLRADDTAVYYCAKEVGEDKDDEWASDYYDLSIAYPVHDPRAVVGGFDIWGQGTMVTVSS

SEQ ID NO: 2207 - protein, 144 aa, Artificial Sequence
  anti-HIV_cap256-048-041276_VR-Chain
QVQLVESGGGVVQPGRSLRLSCAASRFTFSSYAMHWVRQAPGKGLEWVAIISYDGSNKYYADSVKGRFTISRDNSKNTLFLQMNSLRAEDTALYYCAKDLGGYKSDEWATDYYDLSIAYPIQDPRAVVGAFDIWGQGTMVTVSS

SEQ ID NO: 2208 - protein, 144 aa, Artificial Sequence
  anti-HIV_cap256-048-040200_VR-Chain
QVQLVESGGGVVQPGRSLRLSCVASGFTFSSFGMHWVRQAPGKGLEWVAVISHDGHNKYYADSLKGRFTVSRENSKNTLFLQMNSLRAEDTSVYYCAKDLGGGECEEWASDYYDFGRDYPCLTPRGVVGTFDIWGHGTTVTVSS

SEQ ID NO: 2209 - protein, 144 aa, Artificial Sequence
  anti-HIV_cap256-048-039061_VR-Chain
EVQLLGSGGGLVQPGGSLRLTCAVSGFTFSSFAMSWVRQAPGKGLEWVALISYDGTDKYYADSVKGRFTISRDNSKNTLYLQMNSLRVEDTAIYHCAKDLGGTKSDEWATDYYDLSIAYPIQDPGAVVGVFDIWGQGTMVTVSS

SEQ ID NO: 2210 - protein, 144 aa, Artificial Sequence
  anti-HIV_cap256-048-038515_VR-Chain
QVQLVESGGGVVQPGRSLRLSCAASGFTFSTYAMHWVRQAPGKGLEWVVVISYDGSNKYYADSVKGRFTISRDNSKNTLFLQMNSLRAEDTALYYCAKDVGEYKSDEWATDYYDLSIAYPIQDPRAMVGAFDIWGQGTMVTVSS

SEQ ID NO: 2211 - protein, 144 aa, Artificial Sequence
  anti-HIV_cap256-048-038255_VR-Chain
QVQLVESGGGVVQPGRSLRLSCAASGFTLSSYAMHWVRQAPGKGLEWVAVISYDGSNKYYADSVKGRFTISRDNSKNALYLQMNSLRAEDTALYYCAKDLREYECEEWASDYYDFGRDYPCQDPRGVVGTFDIWGQGTMVTVSS

SEQ ID NO: 2212 - protein, 144 aa, Artificial Sequence
  anti-HIV_cap256-048-038177_VR-Chain
QVQLVESGGGVVQPGRSLRLSCAASGFTFNTYGIHWVRQAPGKGLEWVALISYDGTDKYYADSVKGRFTISRDNSKNTLYLQMNSLRVEDTAIYHCAKDLGGTKSDEWATDYYDLSIAYPIQDPGAVVGVFDIWGQGTMVTVSS

SEQ ID NO: 2213 - protein, 144 aa, Artificial Sequence
  anti-HIV_cap256-048-035513_VR-Chain
QVQLVESGGGVVQPGRSLRLSCAASGFTFSSYGMAWVRQAPGKGLEWVTVISFAGVKKYYADSVKGRFTISRDNSKGTLYLQMDGLRPEDTALYYCAKDLGERECEEWASDYYDFGRDFPCQDPRGVVGTFDIWGQGTMVTVSS

SEQ ID NO: 2214 - protein, 144 aa, Artificial Sequence
  anti-HIV_cap256-048-034112_VR-Chain
QMQLVESGGGVVQPGRSLRLSCAASGFTFNSYAMHWVRQAPGKGLEWVAVISYDGSNKYYADSVKGRFTISRDNSKNTVYLQMNSLRGVDTAVYYCAKDLGGGEVEEWATDYYDWSIAYPVEHPRAVVGVFDIWGQGTKVTVSS

SEQ ID NO: 2215 - protein, 144 aa, Artificial Sequence
  anti-HIV_cap256-048-033983_VR-Chain
QVQLVESGGGVVQPGESLRLSCAASGFTLSSHGIHWVRQAPGKGLEWVAFISSDGSNKNYGDSVKGRFTISRDNSKNTLFLQMNSLRAEDTALYYCAKDVGEYKSDEWATDYYDLSIAYPIQDPRAMVGAFDIWGQGTMVTVSS

SEQ ID NO: 2216 - protein, 144 aa, Artificial Sequence
  anti-HIV_cap256-048-032688_VR-Chain
QVQLVESGGGVVQPGRSLRLSCAASGFIFNSYGMHWVRQAPGKGLEWVAVVHGDGGNKYYADSVKGRFTISRDNSKNTLYLEMNSLRAEDTAEYYCAKDLGESDKEEWPSDYYDFGRDFTGQVPRAVVGAFDIWGQGTMVTVSS

SEQ ID NO: 2217 - protein, 144 aa, Artificial Sequence
  anti-HIV_cap256-048-031092_VR-Chain
QVQLVESGGGVVQPGRSLRLSCAASGFSFYNFAMDWVRQAPGKGLEWVAVISSDGGNKNYVDSVKGRFTISRDNSKNTLYLQMNSLRAEDTAVYYCAKDLGGTKDDEWATDYYDISIAYPVQDPRAVAGAFDIWGQGTMVTVSS

SEQ ID NO: 2218 - protein, 145 aa, Artificial Sequence
  anti-HIV_cap256-048-030464_VR-Chain
QVQLVESGGGLVKPGGSLRLSCEASGFSFTNYYMSWIRQAPGKGLEWVAVISFNGRNKYYADFVKGRFTISRDNSKNTLSLQMNSLRVEDTAVYYCAKEVGENKDDEWAAPDYYDFSIAYPVQDPRAVVGGFDIWGQGTMVTVSS

SEQ ID NO: 2219 - protein, 144 aa, Artificial Sequence
  anti-HIV_cap256-048-030289_VR-Chain
QVQLVESGGGVVQPGGSLRLSCAASGFTFSSYGMHWVRQAPGKGLEWVAFIRYDGSNKYYADSVKGRFTISRDNSKNTVYLQMNSLRVEDTAVYYCAKDLGANKDDEWATDYYDLSVAYPVPDPRAVVGAFDVWGQGTMVTVSS

SEQ ID NO: 2220 - protein, 144 aa, Artificial Sequence
  anti-HIV_cap256-048-030261_VR-Chain
QVQLVESGGGVVQPGGSLRLSCAASGFTFSTFGMHWVRQAPGKGLEWVAVISHDGSNKYYADSLKGRFTISRENSKNTLYLQMNSLRLEDTAVYHCAKDLGGSKSDEWATDYYDLSVAYPVQDPRAVVGVFDIWGQGTMVTVSS

SEQ ID NO: 2221 - protein, 144 aa, Artificial Sequence
  anti-HIV_cap256-048-029362_VR-Chain
QVQLVESGGGVVQPGRSLRLSCAASQFTFSSYGMHWVRQAPGKGLEWVAGISFAGTNKYYADSVKGRFTISRDNSKNTLYLQMNSLRTEDAALYYCAKDMREFECEEWASDYYDFGRDYPCQDPRGVVGIFDIWGQGTMVTVSS

SEQ ID NO: 2222 - protein, 144 aa, Artificial Sequence
  anti-HIV_cap256-048-027638_VR-Chain
QVQLVESGGGVVQPGRSLRLSCVASGFIFSSYGIHWVRQAPGKGLEWVAVISGDGTNKYCADSVKGRFTISRDNSKNTVFLQMNSLRAEDTAVFYCAKDLGESDKEEWPSDYYDFGRDFTGQVPRAVVGAFDIWGQGTMVTVSS

SEQ ID NO: 2223 - protein, 144 aa, Artificial Sequence
  anti-HIV_cap256-048-027613_VR-Chain
VQQLVESGGDVVQPGTSLRLSCEASGLILSGYGLHWVRQAPGKGMEWVAVISYDGSNKYYADSVKGRFTISRDNSKNTVYLQMNSLRGVDTAVYYCAKDLGGGEVEEWATDYYDWSTAYPVEHPRAVVGVFDIWGQGTKVTVSS

SEQ ID NO: 2224 - protein, 144 aa, Artificial Sequence
  anti-HIV_cap256-048-026627_VR-Chain
QVQLLGSGGGSVQPGGSLRLTCAVSGFTFSSFAMSWVRQAPGKGLEWVAFISSDGTNKNYGDSVKGRFTISRDNSKNTLFLQMNSLRAEDTALYYCAKDLGGYKSDEWATDYYDLSIAYPIQDPRAVVGAFDIWGQGTMVTVSS

SEQ ID NO: 2225 - protein, 144 aa, Artificial Sequence
  anti-HIV_cap256-048-026239_VR-Chain
QMQLVESGGGVVQPGRSLRLSCAASGFTFNSYAMHWVRQAPGKGLEWVAVISYDGSNKYYADSVKGRFTISRDNSKNTLYLQMNSLRTEDAALYYCAKDMREFECEEWASDYYDFGRDYPCQDPRGVVGIFDIWGQGTMVTVSS

SEQ ID NO: 2226 - protein, 144 aa, Artificial Sequence
  anti-HIV_cap256-048-025518_VR-Chain
QVQLVESGGGVVQPGRSLRLSCAVSGFTFSQHAMHWVRQAPGKGLEWVTLISNDGTEKFYADSVKGRFTISRDNSKNTLYLQMNSLSVEDTAVYYCAKDLGKNKDDEWATDYYDISIAYPVPDPRAVVGVFDIWGQGTVVTVSS

SEQ ID NO: 2227 - protein, 144 aa, Artificial Sequence
  anti-HIV_cap256-048-024854_VR-Chain
QVQLVESGGGVVQPGRSLTLSCAASGFTFNNYDMHWVRQAPGKGLEWVAFTRYDGSNQYYADSVTGRFTISRDNSKNTVYLQMNSLRGVDTAVYYCAKDLGGGEVEEWATDYYDWSIAYPVEHPRAVVGVFDIWGQGTKVTVSS

SEQ ID NO: 2228 - protein, 144 aa, Artificial Sequence
  anti-HIV_cap256-048-024537_VR-Chain
QVQLVESGGAVVQPGRSLRLSCVASGFTFSSYAMHWVRQAPGKGLDWVALISYDGSNKYFADSVKGRFAISRDNSKNTLYLQMNSLRPEDTAVYYCAKDLGGGECETWASDYYDFGKDYPCLDPRDVVGTFDIWVQGTLVTVSS

SEQ ID NO: 2229 - protein, 144 aa, Artificial Sequence
  anti-HIV_cap256-048-021781_VR-Chain
QVHLVESGGGLVKPGGSLRLSCEASGFSFSNYAMDWVRQAPGKGLEWVAFVSSDGSNKNYADSVKGRFTISRDNSKNTVYLQMNSLRVEDTAVYYCAKDLGANKDDEWATDYYDLSVAYPVPDPRAVVGAFDVWGQGTMVTVSS

SEQ ID NO: 2230 - protein, 144 aa, Artificial Sequence
  anti-HIV_cap256-048-021758_VR-Chain
QVQLVESGGGVVQPGRSLRLSCAASGFTFSRYGMHWVRQAPGKGLEWVAVISYDGSKEYYADSVKGRFTISRDNSKDTLYLQMSSLRVEDTAVYYCAKDVGANKDDEWATDYYDLSIAYPVPDPRAVVGAFDIWGQGTMVTVSS

SEQ ID NO: 2231 - protein, 144 aa, Artificial Sequence
  anti-HIV_cap256-048-020988_VR-Chain
QVQLVESGGGVVQPGRSLRLSCEASAFTFSSYGMHWVRQAPGKGLEWVTFISYSGNNKYYADSVKGRFTVSRDNSKNTLYLQMNSLTSEDTAVYYCAKDLGGSKTDEWGTDYYEFWNAYPVQDPRVVVGAFDIWGHGTMVTVSS

SEQ ID NO: 2232 - protein, 145 aa, Artificial Sequence
  anti-HIV_cap256-048-020663_VR-Chain
QVQLVESGGGVVQPGMSLRLSCAASGFTFSNFGMHWVRQAPGKGLEWVAVISHDGNNKYYPDSVQGRFTISRENSKNTLYLQMNSLKPEDTAVYFCAKDLGGESEVEEWASDYYDFGRDIPGPDPRGVVGTLDIWGHGTMVTVSS

SEQ ID NO: 2233 - protein, 144 aa, Artificial Sequence
  anti-HIV_cap256-048-020590_VR-Chain
QVQLVESGGGVVQPGGVPRLACAASGFTFSSYAMHWVRQAPGKGLEWVTVISYDGSNKYYADSVKGRFTISRDNSKNTLYLQMNSLRAEDTAVYYCAKDLGGTKDDEWATDYYDISIAYPVQDPRAVAGAFDIWGQGTMVTVSS

SEQ ID NO: 2234 - protein, 144 aa, Artificial Sequence
  anti-HIV_cap256-048-019765_VR-Chain
QVQLVESGGGVVQPGRSLRLSCAASGFIFTNYAMDWVRQAPGKGLEWVAVISSDGSNKNYADSVKGRFTISRDNSKNTVSLQMNSLRAEDTAVYYCAKDLGDSKKDEWATDYYDLSIAYPVPDPRAVVGAFDIWGQGTMVTVSS

SEQ ID NO: 2235 - protein, 144 aa, Artificial Sequence
  anti-HIV_cap256-048-019254_VR-Chain
QVQLVESGGGVVQPGRSLRLSCAASGFTSSTYAMHWVRQAPGKGLEWVALISYDGTDKYYADSVKGRFTISRDNSKNTLYLQMNSLRVEDTAVYHCAKDLGGNKPDEWATDYYDLSIAYPVQDPRAVVGVFDIWGQGTIITVSS

SEQ ID NO: 2236 - protein, 144 aa, Artificial Sequence
  anti-HIV_cap256-048-018073_VR-Chain
QVQLVESGGGVVQPGRSLRLSCAASGFSLSSYAMDWVRQAPGKGLEWVAVISSDGTNKYYADSVKGRFTITRDNSKNTLYLQMNSLRVEDTALYYCAKDMGESEKEEWASDYYDFGRDIPGQDPRGEVGSFDIWGQGTMVTVSS

SEQ ID NO: 2237 - protein, 144 aa, Artificial Sequence
  anti-HIV_cap256-048-016775_VR-Chain
EVQLVEFGGGLVQPGRSLRLSCAASAFTFSHYGIHWVRQAPGKGLEWVAVISHDGSTKDYADSVKGRFTISRDNSKNTMYLQMNSLRAEDTAVYYCARDLGESETEEWATDYYDFSIAYPVQNPRGVIGVLDIWGLGTMVTVSS

SEQ ID NO: 2238 - protein, 144 aa, Artificial Sequence
  anti-HIV_cap256-048-016069_VR-Chain
QVQLVESGGGVVQPGRSLRLSCAASGFTFSKYAMHWVRQAPGKGLEWVAFVAFDESAKFYADSVKGRFTISRDNSKNTLSLQMNSLRAEDTAVYYCAKEVGENKDDEWASDYYDLSIAYPVHDPRAVVGGFDVWGQGTMVTVSS

SEQ ID NO: 2239 - protein, 144 aa, Artificial Sequence
  anti-HIV_cap256-048-015867_VR-Chain
QVQLVESGGGVVQPGRSLRLSCSASGFSFTNYAMDWVRQAPGKGLEWVAVISSDGSNKNYADSVKGRFTISRDNSKNTLFLQMNSLRPEDTAVYFCAKDLGANKDDEWATDYYDLSIAYPVHDPRAVVGIFDLWGQGTMVTVSS

SEQ ID NO: 2240 - protein, 144 aa, Artificial Sequence
  anti-HIV_cap256-048-015673_VR-Chain
QVHLVESGGGVVQPGRSLRLSCAASGFTFSNFAMGWVRQAPGKGLEWVAFISSDGTNKNYGDSVKGRFTISRDNSKNTLFLQMNSLRAEDTALYYCAKDLGGYKSDEWATDYYDLSIAYPIQDPRAVVGAFDIWGQGTMVTVSS

SEQ ID NO: 2241 - protein, 144 aa, Artificial Sequence
  anti-HIV_cap256-048-015156_VR-Chain
QVQLVESGGGVVQPGRSLRLSCAASGFTFSVYALHWVRQTPGKGLEWVALISYDGTNKYYVDSVKGRFTISRDNSKNTLYLQMNSLTAEDTAVYYCAKDLGGSKNDEWATDYYDLSIAYPIQDPRAVAGIFDVWGRGTMVTVSS

SEQ ID NO: 2242 - protein, 144 aa, Artificial Sequence
  anti-HIV_cap256-048-014521_VR-Chain
EVQLVESGGGLVQPGRSLRLSCAASGFIFSSYGIHWVRQGPGKGLEWVALISGDGNNKYYADSVQGRFSISRDNSKNTLYLQMNSLRAEDTAVYYCAKDLGESDKEEWPSDYYDFGRDFTGQDPRAVVGVFDIWGQGTTVIVSS

SEQ ID NO: 2243 - protein, 144 aa, Artificial Sequence
  anti-HIV_cap256-048-014475_VR-Chain
QVQLVESGGGVVQPGRSLRLSCAASGFTFNTFGMHWVRQAPGKGLEWVAVISHDGNNKYYADSLKGRFTISRENSKNTLFLQMNSLRAEDTSVYYCAKDLGHGECEEWASDYYDFGKDYPCLTPRGVAGTFDIWGHGTTVTVSS

SEQ ID NO: 2244 - protein, 144 aa, Artificial Sequence
  anti-HIV_cap256-048-013798_VR-Chain
QVQLVESGGGVVQPGRSLRLSCAASGFTFNNYGTHWVRQAPGKGLEWVAVISDSGSNKYYADSVKGRFTISRDNSKNTLYLQMNSLRAEDTAVYFCAKDLGGRETEEWASDYYDFGRDFPGQDQRAVAGVFDMWGQGTMVTVSS

SEQ ID NO: 2245 - protein, 144 aa, Artificial Sequence
  anti-HIV_cap256-048-013271_VR-Chain
EVQLVESGGGVVRPGGSLRLSCAASGFIFSSYGIHWVRQAPGKGLEWVAVISGDGTNKYCADSVKGRFTISRDNSKNTLYLQINSLRVEDTAVYYCAKDLGKNKDDEWATDYYDLSIAYPVPDPRAVVGVFDIWGQGTVVTVSS

SEQ ID NO: 2246 - protein, 144 aa, Artificial Sequence
  anti-HIV_cap256-048-013180_VR-Chain
QVQLVESGGGVVQPGRSLRLSCAASGFTFSKNGMHWVRQAPGKGLEWVAFVAFDGSDKYYADSVKGRFVISRDNSKNTLSLQMNSLRAEDTAVYYCAKEVGEDKDDEWASDYYDLSIAYPVHDPRAVVGGFDIWGQGTMVTVSS

SEQ ID NO: 2247 - protein, 144 aa, Artificial Sequence
  anti-HIV_cap256-048-012148_VR-Chain
QVQLVESGGGVVQPGRSLRLSCAASGFTFTHYAMDWVRQAPGKGLEWVAVISSDGSSKNYADSVRGRFTISRDNSKNTLSLLMNGLRPEDTAVYYCAKDVGDVKNDEWATDYYDLSIAYPVQDPRAVVGAFDFWGQGTMVTVSA

SEQ ID NO: 2248 - protein, 144 aa, Artificial Sequence
  anti-HIV_cap256-048-011870_VR-Chain
QVQLVESGGGVVQPGRSLRLSCAVSGFTFSFYGMHWVRQAPGKGLEWVAVISYDGNNKYYVDSVKGRFIISRDNSKNTLYLQMNSLRVEDTAVYYCARDLGERENEEWATDYYDFSIAYPIEGPRGVVGVFDIWGRGTMVTVSS

SEQ ID NO: 2249 - protein, 144 aa, Artificial Sequence
  anti-HIV_cap256-048-011530_VR-Chain
QVHLVESGGGVVQPGRSLRLSCAASGFSFRNYAMDWVRQAPGKGLEWVAVISSDGSDKHYADSVRGRFTISRDNSKNTLYLQMNSLRVEDTAVYYCAKDLGANKNDEWATDYYDFSIAYPVPDPRAVVGAFDIWGQGTMVTVSS

SEQ ID NO: 2250 - protein, 144 aa, Artificial Sequence
  anti-HIV_cap256-048-010968_VR-Chain
QVQLVESGGGVVQPGRSLRLSCAASGFIFSSYGMHWVRQAPGKGLEWVALISGDGSNKYYADSVKGRFTISRDNSKNTLYLQMNSLRAEDSALYFCAKDLGESDKEEWPSDYYDFGRDFTGQVPRAVVGIFDMWGQGTMVTVSS

SEQ ID NO: 2251 - protein, 142 aa, Artificial Sequence
  anti-HIV_cap256-048-010224_VR-Chain
EVHLVESGGDLVQPGGSLRLSCVVSEFTFSSYGMHWVRQAPGKGLEWVAFIRYDGSNKYYADSVKGRFTISRDNSKVYLEMNSLRAEDTAVYYCAKEVGENKDDEWASDYYDLSIAYPIHDPRAVVGGFDIWGQGTMVTVSS

SEQ ID NO: 2252 - protein, 144 aa, Artificial Sequence
  anti-HIV_cap256-048-009749_VR-Chain
QVQLVESGGGVVQPGRSLRLSCGASGFTFSSYAMHWVRQAPGRGLEWVAFTSSDGSNKNYGDSVKGRFTISRDNSKNTLFLQMNSLRAEDTALYYCAKDVGEYKSDEWATDYYDLSIAYPIQDPRAMVGAFDIWGQGTMVTVSS

SEQ ID NO: 2253 - protein, 144 aa, Artificial Sequence
  anti-HIV_cap256-048-009623_VR-Chain
QVQLVESGGGVVQPGRSLRLSCAASGFSFSKYGMHWVRQAPGKGLEWVAFVAFDEGDKYYVDSVKGRFTISRDNSKNTLSLQMNSLRAEDTAVYYCAKEVGENKDDEWASDYYDLSIAYPIHDPRAVVGGFDIWGQGTMVTVSS

SEQ ID NO: 2254 - protein, 144 aa, Artificial Sequence
  anti-HIV_cap256-048-008234_VR-Chain
QVQLVESGGGVVQPGRSLRLSCAASGFTFTNYAMDWVRQAPGKGLEWVAVISSDGSNKNYADSVKGRFTISRDNSKNTVYLQMSSLRPEDTAVYYCAKDVGDTKSDEWATDYYDLSIAYPVQDPRAVVGAFDIWGQGTMVTVSS

SEQ ID NO: 2255 - protein, 144 aa, Artificial Sequence
  anti-HIV_cap256-048-008149_VR-Chain
QVQLVESGGGVVQPGRSLRLSCAASGFTFSVYTMHWVRQAPGKGLEWVAVISYDGRNKYYADSVKGRFTISRDNSKNTVYLQMNSLRVEDTAVYYCAKDLGANKDDEWATDYYDLSVAYPVPDPRAVVGAFDVWGQGTMVTVSS

SEQ ID NO: 2256 - protein, 144 aa, Artificial Sequence
  anti-HIV_cap256-048-007301_VR-Chain
QVQLVESGGGVVQPGRSLRLSCAASGFSFNYYAMDWVRQAPGKGLEWVAVISSDGRNKNYADSVKGRFTISRDNSKNTLYLQMNSLSVEDTAVYYCAKDLGKNKDDEWATDYYDISIAYPVPDPRAVVGVFDIWGQGTVVTVSS

SEQ ID NO: 2257 - protein, 144 aa, Artificial Sequence
  anti-HIV_cap256-048-007174_VR-Chain
QVQLVESGGGVVQPGRSLRLSCAASGFTFNSYGMAWVRQAPGKGLEWVALISYDGSNKYYADSVRGRFTISRDNSKDTLYLQMDGLRPEDTALYYCAKDLGESECEEWASDYYDFGRDYPCLAPRGVPGTFDIWGQGTMVTVSS

SEQ ID NO: 2258 - protein, 144 aa, Artificial Sequence
  anti-HIV_cap256-048-007079_VR-Chain
QVQLAESGGGVVQPGRSLRLSCAASGFTFSIYGMHWVRQAPGKGLEWVAFILSDGTDKYSADSVKGRFTISRDNSKNTLYLQMNSLRAEDTAVYYCAKDLGKAKDDEWATDYYDFSIAYPVHDPRGVAGIFDIWGQGTMVTVSS

SEQ ID NO: 2259 - protein, 144 aa, Artificial Sequence
  anti-HIV_cap256-048-007033_VR-Chain
QVQLVESGGGVVQPGRSLRLSCAASGFTFSNFGFHWVRQAPGKGLEWVAAISFAGNNKYYADSVKGRFTISRENSKNILYLQMNSLRGEDTAVYYCAKDLREFECEEWASDYYDFGRDYPCQDPRGVVGTFDVWGHGSLVTVSS

SEQ ID NO: 2260 - protein, 144 aa, Artificial Sequence
  anti-HIV_cap256-048-006128_VR-Chain
QVQLVESGGGVVQPGRSLRLSCAASGFTFSTYAMHWVRQAPGKGLEWVALISYDGTDKYYADSVKGRFTISRDNSKNTLYLQMNSLRVEDTAVYHCAKDLGGSKSDEWATDYYDWSIAYPVHDPRAVVGVFDIWGQGTLVTVSS

SEQ ID NO: 2261 - protein, 144 aa, Artificial Sequence
  anti-HIV_cap256-048-005999_VR-Chain
QVQLVESGGGVVQPGRSLRLSCAASGFTFTHFAMDWVRQAPGKGLEWVAVISSDGSSKNYADSVKGRFTISRDNSKNTVSLQMNSLRPEDTAVYYCAKDLGANKDDEWATDYYDLSIAYPVPDPRAVVGAFDIWGQGTMVTVSS

SEQ ID NO: 2262 - protein, 144 aa, Artificial Sequence
  anti-HIV_cap256-048-005394_VR-Chain
QVQLVESGGGVVQPGRSLRLSCAASQFTFSSYGMHWVRQAPGKGLEWVAAISFAGTNKYYADSVKGRFTISRDNSKNALYLQMNSLRAEDTALYYCAKDLREFECEEWASDYYDFGRDYPCQDPRGVVGTFDIWGQGTMVTVSS

SEQ ID NO: 2263 - protein, 144 aa, Artificial Sequence
  anti-HIV_cap256-048-004226_VR-Chain
QVQLVESGGGVVQPGRSLRLSCAASGFTFNKHGMHWVRQAPGKGLEWVAFVAFDGSDKYYADSVKGRFTISRDNSKNTLSLQMNNLRAEDTAVYYCAKEVGDNKDDEWASDYYDLSIAYPVQDPRAVVGGYDIWGQGTMVTVSS

SEQ ID NO: 2264 - protein, 144 aa, Artificial Sequence
  anti-HIV_cap256-048-004097_VR-Chain
QVQLVESGGGVVQPGRSLRLSCAASGFTFSAYTVHWVRQAPGRGLEWVSVISYDDRNKYYAHSVKGRFTISRDNSKNTLYLQMNSLRREDTAVYYCAKDLGANKDDEWATDYYDLSIAYPVPDPRAVVGAFDIWGQGTMVTVSS

SEQ ID NO: 2265 - protein, 144 aa, Artificial Sequence
  anti-HIV_cap256-048-003289_VR-Chain
QVQLVESGGGVVQPGRSLRLSCAASGFTFSKYGMHWVRQAPGKGLEWVAFVAFDGSSKNYADSVKGRFTISRDNSKNTVSLQMNSLRPEDTAVYYCAKDLGANKDDEWATDYYDLSIAYPVPDPRAVVGAFDIWGQGTMVTVSS

SEQ ID NO: 2266 - protein, 144 aa, Artificial Sequence
  anti-HIV_cap256-048-002601_VR-Chain
QVQLVESGGGVVQPGRSLRLSCAASGFSFNNYAMDWVRQAPGKGLEWVAVISSDGRNKNYAESVKGRFTISRDNSKNTVYLQMNSLRAEDTAVYYCAKDVGDTKKDEWATDYYDLSIAYPVQDPQAVVGAFDIWGQGTMVTVSS

SEQ ID NO: 2267 - protein, 144 aa, Artificial Sequence
  anti-HIV_cap256-048-002129_VR-Chain
QVQLVESGGGVVQPGRSLRLSCAASGFTFSTYAMHWVRQAPGKGLEWVALISYDGTDKYYADSVKGRFIISRDNSRSTLYLQMNSLRLEDTAVYHCAKDLGGSKSDEWATDYYDLSVAYPVQDPRAVVGVFDIWGQGTMVTVSS

SEQ ID NO: 2268 - protein, 144 aa, Artificial Sequence
  anti-HIV_cap256-048-001875_VR-Chain
QVQLVESGGGVVQPGGSLRLSCATSGLTFSNYGMHWVRQAPGRGLEWVAFTRYDGTYNYYADSVKGRFTISRDNSKGTLYLQMDGLRPEDTALYYCAKDLGERECEEWASDYYDFGRDFPCQDPRGVVGTFDIWGQGTMVTVSS

SEQ ID NO: 2269 - protein, 144 aa, Artificial Sequence
  anti-HIV_cap256-048-001302_VR-Chain
QVQLVESGGGVVQPGRSLRLSCAASGFTFSYSGMHWVRQAPGKGMEWVAVISYDGSNKYYADSVKGRFTISRDNSKNTVYLQMNSLRGVDTAVYYCAKDLGGGEVEEWATDYYDWSIAYPVEHPRAVVGVFDIWGQGTKVTVSS

SEQ ID NO: 2270 - protein, 144 aa, Artificial Sequence
  anti-HIV_cap256-048-001203_VR-Chain
QVQLVESGGGVVQPGRSLRLSCAASGFTFSSYAMHWVRQAPGKGLEWVAIISYDGTIKYYADSVKGRFTISRDNSKNTVSLQMNSLRPEDTAVYYCAKDVGANKDDEWATDYYDLSIAYPVPDPRAVVGAFDIWGQGTMVTVSS

SEQ ID NO: 2271 - protein, 144 aa, Artificial Sequence
  anti-HIV_cap256-048-000383_VR-Chain
QVQLVESGGGVVQPGRSLRLSCTASGFTFNHYAMDWVRQAPGKGLEWVAVISSDGSDKTYADSVKGRFTISRDNSKNTVYLQMNSLRAEDTAVYYCAKDVGGSKDDEWATDYYDLSIAYPVPDPRAVVGAFDFWGPGTMVTVSS

SEQ ID NO: 2272 - protein, 144 aa, Artificial Sequence
  anti-HIV_cap256-038-261791_VR-Chain
QVQLVEFGGGVVQPGGSLRLSCAAFGFTISSYGMHWVRQAPGKGLQWVAFIRYDESSKFYADSVKGRFTISRDNSENTLYLQMNSLRAEDTAVYYCAKDLGESENEEWATDYYDFSIAYPGQDPRGVVGIFDIWGQGTMVTVSS

SEQ ID NO: 2273 - protein, 144 aa, Artificial Sequence
  anti-HIV_cap256-038-241540_VR-Chain
QVQLVESGGGVVQPGRSLRLSCAASGFTFSNSAMHWVRQAPGKGLEWVALISYVGGNIYYADSVKGRFTVSRDNSKKTLYLQMNSLRVEDTAVYYCVKDVGESENEEWASDYYDFGRDYPGQDTRAVVGAFDIWGQGTMVTVSS

SEQ ID NO: 2274 - protein, 144 aa, Artificial Sequence
  anti-HIV_cap256-038-235677_VR-Chain
LVQLVESGGGVVQPGGSLRLSCAASGFRFSSYGMHWVRQAPGKGLEWVAFIRYDGSFKDYADSVRGRFTISRENSKNTLYLQMNSLRTDDTAVYYCAKDLGESETEEWPSDYYDFGRDYPGQDPRGVVGTFDIWGHGTMVTVSS

SEQ ID NO: 2275 - protein, 145 aa, Artificial Sequence
  anti-HIV_cap256-038-234314_VR-Chain
EVQLLESGGGLVQPGGSLRLSCAASGFTFSRYAMSWVRQAPGKGLEWVAVISYDGSNKYYADSVKGRFTISRDNSKNTLYLQMNSLRAVDTAVYYCAKDLGEGENEEWATDYYDFSYWLPCPKYHGAWLELLYIWGQGTMVTVSS

SEQ ID NO: 2276 - protein, 144 aa, Artificial Sequence
  anti-HIV_cap256-038-234273_VR-Chain
EVQLVESGGGLIQPGGSLRLSCAASGFTVSTNFMSWVRQAPGKGLEWVAVISYDGNNKYYADSVKGRFTISRENSKNTLYLQMNSLRTDDTAVYYCAKDLGESETEEWPSDYYDFGRDYPGQDPRGVVGTFDIWGHGTMVTVSS

SEQ ID NO: 2277 - protein, 144 aa, Artificial Sequence
  anti-HIV_cap256-038-223164_VR-Chain
EVQLVESGGGLVRPGGSLRLSCAASGFSLGSYWMTWVRQAPGKGLEWVAVISYDGSNKYYADSVKGRFTISRDNSKNTLYLQMNSLRAEDTALYYCAKDLGESENEEWASDYYDFGRDYPGQDPRGVVGTFDIWGQGTMVTVSS

SEQ ID NO: 2278 - protein, 144 aa, Artificial Sequence
  anti-HIV_cap256-038-220289_VR-Chain
EVQLVESGGGLVQPGGSLRLSCTASGFTFSSYEMNWVRQAPGKGPEWVAVISYDGNNKYYADSVKGRFTISRENSKNTLYLQMNSLRTDDTAVYYCAKDLGESETEEWPSDYYDFGRDYPGQDPRGVVGTFDIWGHGTMVTVSS

SEQ ID NO: 2279 - protein, 144 aa, Artificial Sequence
  anti-HIV_cap256-038-220020_VR-Chain
QVQLVESGGGVVQPGRSLRLSCAASGFTFSRNAMHWVRQAPGKGLEWVALISYDGSNKYYVDSVKGRFTISRDNSKNTLYLQMNSLRADDTAVYYCAKDLGESETEEWGTDYYDFSTGYPVQDPRGVVGAFDIWGQGTMVSVSS

SEQ ID NO: 2280 - protein, 144 aa, Artificial Sequence
  anti-HIV_cap256-038-216853_VR-Chain
QVQLVESGGGVVQPGRSLRLSCAASGFTFSSYAMHWVRQAPGKGLEWVAVISYDGSNKYYADSVKGRFTISRDNSKNTLYVQMNSLRAEDTAVYYCARDLGESETEEWPSDYYDFGRDYPGQDPRGVVGTFDIWGHGTMVTVSS

SEQ ID NO: 2281 - protein, 144 aa, Artificial Sequence
  anti-HIV_cap256-038-213466_VR-Chain
EVQLVESGGGLVQPGRSLRVSCAASGFTFEDYAMHWVRQAPGKGLEWVAVISDDGNNKYYADSVKGRFTISRDNSKNTLYLQMNSLRVEDTAVYYCVKDVGESENEEWASDYYDFGRDYPGQDTRAVVGAFDIWGQGTMVTVSS

SEQ ID NO: 2282 - protein, 144 aa, Artificial Sequence
  anti-HIV_cap256-038-213212_VR-Chain
QVQLVESGGGVVQPGGSLRLSCAASGFIFSDYGMHWVRQAPGKGLEWVASIWHDGSKKYYADSVKGRFTISRENSKNTLYLQMNSLRAEDTAVYHCAKDLGESEIEEWTSDYYDFGRDYPGQDPRGVFGTFDIWGHGTMVTVSS

SEQ ID NO: 2283 - protein, 144 aa, Artificial Sequence
  anti-HIV_cap256-038-213120_VR-Chain
QVHLVESGGGLVKPGGSLRLSCAASGFTFSDYYMIWIRQAPGKGLEWVAVISSDGSNKNYADSVKGRFTISRDNSKNTLYLQMNSLRAEDTAVYYCAKDLGESENEEWATDYYDFATGYPVQDPRAVVGAFDIWGQGTMVTVSP

SEQ ID NO: 2284 - protein, 144 aa, Artificial Sequence
  anti-HIV_cap256-038-212592_VR-Chain
LVQLVESGGGVVQPGKSLRLSCAASGFTFSSYAMHWIRQAPGKGLEWVAVISDDGSIKNYADSVKGRFTISRDTSKKLMYLQMNSLSANDTAVYYCAKDLGERENEEWASDYYDFGRDYPGQDPRGVVGSIDTWGHGTMVTVSS

SEQ ID NO: 2285 - protein, 144 aa, Artificial Sequence
  anti-HIV_cap256-038-211790_VR-Chain
ELQLVESGGGLVQPGGSLRLSCVVSGFTVSTNYISWVRQAPGKGLEWVAVISYDGSNKYYADSVKGRFTISRDNSKNTLYLQMNSLRAEDTALYYCAKDLGESENEEWASDYYDFGRDYPGQDPRGVVGTFDIWGQGTMVTVSS

SEQ ID NO: 2286 - protein, 144 aa, Artificial Sequence
  anti-HIV_cap256-038-209916_VR-Chain
QVQLVESGGGVVQPGGSLRLSCAASGFTFSSFGMHWVRQAPGKGLEWVSFIRNDGGIRYSADSVRGRFTISRDNSKNTLYLQMNSLRTDDTAVYYCAKDLGESETEEWPSDYYDFGRDYPGQDPRGVVGTFDIWGHGTMVTVSS

SEQ ID NO: 2287 - protein, 144 aa, Artificial Sequence
  anti-HIV_cap256-038-207938_VR-Chain
QVQLVESGGGVVHPGRSLRLSCAASGFTFSSYGMHWVRQAPGKGLEWVAVISHDGSNKYYADSVKGRFTISRDNSKNTLYLQMNSLRAEDTAVYYCAKDLGESENEEWASDYYDFGRDYPGQDPRGVVGVFDIWGQGTMVTVSS

SEQ ID NO: 2288 - protein, 144 aa, Artificial Sequence
  anti-HIV_cap256-038-202245_VR-Chain
QVHLVESGGGVVQPGRSLRLSCTVSGFTFGSYALHWVRQAPGKGLEWLSVISYDGNNKYYADSVKGRFTISRENSKNTLYLQMNSLRAEDTAVYHCAKDLGESEKEEWASDYYDFGRDYPGQDPRGVVGTFDIWGHGTMVTVSS

SEQ ID NO: 2289 - protein, 144 aa, Artificial Sequence
  anti-HIV_cap256-038-197721_VR-Chain
QVQLVESGGGVVQPGKSLRLSCAGSGFIFSNYPMHWVRQAPGKGLEWMADVSYDGSNKDYADSVKGRFTISRDNSKNTLYLQMNSLRAEDTAVYYCVKDVGESENEEWASDYYDFGRDYPGQDTRAVVGAFDIWGQGTMVTVSS

SEQ ID NO: 2290 - protein, 144 aa, Artificial Sequence
  anti-HIV_cap256-038-196679_VR-Chain
EVQLLESGGGLVQPGGSLRLSCAASGFTFSSYAMSWVRQAPGKGLEWVAVISYDGGNKYYADSVKGRFTISRDNSKNTLYLQMNSLRAEDTALYYCAKDLGESENEEWASDYYDFGRDYPGQDSRGVVGTFDVWGQGTMVTVSS

SEQ ID NO: 2291 - protein, 146 aa, Artificial Sequence
  anti-HIV_cap256-038-196118_VR-Chain
QVQLVESGGGVVQPGGSLRLSCAASGFTFSTYGMHWVRQAPGKGLEWVTFIRNDGTNKYYADSVKGRFTISRDNTKNTLYLQMYSLRAEDTAVYYCAKDLGESENEDEEWASDYYDFGRDYPGQDSRGVVGTFDMWGQGTMVTVSS

SEQ ID NO: 2292 - protein, 143 aa, Artificial Sequence
  anti-HIV_cap256-038-195382_VR-Chain
QVHLVESGGGVVQPGRSLRLSCAASGFTFSNYPVHWVRQAPGKGLEWVAVISFDGINNYAGSVKGRFIISRDNSKNTLYLQMNSLRAEDTAVYYCVKDLGESEKEEWPSDYYDFGRDYPGQDSRGVVGVFDIWGQGTMVTVSS

SEQ ID NO: 2293 - protein, 144 aa, Artificial Sequence
  anti-HIV_cap256-038-180001_VR-Chain
EVQLVESGGGLVQPGRSLRLSCTASGFTFGDYAMSWFRQAPGKGLEWVADISYDGSNKYYADSVKGRLTISRDNSKNTLYLQMNSLRAEDTAVYYCVKDLGESEKEEWPSDYYDFGRDYPGQDSRGVVGVFDIWGQGTMVTVSS

SEQ ID NO: 2294 - protein, 144 aa, Artificial Sequence
  anti-HIV_cap256-038-178021_VR-Chain
QVKLVESGGGVVQPGGSLRLSCAAAGFIFSNSGMHWVRQAPDKGLEWVAFVPYDGSNKYYADSVKGRFTISRDNSKNTLSLQMNSLRTEDTAVYYCAKDLGESETEEWPSDYYDFGRDYPGQDPRGVVGTFDIWGHGTMVTVSS

SEQ ID NO: 2295 - protein, 144 aa, Artificial Sequence
  anti-HIV_cap256-038-177104_VR-Chain
EVQLLESGGGLVQPGGSLRLSCAASGFTFSSYAMNWVRQAPGKGLEWVAVISYDGGDKYYADSVKGRFTISRDNSKNTLYLQMNSLRVEDTAVYYCVKDVGESENEEWASDYYDFGRDYPGQDTRAVVGAFDIWGQGTMVTVSS

SEQ ID NO: 2296 - protein, 144 aa, Artificial Sequence
  anti-HIV_cap256-038-171261_VR-Chain
QVQLVESGGGVVQPGRSLRLSCAASGFTFSSYAMYWVRQAPGKGLEWVAVISSDGSDKNYADSVKGRFTISRDNSNNTLYLQMNSLRAEDTAVYYCARDLGESENEEWPSDYYDFGRDYPGQDPRGVIGTFDVWGQGTMVTVSS

SEQ ID NO: 2297 - protein, 144 aa, Artificial Sequence
  anti-HIV_cap256-038-169090_VR-Chain
QVQLVESGGGVVQPGRSLRLSCAASRFTFKTYTMHWVRQAPGKGLEWVALISYDGSNKYYADSVKGRLTISRDNSKNTLYLQMNSLRAEDTAVYYCVKDLGESEKEEWPSDYYDFGRDYPGQDSRGVVGVFDIWGQGTMVTVSS

SEQ ID NO: 2298 - protein, 144 aa, Artificial Sequence
  anti-HIV_cap256-038-168705_VR-Chain
EVQLVESGGGLVKPGGSLRLSCAASGFTFSSYSMNWVRRAPGKGLEWVALISYDENKKYYADSVKGRFTISRENSKNTLYLQMNSLRAEDTAVYYCAKDLGERENEEWASDYYDFGRDYPGQDPRGVVGSIDTWGHGTMVTVSS

SEQ ID NO: 2299 - protein, 144 aa, Artificial Sequence
  anti-HIV_cap256-038-167685_VR-Chain
QVQLVESGGGVVQPGRSLRLSCAASGITFSSYAIHWVRQAPGKGLEWVAVISYDGSNKYYADSVKGRFTISRDNSKNTLYLQMNSLRAEDTAVYYCAKDLGESENEEWATDYYDFSIGYPGQDPRGVVGAFDIWGQGTMVTVSL

SEQ ID NO: 2300 - protein, 144 aa, Artificial Sequence
  anti-HIV_cap256-038-158775_VR-Chain
QVQLVESGGGVVQPGGSLRLSCAASGFTFSTYGMHWVRQAPGKGLEWVAFIRDNGSNKYYADSVKGRFTISRDNSKNTLYLQMNSLRAEDTALYYCAKDLGESENEEWASDYYDFGRDYPGQDSRGVVGTFDVWGQGTMVTVSS

SEQ ID NO: 2301 - protein, 144 aa, Artificial Sequence
  anti-HIV_cap256-038-157318_VR-Chain
HVQLVESGGGVVQPGRSLRLSCAASGITFSTYDMHWVRQAPGKGLEWVAVISNDGSNKYYADSVKGRFTISRDNSKNTLYLQMNSLRAEDTALYYCAKDLGESEKEEWASDYYDFGRDYPGQDPRGVVATFDIWGQGTMVTVSS

SEQ ID NO: 2302 - protein, 144 aa, Artificial Sequence
  anti-HIV_cap256-038-153058_VR-Chain
QVQLVESGGGVVQPGRSLRLSCAASGFTFSTYAMHWVRQAPGKGLEWVAVISYDGSHSYYAGSVKGRFTTSRDNSKNTLNLQMNSLRPEDTALYYCAKDLGESENEEWASDYYDFGRDYPGQDSRGVVGTFDVWGQGTMVTVSS

SEQ ID NO: 2303 - protein, 144 aa, Artificial Sequence
  anti-HIV_cap256-038-150027_VR-Chain
LVQLVESGGGVVQPGGSLRLSCAASGFRFSSYGMHWVRQAPGKGLEWVAFIRYDGSFKDYADSVRGRFTISRDNSKNTVYVQMNSLRAEDTAVYYCAKDLGESENEEWATDYYDFATGYPVQDPRAVVGAFDIWGQGTMVTVSP

SEQ ID NO: 2304 - protein, 144 aa, Artificial Sequence
  anti-HIV_cap256-038-146372_VR-Chain
QVQLVESGGGVVQPGRSLRLSCAASGFTFSSFGMHWVRQSPGKGLEWVAVISYDGNNKYYADSVKGRFTISRENSKNTLYLQMNSLRTDDTAVYYCAKDLGESETEEWATDYYDFATGYPVQDPRAVVGAFDIWGQGTMVTVSP

SEQ ID NO: 2305 - protein, 144 aa, Artificial Sequence
  anti-HIV_cap256-038-141868_VR-Chain
ELRLVESGGNLVQPGGSLTLSCVASGFTFDSYGMSWVRQAPGKGLEWVALISYDENKKYYADSVKGRFTISRENSKNTLYLQMNSLRAEDTAVYYCAKDLGERENEEWASDYYDFGRDYPGQDPRGVVGSIDTWGHGTMVTVSS

SEQ ID NO: 2306 - protein, 144 aa, Artificial Sequence
  anti-HIV_cap256-038-141616_VR-Chain
EVQLLESGGGLVQPGGSLRLSCAASGFTFSSYAMSWVRQAPGKGLEWVAVISKDGSDNSYVDSVKGRFTISRDNSKNTLYLQMNSLRAEDTAVYYCARDLGESENEEWPSDYYDFGRDYPGQDPRGVIGTFDVWGQGTMVTVSS

SEQ ID NO: 2307 - protein, 144 aa, Artificial Sequence
  anti-HIV_cap256-038-127989_VR-Chain
QAQLVESGGGVVQPGRSLRLSCAASGFTFSNFAMHWVRQAPGKGLEWVAVMSDDGSNKYYADSVKGRFTISRDNSENTLYLQMNSLRAEDTAVYYCAKDLGESETEEWATDYYDFGTGYPGQDPRAMIGTFDIWGRGTMVTVSS

SEQ ID NO: 2308 - protein, 144 aa, Artificial Sequence
  anti-HIV_cap256-038-118109_VR-Chain
QVQLVESGGGVVQPGGSLRLSCTASGFTFSAYDMHWIRQAPGKGLGWVAFITNEGSSKNYVDSVKGRFTISRDNSKNTLYLQMNSLRAEDTAVYYCAKDLGESENEEWATDYYDFSIAYPGQDPRGVVGIFDIWGQGTMVTVSS

SEQ ID NO: 2309 - protein, 144 aa, Artificial Sequence
  anti-HIV_cap256-038-112226_VR-Chain
EVQLVESGGGLVQPGGSLRLSCAASGFTFSSYWMTWVRQAPGKGLEWVAVISDDGNNKYYADSVKGRFTISRDNSKNTLYLQMNSLRVEDTAVYYCVKDVGESENEEWASDYYDFGRDYPGQDTRAVVGAFDIWGQGTMVTVSS

SEQ ID NO: 2310 - protein, 144 aa, Artificial Sequence
  anti-HIV_cap256-038-105918_VR-Chain
EVQLLESGGGLVQPGGSLRLSCAASGFTFNIHPMHWVRQAPGKGLEWVAVISYDGNNKYYADSVKGRFTISRENSKNTLYLQMNSLRTDDTAVYYCAKDLGESETEEWPSDYYDFGRDYPGQDPRGVVGTFDIWGHGTMVTVSS

SEQ ID NO: 2311 - protein, 144 aa, Artificial Sequence
  anti-HIV_cap256-038-104487_VR-Chain
LVQLVESGGGVVQPGKSLRLSCAASGFTFSSYAMHWIRQAPGKGLEWVAVISDDGSIKNYADSVKGRFTISRDNSKNTLYLQMNSLRAEDTAVYYCAKDLGESENEEWATDYYGFSIGYPGQDPRGVVGIFDIWAQGTMVTVSS

SEQ ID NO: 2312 - protein, 144 aa, Artificial Sequence
  anti-HIV_cap256-038-102308_VR-Chain
QVQLVESGGGVVQPGGSLRLSCAALDFPFSSFGMHWVRQTPGRGLEWVAIIWSDGSNRYYVDSVKGRFTISRDNSKNTLYLQMNSLRPDDTAVYYCVKDLGESENEEWATDYYDFSVGYPGQGPRGVVGIFDIWGQGTMVTVSS

SEQ ID NO: 2313 - protein, 144 aa, Artificial Sequence
  anti-HIV_cap256-038-091115_VR-Chain
QVQLVESGGGVVQPGRSLRLSCAVSGFTFSSYGLHWVRQAPGKGLEWVAVISYDGSNKYYADSVKGRFTISRDNSKNTLYLQINSLRAEDTAVYYCAKDLGESENEEWATDYYDFSIGYPGQDPRAVVGAFDIWGQGTMVTVSS

SEQ ID NO: 2314 - protein, 144 aa, Artificial Sequence
  anti-HIV_cap256-038-090262_VR-Chain
QVQLVESGGGVVQAGGSLRLSCAASGFTFNNYGMHWVRQAPGKGLEWAAFIRYDGSNKYYADSVRGRFTISRDNSKNTLYLQMNSLRAEDTAVYYCVKDVGESENEEWASDYYDFGRDYPGQDTRAVVGAFDIWGQGTMVTVSS

SEQ ID NO: 2315 - protein, 144 aa, Artificial Sequence
  anti-HIV_cap256-038-083260_VR-Chain
QVQLVESGGGLVKPGGSLRLSCAASGFTFSDYYMTWIRQAPGKGLEWVAVISYDGGNKYYADSVKGRFTISRDNSKNTLYLQMNSLRAEDTALYYCAKDLGESENEEWASDYYDFGRDYPGQDSRGVVGTFDVWGQGTMVTVSS

SEQ ID NO: 2316 - protein, 144 aa, Artificial Sequence
  anti-HIV_cap256-038-080981_VR-Chain
QVQLVESGGGVVQPGRSLRLSCAASGFTFSSYGMHWVRQAPGKGMEWVAVISYDGSNKYYADSVKGRFTISRDNSKNTLYLQMNSLRAVDTAVYYCAKDLGEGENEEWATDYYDFSIGYPGQDPRGVVGAFDIWGQGTMVTVSS

SEQ ID NO: 2317 - protein, 144 aa, Artificial Sequence
  anti-HIV_cap256-038-080873_VR-Chain
LVQLVESGGGVVQPGGSLRLSCAASGFRFSSYGMHWVRQAPGKGLEWVAFIRYDGSFKDYADSVRGRFTISRDNSKNTVYLQMNSLRAEDTAVYYCVKDLGESEKEEWPSDYYDFGRDYPGQDSRGVVGVFDIWGQGTMVTVSS

SEQ ID NO: 2318 - protein, 144 aa, Artificial Sequence
  anti-HIV_cap256-038-074413_VR-Chain
QVQLVESGGGVVQPGGSLRLSCAASGFTFSTYGMHWVRQPPGKGLEWVAFIRYDGSNTYYADSVKGRFTISRDNSKNTLYLQMNSLRAEDTAVYYCAKDLGESENEEWASDYYDFGRDYPGQDPRGVVGVFDIWGQGTMVTVSS

SEQ ID NO: 2319 - protein, 144 aa, Artificial Sequence
  anti-HIV_cap256-038-073153_VR-Chain
QVQLVESGGGVVQPGRSLRLSCAASGFTFSSYGMHWVRQAPGKGLEWVALISYDGTNKYYADSVKGRFTISRDNSKNTLFLQMNSLRAEDTALYYCAKDLGESENEEWASDYYDFGRDYPGQDPRGVVGTFDIWGQGTMVTVSS

SEQ ID NO: 2320 - protein, 144 aa, Artificial Sequence
  anti-HIV_cap256-038-064227_VR-Chain
EVQVVESGGGLVQPGGSLRLSCAASGFTFSNYWMSWVRQAPGKGLEWVAVMSFSGSGSYYADSVKGRFTISSDDSMNTVYLQMNSLRAEDTAVYYCAKDLGERENEEWASDYYDFGRDYPGQDPRGVVGSIDTWGHGTMVTVSS

SEQ ID NO: 2321 - protein, 144 aa, Artificial Sequence
  anti-HIV_cap256-038-061640_VR-Chain
QVQLVESGGGVVQPGRSLRLSCTASRFSFNNYAMHWVRQAPGKGLEWVAIISKDGSDNSYVDSVKGRFTISRDNSKNTLYLQMNSLRAEDTAVYYCARDLGESENEEWPSDYYDFGRDYPGQDPRGVIGTFDVWGQGTMVTVSS

SEQ ID NO: 2322 - protein, 138 aa, Artificial Sequence
  anti-HIV_cap256-038-059482_VR-Chain
RGVQCQVQLVESGGGVVQPGFTFSSYVMHWVRQAPGKGLEWVADISYDGSNKYYADSVKGRLTISRDNSKNTLYLQMNSLRAEDTAVYYCVKDLGESEKEEWPSDYYDFATGYPVQDPRAVVGAFDIWGQGTMVTVSP

SEQ ID NO: 2323 - protein, 144 aa, Artificial Sequence
  anti-HIV_cap256-038-054000_VR-Chain
EVQLVESGGSVVRPGGSLRLSCAASGFTFDDSGMSWVRQGPGKGLEWVAVISYDGGNKYYADSVKGRFTISRDNSKNTLYLQMNSLRAEDTALYYCAKDLGESENEEWASDYYDFGRDYPGQDSRGVVGTFDVWGQGTMVTVSS

SEQ ID NO: 2324 - protein, 144 aa, Artificial Sequence
  anti-HIV_cap256-038-050554_VR-Chain
EVQLLESGGDLVQSGGSLRLSCVASGFTFSTHAMTWVRQAPGKGLEWVAVISSDGSNKNFADSVKGRFTISRDNSKNTLYLQMNSLRPEDTAVYYCAKDLGESENEEWATDYYDFSTGYPVQDPRAVVGAFDIWGQGTMVTVSS

SEQ ID NO: 2325 - protein, 144 aa, Artificial Sequence
  anti-HIV_cap256-038-044256_VR-Chain
QVQLVESGGGVVQPGRSLRLSCAASGFTFSSYAMHWVRQAPGKGLEWVAVISYDGSNKYHAGSVKGRFIISRDNSKNTLYLQMNSLRAEDTALYYCAKDLGESENEEWASDYYDFGRDYPGQDPRGVVGTFDIWGQGTMVTVSS

SEQ ID NO: 2326 - protein, 144 aa, Artificial Sequence
  anti-HIV_cap256-038-040944_VR-Chain
QVQLVESGGGVVQPGRSLRLSCAASGFTFSNYAMDWVRQAPGKGLEWVAVISYDGSNKYYADSVKGRFTISRDNSKNTLYLQMNSLRAEDTAVYYCAKDLGESENEEWATDYYDFSTGYPGQDPRAVVGAFDIWGQGTMVTVSS

SEQ ID NO: 2327 - protein, 144 aa, Artificial Sequence
  anti-HIV_cap256-038-040090_VR-Chain
QVQLVESGGGVVQPGRSLRLSCAASGFSFSNYAMDWVRQAPGKGLEWVAVISSDGSNKNYADSVKGRFTISRDNSKNTLYLQMDSLRADDTAVYYCAKDLGESENEEWATDYYDFSIGYPVQDPRGVVGIFDIWGQGTMVTVSS

SEQ ID NO: 2328 - protein, 144 aa, Artificial Sequence
  anti-HIV_cap256-038-032874_VR-Chain
QVQLVESGGGVVQPGGSLRLSCAASGFTFSSYGMHWVRQAPGKGLEWVAFIRYDGNNKYYADSVKGRFTISRENSKNTLYLQMNSLRAEDTAVYHCAKDLGESEKEEWASDYYDFGRDYPGQDPRGVVGTFDIWGHGTMVTVSS

SEQ ID NO: 2329 - protein, 144 aa, Artificial Sequence
  anti-HIV_cap256-038-025899_VR-Chain
QVQLVESGGGVVQPGRSLRLSCVASGFTFSNYAMYWVRQAPGKGLEWVTIISFDGSNQYYADSVKGRFTISRENSKNTLYLQMNSLRAEDTAVYYCAKDLGERENEEWASDYYDFGRDYPGQDPRGVVGSIDTWGHGTMVTVSS

SEQ ID NO: 2330 - protein, 144 aa, Artificial Sequence
  anti-HIV_cap256-038-024581_VR-Chain
HIQLVESGGGVVQPGGSLRLSCAASGFPFSSFGMHWVRQTPGRGLEWVAIIWSDGSHKEYTDSVKGRFTISRDNSRSTMDLQMNNLRPEDTAVYYCAKDLGERENEEWASDYYDFGRDYPGQDPRGVVGSIDTWGHGTMVTVSS

SEQ ID NO: 2331 - protein, 144 aa, Artificial Sequence
  anti-HIV_cap256-038-013345_VR-Chain
QVQLVESGGGVVQPGRSLRLSCAVSGFTFSSYGMHWVRQAPGKGLEWVAAISYDGSNKYYVDSVKGRFTISRDNSKNTLYLQMNSLRAEDTAVYYCARDLGEREIEEWATDYYDFSIGYPGQDPRGVVGVFDIWGQGTMVTVSS

SEQ ID NO: 2332 - protein, 146 aa, Artificial Sequence
  anti-HIV_cap256-038-011559_VR-Chain
QVQLVESGGGVVQPGRSLRLSCEASGFTFSSYGMDWVRQAPGKGLEWVALISHDGSNKHYADSVKGRFTISRDNSRNTLYLQMNSLRAEDTALYYCAKDLGESENEDEEWASDYYDFGRDYPGQDSRGVVGTFDMWGQGTMVTVSS

SEQ ID NO: 2333 - protein, 144 aa, Artificial Sequence
  anti-HIV_cap256-038-009634_VR-Chain
QVQLVESGGGVVQPGRSLRLSCAASGFTFTSFGMHWVRQAPGKGLEWVAVISYDGNNKYYADSVKGRFTISRENSKNTLYLQMNSLRAEDTAVYHCAKDLGESEIEEWTSDYYDFGRDYPGQDPRGVFGTFDIWGHGTMVTVSS

SEQ ID NO: 2334 - protein, 144 aa, Artificial Sequence
  anti-HIV_cap256-038-006730_VR-Chain
QVQLVESGGGVVQPGRSLRLSCAASGFTFSSFGMHWVRQAPGKGLEWVAVISKDGSDNSYVDSVKGRFTISRDNSKNTLYLQMNSLRAEDTAVYYCARDLGESENEEWPSDYYDFGRDYPGQDPRGVIGTFDVWGQGTMVTVSS

SEQ ID NO: 2335 - protein, 144 aa, Artificial Sequence
  anti-HIV_cap256-038-004887_VR-Chain
QVQLVESGGGVVQPGRSLRLSCAASGFSFSTSGMHWVRQAPGKGMEWVAVISYDGSNKYYADSVKGRFTISRDNSKNTLYLQMNSLRAVDTAVYYCAKDLGEGENEEWATDYYDFSIGYPVQNPRGLVGAFDIWGQGTMVTVSS

SEQ ID NO: 2336 - protein, 144 aa, Artificial Sequence
  anti-HIV_cap256-038-004840_VR-Chain
QVQLVESGGGVVQPGRSLRLSCAASGFTFSSFGMHWVRQSPGKGLEWVAVISYDGNNKYYADSVKGRFTISRENSKNTLYLQMNSLRTDDTAVYYCAKDLGESETEEWPSDYYDFGRDYPGQDPRGVVGTFDIWGHGTMVTVSS

SEQ ID NO: 2337 - protein, 144 aa, Artificial Sequence
  anti-HIV_cap256-038-002181_VR-Chain
EVQLVESGGGLVQPGRSLRLSCAASGFTFEDYAMHWVRQAPGKGLEWVAVISYDGSNKYYVDSVKGRFTISRDNSKNTLYLQMNSLRAEDTAVYYCAKDLGESENEEWATDYYDFSIGYPGQDPRGVVGIFDIWGQGTMVTVSS

SEQ ID NO: 2338 - protein, 144 aa, Artificial Sequence
  anti-HIV_cap256-038-001902_VR-Chain
QVQLVESGGGVVQPGRSLRLSCAASGFTFSSFGMHWVRQAPGKGLEWVAVISYDGNNKYYADSVKGRFTISRENSENTLYLQMNSLRADDTAVYYCAKDLGESENEEWASDYYDFGRDYPGQDTRGVVGTFDIWGHGTMVTVSS

SEQ ID NO: 2339 - protein, 144 aa, Artificial Sequence
  anti-HIV_cap256-038-000976_VR-Chain
QVQLVESGGGVVQPGRSLRLSCAASGFTFSSFGMHWVRQAPGKGLEWVAVISDDGNNKYYADSVKGRFTISRDNSKNTLYLQMNSLRVEDTAVYYCVKDVGESENEEWASDYYDFGRDYPGQDTRAVVGAFDIWGQGTMVTVSS

SEQ ID NO: 2340 - protein, 144 aa, Artificial Sequence
  anti-HIV_cap256-038-000384_VR-Chain
QVQLVESGGGVVQPGKSLRLSCAASGFTFSSYVMHWVRQAPGKGLEWVADISYDGSNKYYADSVKGRLTISRDNSKNTLYLQMNSLRAEDTAVYYCVKDLGESEKEEWPSDYYDFGRDYPGQDSRGVVGVFDIWGQGTMVTVSS

SEQ ID NO: 2341 - protein, 107 aa, Artificial Sequence
  anti-HIV_206-314431_VR-Chain
QFVLTQPPSVSAAPGQNVTISCSGPPSHIEKNDVSWYQRLPGMAPKMVIYESRRRPLGIPVRFTASRSGSSATLVITGLQTADEADYYCGTWDGRMNFGTGTTVTVL

SEQ ID NO: 2342 - protein, 107 aa, Artificial Sequence
  anti-HIV_206-247594_VR-Chain
QSILTQPPSVSAAPGQNVTISCSGPPSHIEKNDVSWYQRFPGMAPKMIIYESKRRPFGVPGRFSASRSGKSATLAITGLQTGDEADYYCGTWDGRMNFGTGTTVTVL

SEQ ID NO: 2343 - protein, 107 aa, Artificial Sequence
  anti-HIV_206-116890_VR-Chain
QSVLTQPPSVSAAPGQNVTISCSGPPSHIEKNDVSWYQHLPGEAPKMIIYESWRRPAGIPARFSASRSGKSGTLAITGLQTGDEADYYCGTWNGRMNFGTGTTVTVL

SEQ ID NO: 2344 - protein, 111 aa, Artificial Sequence
  anti-HIV_206-072383_VR-Chain
QSVLTQPPSVSAAPGQRVIISCSGNNSTIGNNFVSWYQQVPGTAPKLLIYETNRRPSGIPDRFSGSKSGTSATLAISGLQTGDEADFYCTVWGVRKGVAAVFGTGTRLTVL

SEQ ID NO: 2345 - protein, 111 aa, Artificial Sequence
  anti-HIV_206-037527_VR-Chain
QSVLTQPPSVSAAPGQKVIISCSGNNSTIGKILVSWYQQVPGTAPKLVIYETNRRPSGIPDRFSGSKSGTSATLAITGLQTGDEADYFCKVWGVRKGVAAVFGTGTKVTVL

SEQ ID NO: 2346 - protein, 111 aa, Artificial Sequence
  anti-HIV_206-009095_VR-Chain
QSVLTQPPSVSAAPAQRVIISCSGDNSTIGNNFVSWYQQVPGAAPKLLIYETNRRPSGIPDRFSGSKSGTTATLAISGLQTGDEADYHCTVWGVRKGVAAVFGTGTKVTVL

SEQ ID NO: 2347 - protein, 107 aa, Artificial Sequence
  anti-HIV_176-503620_VR-Chain
QSVLTQPPSVSTAPGQTVTVSCSGGTSNTGNNFVSWYQHLPGTAPKLLIYENNKRPLGVPDRFSGAKSGTSATLALTGLQTGDEGDYYCATWSGSLNIGTGTKVSVL

SEQ ID NO: 2348 - protein, 107 aa, Artificial Sequence
  anti-HIV_176-478726_VR-Chain
QSVLTQPPSVSAAPGQNVNISCSGPPSHIERNDVSWYQHLPGAAPKMIIYESWRRPAGIPDRFSASRSGASATLAITGLQTGDEADYYCGTWNGRMNFGTGTTVTVL

SEQ ID NO: 2349 - protein, 107 aa, Artificial Sequence
  anti-HIV_176-245056_VR-Chain
QSVLTQPPSVSAAPGQNVTISCSGPPSHIEKNGVSWYQQFPGMAPKMVIYESKRRPFGVPARFSASRSGKSATLAITGLQTGDEADYYCGTWDGRMNFGTGTTVTVL

SEQ ID NO: 2350 - protein, 107 aa, Artificial Sequence
  anti-HIV_176-164413_VR-Chain
QSVLTQPPSVSAAPGQKVTISCSGGTSNIGNNYVSWYQRLPGTAPKLLIYENNKRPSGIPDRFSGPKSGTSATLAITGLQPGDEADYYCATWSGSLNFGTGTKVTVL

SEQ ID NO: 2351 - protein, 111 aa, Artificial Sequence
  anti-HIV_176-094308_VR-Chain
QSVLTQPPSVSAAPGQKVIISCSGNNSTIGNNFVSWYQQVPGTAPKLLVYETYRRPSGIPDRSSGSKSGTTATQAISGLQTGDEADYHCTVWGVRKGVAAVFGTGTKVTVL

SEQ ID NO: 2352 - protein, 111 aa, Artificial Sequence
  anti-HIV_176-065321_VR-Chain
QSVLTQPPSVSAAPGRRVIISCSGNNSTIGNNFVSWYQQVPGTAPKLLVYETNRRPSGIPDRFSGSKSGTSATLAISGLQTGDEADYYCTVWGVRKGVAAVFGTGTKVTVL

SEQ ID NO: 2353 - protein, 108 aa, Artificial Sequence
  anti-HIV_119-099719_VR-Chain
QSVLTQPPSVSAAPGQKVTISCSGSNSYIGNKYISWYQQFPGTAPKLLIYENNKRPSGVPDRFSASKSATSATLAITGLHTGDEADYYCETCDGSGGVFGTGTKVTVL

SEQ ID NO: 2354 - protein, 109 aa, Artificial Sequence
  anti-HIV_119-099536_VR-Chain
ELTQPPSVSAASGQNVNISCSGGSSNIGSNYVSWYQQFPGTAPKLLIYETNKRPSGIPDRFSGSKSGASATLAITGLQTGDEADYYCATWADSLNSARVFGTGTKVTVL

SEQ ID NO: 2355 - protein, 111 aa, Artificial Sequence
  anti-HIV_119-098907_VR-Chain
QSVLTQPPSVSATPGQKVTISCSGSNSNIGDKYVSWYQHFPGTAPKLLVYETYRRPSGIPDRFSGSKSGTSATLAITGLQTGDEADYYCTIWGVRKGVGAVFGTGTKVIVL

SEQ ID NO: 2356 - protein, 108 aa, Artificial Sequence
  anti-HIV_119-098555_VR-Chain
QSVLTQPPSVSAAPGQNVTISCSGSASNIGKNFVSWYQQLPGTAPKLLIYGSNNRPSGVPDRFSGSKSGTSASLAITGLQTGDEADYYCETWDGSGAVFGTGTKVTVL

SEQ ID NO: 2357 - protein, 108 aa, Artificial Sequence
  anti-HIV_119-097828_VR-Chain
QSVLTQPPSVSAAPGQKVTISCSGSSSNIGKNYVSWYQLLPGTAPRLVIYENDERPSGTPDRFSGSKSGTSATLAITGLHTGDEADYYCETWDGSGGVFGTGTKVTVL

SEQ ID NO: 2358 - protein, 108 aa, Artificial Sequence
  anti-HIV_119-096480_VR-Chain
QSVLTQPPSVSGAPGQRITISCSGSTSNIGQNYVSWYQQLPGTAPKLLISDNNRRPSWTPDRFSGSKSGTSATLAITGLQTGDEADYYCETWDGSGGVFGPGTRVTVL

SEQ ID NO: 2359 - protein, 108 aa, Artificial Sequence
  anti-HIV_119-095664_VR-Chain
QSVLTQPPSVSAAPGQKVTISCSGGAANIGKNSVSWYQQLPGTAPKLLIYDNNRRPSGTPDRFSGSKSGTSATLAISGLQTGDEADYYCETWHGSGGVFGTGTKVTVL

SEQ ID NO: 2360 - protein, 107 aa, Artificial Sequence
  anti-HIV_119-095212_VR-Chain
QSVLTQPPSVSAAPGQKVTISCSGSTSNIGKSDVFWYQQLPGTAPKLLISETSRRPSGIPDRFSGAKSGTSATLAITGLQTGDEADYFCSTWSGSLNFGTGTRVTVL

SEQ ID NO: 2361 - protein, 111 aa, Artificial Sequence
  anti-HIV_119-094773_VR-Chain
QSVLTQSPTVSAAPGQTVTISCSGGTSNVGKNFVSWYQQFPRTAPKLLIYENNKRPSGIPDRFSGSKSGTSATLVITGLQTGDEADFYCGTWDGSLRTGGVIGTGTRVTVL

SEQ ID NO: 2362 - protein, 108 aa, Artificial Sequence
  anti-HIV_119-094508_VR-Chain
QSVLTQPPSVSATPGQRVTVSCSGSSSNIGNHYVSWYQQVPGTAPKLLISENSRRPSGTPDRFSGSKSGTSATLAITGLQTGDEADYYCETWDGSGGVFGTGTKVTVL

SEQ ID NO: 2363 - protein, 108 aa, Artificial Sequence
  anti-HIV_119-093795_VR-Chain
QSVLTQPPSVSAAPGQKVTISCSGSSSNIGNNYVSWYQYLPGTAPKLLISENNRRPSGTPDRFSGSKSGTSATLAITGLQTGDEADYYCETWDGSGGVFGTGTKVTVL

SEQ ID NO: 2364 - protein, 107 aa, Artificial Sequence
  anti-HIV_119-093732_VR-Chain
QSVLTQPPSVSAAAGQNVNISCSGRKSNVGGNYVSWYQQFPGTAPKLLIYEDNKRPSWIPDRFTASRSGTSATLGITGLQTGDEADYFCSTWSGSLNFGTGTRVTVL

SEQ ID NO: 2365 - protein, 111 aa, Artificial Sequence
  anti-HIV_119-092903_VR-Chain
QSVLTQPPSVSAAPRQKVTISCSGSSSNIGNHYVSWYQQLPGTAPKLLIYENNKRPSGIPDRFSGSKSGTSATLAITGLQTGDEADYYCATWAPRLNSARVFGNGTMVTVL

SEQ ID NO: 2366 - protein, 111 aa, Artificial Sequence
  anti-HIV_119-092284_VR-Chain
QSVLTQPPSVSGAPGQRVTISCTGSSSNIGGYDVHWYQQVPGTAPKLLLYENDRRPSGIPDRFSGSKSGTSATLVITGLQTGDEADFYCGTWDGSLRTGGVIGTGTRVTVL

SEQ ID NO: 2367 - protein, 111 aa, Artificial Sequence
  anti-HIV_119-091586_VR-Chain
QSVLTQPPSMSAAPGQRVTISCSGTSSDIGRNYVSWYQQFPGAAPKVLIYENSNRPSGIPDRFSGSKSGTSATLAISGLQTGDEADYCCAVWGVRRGAGAVFGAGTKVTVL

SEQ ID NO: 2368 - protein, 111 aa, Artificial Sequence
  anti-HIV_119-091023_VR-Chain
QSVLTQPPSVSAAPGQRVTISCSGSTSNIGNNFVSWYHHVPGTAPKLLIYDNVKRPTNVPDRFSGSKSGTSATLAISGLQTGDEADYWCAVWGVRRGAGAVFGAGTKVTVL

SEQ ID NO: 2369 - protein, 111 aa, Artificial Sequence
  anti-HIV_119-090334_VR-Chain
QSVLTQPPSVSGAPGQRVTISCTGSASNIGDSDVHWYQQLPGTAPKLLIFDNDKRPSGIPDRFSGSKSGTSATLAITGLQSGDEADYYCAVWGVRQGAGAVFGTGTKVTVL

SEQ ID NO: 2370 - protein, 111 aa, Artificial Sequence
  anti-HIV_119-088694_VR-Chain
QSVLTQPPSVSAAPGQKVTISCSGSSSNIPINGVSWYQQFPGTAPKLLVYETYRRPSGIPDRFSGSKSGTSATLAITGLQTGDEADYYCTVWGVRKGVGAVFGTGTKVTVL

SEQ ID NO: 2371 - protein, 111 aa, Artificial Sequence
  anti-HIV_119-088499_VR-Chain
QSVLTQPPSVSAAPGQKVTISCSGSNSYIGNKYVSWYQQFPGTAPKLLIYETNKRPSGIPDRFSGSKSGTSATLAITGLQTGDEADYYCATWAPRLNSARVFGNGTMVTVL

SEQ ID NO: 2372 - protein, 111 aa, Artificial Sequence
  anti-HIV_119-088298_VR-Chain
QSVLTQPPSVSAAPKEKVTISCSGGTSNIGRNYVSWYQQVPGTAPKLLIYENNKRPSGIPDRFSGSKSGTSATLVITGLQTGDEADFYCGTWGGSLRTGGVLGTGTRVTVL

SEQ ID NO: 2373 - protein, 108 aa, Artificial Sequence
  anti-HIV_119-087488_VR-Chain
QSVLTQPPSVSAAPGQKVTIFCSGRYSNIESNYVSWYQQLPGTAPKLLIHENNRRPSGTPDRFSGSKSGTSATLAITGLHTGDEADYYCETWDGSGGVFGTGTKVTVL

SEQ ID NO: 2374 - protein, 111 aa, Artificial Sequence
  anti-HIV_119-087423_VR-Chain
QSVLTQPPSVSAAPGQKVTISCSASSSNIGNNYVSWYQQLPATAPKLLIYDTDKRPSGIPDRFSGSKSGTSATLAITGLQTGDEADYYCTVWGVRKGVGAVFGTGTKVTVL

SEQ ID NO: 2375 - protein, 108 aa, Artificial Sequence
  anti-HIV_119-087371_VR-Chain
QSVLTQPPSLSAAPGQRVTISCSGGASNIGKNSVSWYVQVPGTAPKLLIYENNQRPSGISDRFSGSKSGSSATLGITGLQTADEADYYCETWDGSGGVFGTGTKVTVL

SEQ ID NO: 2376 - protein, 107 aa, Artificial Sequence
  anti-HIV_119-087279_VR-Chain
QSVLTQPPSVSAAPGQKVTISCSGSSSNIGKNYVSWYQQFPGTAPKLLMYENNKRPSGVPDRFSGSKSGTSATLDISGLQTGDEADYYCSTWSGSLNFGTGTRVTVL

SEQ ID NO: 2377 - protein, 108 aa, Artificial Sequence
  anti-HIV_119-087146_VR-Chain
QSVLTQPPSVSAAPGQKVTISCSGSSSNIGKNSVSWYQQFPGTAPKLLIYENNKRPSGIPDRFSGSKSGTSATLAITGLHTGDEADYYCETWDGSGGVFGTGTKVTVL

SEQ ID NO: 2378 - protein, 108 aa, Artificial Sequence
  anti-HIV_119-087048_VR-Chain
QFVLTQPPSVSAAPRQKVIISCSGSSSNIGKNYVSWYQQLPGTAPKLLIYDNDKRPSGISDRFSASKSGTSATLAITGLHTGDEADYYCETWDGSGGVFGTGTKVTVL

SEQ ID NO: 2379 - protein, 107 aa, Artificial Sequence
  anti-HIV_119-085802_VR-Chain
QSILTQPPSVSAAPGQRVTIPCFGGHSNIGSNYVSWYQHLPGTAPKLLIFENNKRPSGIPDRFSGAKSGTSATLAITGLQTGDEADYFCATWSGGLNFGTGTKVTVL

SEQ ID NO: 2380 - protein, 108 aa, Artificial Sequence
  anti-HIV_119-085784_VR-Chain
QSFLTQPPSVSAAPGQKVTISCSGSNSNIGNNYVSWYQYLPGTAPKLLIYENDRRPSGTPDRFSGSKSGTSATLAITGLQTGDEADYYCETWDGSGGVFGTGTKVTVL

SEQ ID NO: 2381 - protein, 111 aa, Artificial Sequence
  anti-HIV_119-085370_VR-Chain
QSVLTQPPSVSAAPGQTVTISCSGSSSNIGNTYVSWYQHLPGTAPKLLIYDNNIRPSGIPDRFSASKSGTSATLAITGLQTGDEADYYCATWAPSLNSARVFGSGTRVAVL

SEQ ID NO: 2382 - protein, 107 aa, Artificial Sequence
  anti-HIV_119-085276_VR-Chain
QSILTQPPSVSAAPGQRVTISCSGSSSNIGNNYVSWYQHVPGTAPKLLIYENNRRPSGTPDRFSGAKSGTSATLAITGLQTGDEADYFCSTWSGSLNFGTGTKVTVL

SEQ ID NO: 2383 - protein, 111 aa, Artificial Sequence
  anti-HIV_119-084885_VR-Chain
QSVLTQPPSVSAAPGEKVTISCSGSSSKIGNNFVSWYQQVPGTAPKLLVYESYRRPSGIPDRFSGSKSGTSATLAITGLQTGDEADYYCTVWGVRKGVGAVFGTGTKVTVL

SEQ ID NO: 2384 - protein, 111 aa, Artificial Sequence
  anti-HIV_119-084874_VR-Chain
QSVLTQPPSVSGAPRQRVTISCSGSASNIGKNSVSWYQQVPGTAPKLLIYENNKRPSGIPDRFSGSKSGTSATLVITGLQTGDEADFYCGTWDGSLRTGGVIGTGTRVTVL

SEQ ID NO: 2385 - protein, 111 aa, Artificial Sequence
  anti-HIV_119-084691_VR-Chain
QSVLTQPPSVSAAPGQKVVISCSGSSSIIEKNSISWYQQGPGAAPKLLIYENDKRPSGIPDRFSGSKSATSATLAIVGLQTGDEADYCCAVWGVRRGAGAVFGAGTKVTVL

SEQ ID NO: 2386 - protein, 108 aa, Artificial Sequence
  anti-HIV_119-083793_VR-Chain
QSVLTQPPSVSAAPGQKVTISCSGSSSNIGKNSVSWYQQLPATAPKLLIYESNKRPSGIPDRFSGSKSGTSATLAITGLQTGDEADYYCATWDGRVSVIGTGTKVTVL

SEQ ID NO: 2387 - protein, 108 aa, Artificial Sequence
  anti-HIV_119-083163_VR-Chain
QSVLTQPPSVSGAPGQRVIISCTGSSSNIWGYDVQWYQQLPGTAPKLLLYENDRRPSGTPDRFSGSKSGTSATLAITGLHTGDEADYYCETWDGSGGVFGTGTKVTVL

SEQ ID NO: 2388 - protein, 111 aa, Artificial Sequence
  anti-HIV_119-082331_VR-Chain
QSVLTQPPSISAAPGQKVTISCSGGSSNIGANYVSWYQHLPGTAPKLLIYETNKRPSGIPDRFSGSQSGTSATLVITGLQTGDEADFYCGTWGGSLRAGGVIGTGTRVTVL

SEQ ID NO: 2389 - protein, 108 aa, Artificial Sequence
  anti-HIV_119-082070_VR-Chain
QSVLTQPPSVSAAPGQKVVISCSGSSSIIEKNSISWYQQGPGAAPKLLIYENDRRPSGTPDRFSGSKSGTSATLAITGLQTGDEADYYCETWDGSGGVFGTGTKVTVL

SEQ ID NO: 2390 - protein, 111 aa, Artificial Sequence
  anti-HIV_119-081512_VR-Chain
QSVLTQPPSVSAAPGQNVTFSCSGSNSNIGDNYVSWYQQIPGTAPKLVIYDNNKRPSGIPDRFSGSKSGTSATLVITGLQTGDEADFYCGTWDGSLRTGGVIGTGTRVTVL

SEQ ID NO: 2391 - protein, 111 aa, Artificial Sequence
  anti-HIV_119-080816_VR-Chain
QLVLTQPPSASGTPGQRVTISCSGSSSNIGSNFVSWYQQRPGTAPKLLIYETNKRPSGIPDRFSGSKSGTSATLAITGLQTGDEADYYCATWAPRLNSARVFGNGTMVTVL

SEQ ID NO: 2392 - protein, 111 aa, Artificial Sequence
  anti-HIV_119-079302_VR-Chain
QSVLTQPPSVSAAPGQKVTISCSGSSSYIGNKYVSWYQQFPGTAPKLLIYENNKRLSGIPDRFSASKSATSATLAISGLQTGDEADFYCGTWDGSLRTGGVIGTGTRVTVL

SEQ ID NO: 2393 - protein, 109 aa, Artificial Sequence
  anti-HIV_119-079292_VR-Chain
QSVLTQPPSVSAAPGQKVTISCSGSNSNIGNNYVSWYQQLPGTAPKLLIYDNNKRPSGIPDRFSGSKSGTSATLGITGLQTGDEANYYCGTWDTSLSGVFGTGTEVIVL

SEQ ID NO: 2394 - protein, 107 aa, Artificial Sequence
  anti-HIV_119-079289_VR-Chain
QSALTQPPSVSAAPGQRVTISCSGNNSNIGNNFVSWYQLLPGTAPKLLIYENNKRSSGIPDRFSGSKSGTSATLGITGLQTGDEADYFCSTWSGSLNFGTGTRVTVL

SEQ ID NO: 2395 - protein, 108 aa, Artificial Sequence
  anti-HIV_119-078935_VR-Chain
QSVLTQPPSVSAAPGQRVTISCSGTSANIENYYVSWYQQLPGTAPKLIIYDDNKRPSGIPQRFSGSKSGTSATLGITGLQTGDEAEYYCETWDGSGGVFGTGTKVTVL

SEQ ID NO: 2396 - protein, 108 aa, Artificial Sequence
  anti-HIV_119-078702_VR-Chain
QSVLTQPPSVSAAPGQKVTISCSGSSSVFGKNYVSWYQHLPGTAPKLLIYENTKRPSGIPDRFSGSKSGTSATLAITGLQTGDEADYYCETWDGSGGVFGSGTKVTVL

SEQ ID NO: 2397 - protein, 108 aa, Artificial Sequence
  anti-HIV_119-078593_VR-Chain
QSFLTQPPSVSAAPGQKVTISCSGSNSNIGNNYVSWYQQVPGTAPKLLIYENNKRPSGIPDRFSGSKSGTSATLVITGLHTGDEADYYCETWDGSGGVFGTGSNVTLL

SEQ ID NO: 2398 - protein, 111 aa, Artificial Sequence
  anti-HIV_119-077708_VR-Chain
QSVLTQPPSLSAAPGQKVTISCSGTTSNIGNNYVSWYQHLPGTAPKLLIYENTKRPSGIPDRFSGSKSGTSATLGITGLQTGDEADYYCTVWGVRKGVGAVFGTGTKVTVL

SEQ ID NO: 2399 - protein, 107 aa, Artificial Sequence
  anti-HIV_119-076904_VR-Chain
QSVLTQPPSVSAAPGQKVTISCSRSSSHIENSYVSWYQHLPGTAPKLLIYENNKRPSGIPDRFSGSKSGTSATLGISGLQTGDEADYFCSTWSGSLNFGTGTRVTVL

SEQ ID NO: 2400 - protein, 108 aa, Artificial Sequence
  anti-HIV_119-075862_VR-Chain
QSVLTQPPSISAAPGQKVTISCSGSASNIGKNSVSWYQQFPGTAPKLLIYENNRRPSGTPDRFSGSKSGTSATLAITGLQTGDEADYYCETWDGSGGVFGTGTKVTVL

SEQ ID NO: 2401 - protein, 111 aa, Artificial Sequence
  anti-HIV_119-075465_VR-Chain
QSVLTQPPSVSAAPGQKVVISCSGSSSIIGNNYVSWYQQLPGTAPKLLIYENNRRPSGIPDRFSGSKSGTSATLAISGLQTGDEADYCCAVWGVRRGAGAVFGAGTKVTVL

SEQ ID NO: 2402 - protein, 110 aa, Artificial Sequence
  anti-HIV_119-074822_VR-Chain
SVLTQPPSVSAAPGQNITISCSGGSSNIAKNYISWYQHLPGTAPKIVIYDNDKRPLGIPDRFSASKSGTSATLGITGLQTGDEADYYCAVWGVRRGVGAVFGAGTKVIVL

SEQ ID NO: 2403 - protein, 111 aa, Artificial Sequence
  anti-HIV_119-074629_VR-Chain
QSVLTQPPSESAAPGQKVTISCSGGTSNIGNNYVSWYRRLPGTAPKLLIYENNRRPSGIPDRFSGSKSGTSATLAISGLQTGDEADYCCAVWGVRRGAGAVFGAGTKVTVL

SEQ ID NO: 2404 - protein, 108 aa, Artificial Sequence
  anti-HIV_119-074500_VR-Chain
QSVLTQPPSVSAAPGQKVTMSCSGSSSNIGNNYVSWYQYLPGTAPKLLIYENDRRPSGIPDRFSASKSGTSATLAITGLQTGDEADYYCETWDGSGGVFGTGTKVTVL

SEQ ID NO: 2405 - protein, 111 aa, Artificial Sequence
  anti-HIV_119-073911_VR-Chain
QSVLTQPPSVSAAPGQRVTISCSGSSSNIENNYVSWYQHLPGTAPKLLVYDDNKRPSGIPHRFSASKSGTSATLAITGLQTGDEADYYCTLWGVRKGVGAVFGTGTKVTVL

SEQ ID NO: 2406 - protein, 108 aa, Artificial Sequence
  anti-HIV_119-072765_VR-Chain
QSVLTQPPSVSAAPGQKVTISCSGNSSNIGNNFVSWYQQVPGTAPKLLVYETYRRPSGTPDRFSGSKSGTSATLAISGLQTGDEADYYCGTWDGSGGVFGTGTKVTVL

SEQ ID NO: 2407 - protein, 111 aa, Artificial Sequence
  anti-HIV_119-072313_VR-Chain
QFVLTQPPSVSAAPGQKVTISCSASSSIIGKNYVSWYQQFPGTAPKLLIYEDNKRPSGIPDRFSGSKSGTSATLAITGLQTGDEADYYCTVWGVRKGVGAVFGTGTKVTVL

SEQ ID NO: 2408 - protein, 111 aa, Artificial Sequence
  anti-HIV_119-072280_VR-Chain
QSVLTQPPSVSAAPGQKVSISCSGSDSNLGDNYVSWYQQFPGTAPKLLIHDNNKRPSGTPDRFSGSKSGTSATLAITGLQTGDEADYYCATWAPRLNSARVFGNGTMVTVL

SEQ ID NO: 2409 - protein, 111 aa, Artificial Sequence
  anti-HIV_119-071693_VR-Chain
QSVLTQPPSVSAAPGQKVVISCSGSSSIIEKNSISWYQQGPGAAPKLLIYENDKRPSGIPDRFSGSKSGTSATLAITGLQTGDEADYYCTIWGVRKGVGAVFGTGTKVTVL

SEQ ID NO: 2410 - protein, 107 aa, Artificial Sequence
  anti-HIV_119-071353_VR-Chain
QSVLTQPPSASAAPGQKVTISCSGSNSNIGNNFVSWYQLFPGTAPKLLIFENNKRPSGIPDRFSGAKSGTSATLAITGLQTGDEADYFCSTWSGSLNFGTGTRVTVL

SEQ ID NO: 2411 - protein, 108 aa, Artificial Sequence
  anti-HIV_119-069711_VR-Chain
QSVLTQPPSVSAAPGQKVTISCSGSSSNIGNNYVSWYQQLPGTAPKLLIYDNNNRPSGVPDRFSGSKSGTSATLAITGLQTGDEADYYCETWDDSGGVFGTGTKVTVL

SEQ ID NO: 2412 - protein, 111 aa, Artificial Sequence
  anti-HIV_119-069061_VR-Chain
QSVLTQPPSVSAAPGQKVTISCSGSSSNIGSNYVSWYQQLPGTAPKLLVYDNNERPSGIPDRFSGSKSGTSATLAITGLQTGDEADYYCATWAPRLNSARVFGNGTMVTVL

SEQ ID NO: 2413 - protein, 108 aa, Artificial Sequence
  anti-HIV_119-068202_VR-Chain
QSVLTQEPSVSGAPGQRVTISCTGSNSNIGGHDVHWYQQLPGTAPKLLIYDNDKRPSGIPDRFSGSKSDTSASLGITGLQTGDEADYYCETWDGSGGVFGTGTKVTVL

SEQ ID NO: 2414 - protein, 108 aa, Artificial Sequence
  anti-HIV_119-068063_VR-Chain
QSALTQPPSASGSLGQSVTISCTGTRSDVGNYYVSWYQQLPGTAPKLLISENNRRPSGTPDRFSGSKSGTSATLAISGLQTGDEADYYCGTWDGSGGVFGTGTKVTVL

SEQ ID NO: 2415 - protein, 111 aa, Artificial Sequence
  anti-HIV_119-067980_VR-Chain
QSVLTQPPSVSAAPGQKVTISCSGNSSNIGNNFVSWYQQVPGTAPKLLVYETYRRPSGIPDRFSGSKSGTSATLAITGLQTGDEADYHCAIWGVRKGVGAVFGTGTKVTVV

SEQ ID NO: 2416 - protein, 108 aa, Artificial Sequence
  anti-HIV_119-067866_VR-Chain
QSVLTQPPSVSAAPGQKVTISCSGSTSTIGNNYVSWYQHLPGTAPKLLIYDNNKRPAGIPDRFTASKSGTSATLAITGLHTGDEADYYCETWDGSGGVFGTGTKVTVL

SEQ ID NO: 2417 - protein, 107 aa, Artificial Sequence
  anti-HIV_119-067756_VR-Chain
QSVLTQPPSVSAAPGQKVVISCSGSTSNIGKNFVSWYQQLPGTAPKLLIYENSRRPSGIPDRFSGAKSGTSATLAITGLQTGDEADYFCSTWSGSLNFGTGTRVTVL

SEQ ID NO: 2418 - protein, 107 aa, Artificial Sequence
  anti-HIV_119-066859_VR-Chain
QSVLTQPPSVSAAPGQKVTITCSGSASNIENNYVSWYQQFPGPAPKLLIYENDKRPSGIPDRFSGSASGTSATLAITGLQTGDEADYFCSTWSGSLNFGTGTRVTVL

SEQ ID NO: 2419 - protein, 111 aa, Artificial Sequence
  anti-HIV_119-065821_VR-Chain
QSVLTQPPSVSATPGQRVTVSCSGSSSNIGNHYVSWYQQVPGTAPKLLIYDNSNRPSGIPDRFSGSKSGTSATLGITGLQTGDEADYYCTVWGVRKGVGAVFGTGTKVTVL

SEQ ID NO: 2420 - protein, 111 aa, Artificial Sequence
  anti-HIV_119-065191_VR-Chain
QSVLTQPPSVSAAPGQKVTISCSGNNSNIGNNYVSWYQQLPGTAPKLLIFENHKRPSGIPDRFSGSKSGTSATLGITGLQSGDEADYYCATWAPRLNSARVFGTGTKVTVL

SEQ ID NO: 2421 - protein, 111 aa, Artificial Sequence
  anti-HIV_119-064667_VR-Chain
QSVLTQPPSVSAAPGQKVTISCSGSNSYIGNKYVSWYQQVPGTAPKLLIYENNKRPSGIPDRFSGSKSGTSATLVITGLQTGDEADFYCGTWDGSLRTGGVIGTGTRVTVL

SEQ ID NO: 2422 - protein, 108 aa, Artificial Sequence
  anti-HIV_119-063791_VR-Chain
QSVLTQPPSVSAAPGQKVPISCSGNSSNIGNNYVSWYQQLPGTAPKLLIYENNKRPSGIPDRFSGSKSGTSATLAITGLHTGDEADYYCETWDGSGGVFGTGTKVTVL

SEQ ID NO: 2423 - protein, 111 aa, Artificial Sequence
  anti-HIV_119-062989_VR-Chain
QSVLTQPPSVSAAPGQRVTISCSGSSSNIGNNFVSWYQQFPGTVPKLLIYENNRRPSGIPDRFSGSKSGTSATLAITGLQTGDEADYYCAVWGVRRGVGAVFGAGTKVIVL

SEQ ID NO: 2424 - protein, 107 aa, Artificial Sequence
  anti-HIV_119-062286_VR-Chain
QSVLTQPPSVSAAPGQKVTISCSGSASNIGKNFVSWYQQLPGTAPKLLISENNRRPSGTPDRFSGSKSGASATLVISGLQTGDEADYYCATWSGSLSIGTGTKVTVL

SEQ ID NO: 2425 - protein, 107 aa, Artificial Sequence
  anti-HIV_119-061416_VR-Chain
QSVLTQPPSVSAAPGQKVVISCSGSSSIFEKNSISWYQQGPGAAPKLLIYENDKRRSGIPDRFSGSKSATSTTLAIVGLQTGDEADYFCSTWSGSLNFGTGTRVTVL

SEQ ID NO: 2426 - protein, 107 aa, Artificial Sequence
  anti-HIV_119-061344_VR-Chain
QSVLTQPPSVSAAPGQKVTISCSGSSSVFGKNYVSWYQHLPGTAPKLLIYENNKRPSGIPDRFSGAKSGTAATLAITGLQTGDEADYYCATWSGSLNFGTGTKVTVL

SEQ ID NO: 2427 - protein, 108 aa, Artificial Sequence
  anti-HIV_119-060240_VR-Chain
QSVLTQPPSEYGAPGHNVTVSCSGTTSNIENNFVSWYLIVPGTAPKLLIFDNDKRPSGIPDRFSGSKSGTSATLAITGLQTGDEADYYCATWDGRVSVIGTGTKVTVL

SEQ ID NO: 2428 - protein, 111 aa, Artificial Sequence
  anti-HIV_119-060184_VR-Chain
QSVLTQPPSVSGAPGQRVTISCSGSSSNIGSNTVNWYQQLPGTAPKLLIYDNNKRPSGIPDRFSGSKSGTSATLVITGLQTGDEADFYCGTWDGSLRTGGVIGTGTRVTVL

SEQ ID NO: 2429 - protein, 107 aa, Artificial Sequence
  anti-HIV_119-058035_VR-Chain
QSVLTQPPSVSAAPGQKVTISCSGSASNIGKNFVSWYQQLPGTAPKLLIYENNRRPSGTPDRFSGAKSGTSATLAITGLQTGDEADYFCSTWSGSLNFGTGTRVTVL

SEQ ID NO: 2430 - protein, 107 aa, Artificial Sequence
  anti-HIV_119-057858_VR-Chain
QSVLTQPPSVSAAPGQNVNISCSGGSSNIGSNYVSWYQQFPGTAPKLLIYENNKRPSGIPDRFSGAKSGTSATLAITGLQTGDEADYFCSTWSGSLNFGTGTRVTVL

SEQ ID NO: 2431 - protein, 108 aa, Artificial Sequence
  anti-HIV_119-057473_VR-Chain
QSVLTQPPSVSAAPGQKVTISCSGSSSNIGNNYVSWYQHLPGTAPKLLIYDTYSRPSGIPDRFSGSKSGTSATLAITGLQTGDEADYYCGTWDGSGGVFGTGTKVTVL

SEQ ID NO: 2432 - protein, 107 aa, Artificial Sequence
  anti-HIV_119-057090_VR-Chain
QSVLTQPPSVSAAPGQTVTISCSGSTSNIGKNDVSWYQQLPGTAPKLLISENNRRPSGTPDRFSASKSGTSATLAITGLQTGDEADYFCSTWSGSLNFGTGTRVTVL

SEQ ID NO: 2433 - protein, 111 aa, Artificial Sequence
  anti-HIV_119-055754_VR-Chain
QSVLTQPPSVSAAPGQKVTISCSGNSSSIGNNFVSWYQQLPGTAPKLLVYENYRRPSGIPDRFSGSKSGTSATLAIDGLQTWDEADYHCAIWGVRKGVGAVFGTGTKVTVV

SEQ ID NO: 2434 - protein, 108 aa, Artificial Sequence
  anti-HIV_119-054899_VR-Chain
QSVLTQPPSVSAAPGQKVTISCSGSNSYIGNKYVSWYQQFPGTAPKLLIHENNRRPSGTPDRFSGSKSGTSATLAISGLQTGDEADYYCETWDGSGGVFGTGTKVTVL

SEQ ID NO: 2435 - protein, 108 aa, Artificial Sequence
  anti-HIV_119-054501_VR-Chain
QSVLTQPPSVSAAPGQKVTISCSGTSSNIGNNYVSWYQHLPGTAPKLLIFETNKRPSGIPDRFSASKSGTSATLAITGLQTGDEADYYCETWDGSGGVFGPGTRVTVL

SEQ ID NO: 2436 - protein, 108 aa, Artificial Sequence
  anti-HIV_119-051867_VR-Chain
QSVLTQPPSVSAAPGQKVTISCSGNSSNIGNNFISWYQQLPGTAPKLLIYENDRRPSGTPDRFSGSKSGTSATLAITGLQTGDEADYYCETWDGSGGVFGTGTKVTVL

SEQ ID NO: 2437 - protein, 108 aa, Artificial Sequence
  anti-HIV_119-051814_VR-Chain
QSVLTQPPSVSAAPGQKVTISCSGSNSNIGNKDVSWYQQIPATAPKLLIYENNKRPSGIPDRFSGSKSGTSATLAITGLQTGDEADYYCATWDGRVSVIGTGTNVIVL

SEQ ID NO: 2438 - protein, 107 aa, Artificial Sequence
  anti-HIV_119-051567_VR-Chain
QSVLTQPPSVSAAPGQKVTIYCSGSRSNIGRNYASWYQQLPGTAPKLLIFDNNRRPSGIPDRFSGAKSGTSATLAITGLQTGDEADYFCSTWSGSLNFGTGTRVTVL

SEQ ID NO: 2439 - protein, 108 aa, Artificial Sequence
  anti-HIV_119-051483_VR-Chain
QSVLTQPPSVSAAPGQKLTISCSGTSSNIGNNYVSWYQHLPGTAPKLLIYENNRRPSGIPERFSASKSGTSATLGITGLQTGDEADYYCETWDDSGGVFGTGTKVTVL

SEQ ID NO: 2440 - protein, 111 aa, Artificial Sequence
  anti-HIV_119-050913_VR-Chain
QSVLTQPPSVSAAPGQKVTISCSGGTSNIGNNYVSWYQQLPGTAPRLLIYETNKRPSGIPDRFFGSKSGTSATLAISGLQTGDEADYYCTVWGVRKGVGAVFGTGTKVTVL

SEQ ID NO: 2441 - protein, 111 aa, Artificial Sequence
  anti-HIV_119-050187_VR-Chain
QSVLTQPPSVSAAPGQKVTISCSGSSSNIGKNSVSWYQQFPGTAPKLLIYENNKRPSGIPDRFSDSQSGTSATLAITGLQTGDEADYSCATWAASLNSARVFGTGTRVTVL

SEQ ID NO: 2442 - protein, 108 aa, Artificial Sequence
  anti-HIV_119-049069_VR-Chain
QSVLTQPPSVSAAPGQKVTISCSGSTSNIGKSDVFWYQQLPGTAPKLLISETSRRPSGTPDRFSGSKSGTSATLTITGLQTGDEADYYCEAWDGSGGVFGTGTKVTVL

SEQ ID NO: 2443 - protein, 111 aa, Artificial Sequence
  anti-HIV_119-048517_VR-Chain
QSVLTQPPSVSAAPGQKVTISCSGSKFNIGNKDVSWYQHSPGTAPKLLIYENNKRPSGIPDRFSGSKSGTSATLGISGLQTGDEADYCCAVWGVRRGAGAVFGAGTKVTVL

SEQ ID NO: 2444 - protein, 111 aa, Artificial Sequence
  anti-HIV_119-048470_VR-Chain
QSVLTQPPSVSAAPGQKVTISCSGSTSNIGKNLVSWYQQFPGTAPKLLIYENNRRPSGIPDRFSGSKSGTSATLVITGLQTGDEADFYCGTWGGSLRAGGVIGTGTRVTVL

SEQ ID NO: 2445 - protein, 94 aa, Artificial Sequence
  anti-HIV_119-048303_VR-Chain
SVLTQPPSVSAAPGQNITISCSGSISNIASNFISWYQQLPGTAPKIIIYDNDQRPLGIPARFSGSKSGASATLVITGLQTGDEADYYCGTWDGS

SEQ ID NO: 2446 - protein, 111 aa, Artificial Sequence
  anti-HIV_119-048021_VR-Chain
QSVLTQPPSVSAAPGQKVTISCSGSSSNIGNNYVSWYQQLPGTAPKLLIYDNNKRPSGIPDRFSGSKSGTSATLVITGLQTGDEADFYCGTWDGSLSGGGVIGTGTRVTVL

SEQ ID NO: 2447 - protein, 108 aa, Artificial Sequence
  anti-HIV_119-047928_VR-Chain
QSVLTQPPSVSAAPGQKVTISCSGSNSNIGNNCVSWYQQVPGTAPKLLIYENNRRPSGIPDRFSGSKSGTSATLAISGLQTGDEADYYCGTWDGSGGVFGTATKVTVL

SEQ ID NO: 2448 - protein, 108 aa, Artificial Sequence
  anti-HIV_119-047384_VR-Chain
QSVLTQPPSVSAAPGQKVTISCSGSNSNIGNKDVSWYRQVPPTAPKLLIYENNKRPSGIPDRFSGSKSGTSATLAITGLQTGDEADYYCATWDGRVSVFGTGTKVAVL

SEQ ID NO: 2449 - protein, 111 aa, Artificial Sequence
  anti-HIV_119-047145_VR-Chain
QSVLTQPPSVSAAPGQTVNISCSGSNSNIGSKYVSWYQHFPGTAPKLLIYENNKRSSGIPDRFSGSKSATSATLAITGLQTGDEADYYCATWAPSLNSARVFGTGTKVTVL

SEQ ID NO: 2450 - protein, 111 aa, Artificial Sequence
  anti-HIV_119-046752_VR-Chain
QSVLTQPPSVSAAPGQKVTISCSGNSSSIGNNFVSWYQQLPGTAPKLLVYENYRRPSGISDRFSGSKSGTSATLAITGLQTGDEADYYCTVWGVRKGVGAVFGTGTKVTVL

SEQ ID NO: 2451 - protein, 108 aa, Artificial Sequence
  anti-HIV_119-046660_VR-Chain
QSVLTQPPSVSAAPGQKVTISCSGSSSNIGNHYVSWYQQLPGTAPKLLIYDNNKRPSGIPDRFSASKSGTSATLGITGLQTGDEADYYCATWDGRVSVIGTGTKVTVV

SEQ ID NO: 2452 - protein, 111 aa, Artificial Sequence
  anti-HIV_119-046202_VR-Chain
QSVLTQPPSVSAAPGQKVTISCSGSSSNIGNNYVSWYQQLPGTAPKLLVYENYRRPSGIPDRFSGSKSGTSATLAITGLQTGDEADYHCAIWGVRKGVGAVFGTGTKVTVV

SEQ ID NO: 2453 - protein, 111 aa, Artificial Sequence
  anti-HIV_119-045790_VR-Chain
QSVLTQPPSVSAAPGQKVTISCSGSSSNIGNNYVSWYQYLPGTAPKLLFYEDNRRPSGTPDRFSGSKSGTSATLAISGLQTGDEADYYCTIWGVRKGVGAVFGTGTKVTVL

SEQ ID NO: 2454 - protein, 111 aa, Artificial Sequence
  anti-HIV_119-044670_VR-Chain
QSVLTQPPSVSGAPGERVTISCTGNTSNIGTYDVQWYQHLPGTAPRLLIYHNVNLPSGVPDRFSASKSGTSATLAITGLQTGDEADYYCTIWGVRKGVGAVFGTGTKVTVL

SEQ ID NO: 2455 - protein, 107 aa, Artificial Sequence
  anti-HIV_119-044140_VR-Chain
QSVLTQPPSVSAAPGQKVTISCSGGTSNIGNHFVSWYRHLPGTAPKLLIYENNNRPSGIPDRFSGAKSGTSATLAITGLQTGDEGDYYCATWSGSLNIGTGTKVTVL

SEQ ID NO: 2456 - protein, 111 aa, Artificial Sequence
  anti-HIV_119-042776_VR-Chain
QSVLTQPPSVSAAPGQKVTISCSGSSSNIGNNYVSWYQHLPGTAPKLLIYESARRPSGTPDRFSGSKSGTSATLAITGLQTGDEADYYCTLWGVRKGVGAVFGTGTRVTVL

SEQ ID NO: 2457 - protein, 111 aa, Artificial Sequence
  anti-HIV_119-042581_VR-Chain
QSVLTQPPSVSAAPGQKVTISCSGSSSNIGNNFVSWYQQLPGTAPKLLIFETHRRPSGIPDRFSGSKSGTSATLAITGLQSGDEADYYCAVWGVRQGAGAVFGTGTKVTVL

SEQ ID NO: 2458 - protein, 111 aa, Artificial Sequence
  anti-HIV_119-040905_VR-Chain
QSVLTQPPSVSAAPGQKVTISCSGNSSNIGDNFVSWYQQLPGIAPKLLVYETNKRPSGIPDRFAGSKSGTSATLVITGLQTGDEADFYCGTWDGSLRTGGVIGTGTRVTVL

SEQ ID NO: 2459 - protein, 107 aa, Artificial Sequence
  anti-HIV_119-040322_VR-Chain
QSVLTQPPSVSAAPGQKVVISCSGSSSIIEKNSISWYQQGPGAAPKLLIYENDKRPSGIPDRFSGSKSGTTGTLAITGLQTGDEADYFCATWSGRLNIGTGTKVTVL

SEQ ID NO: 2460 - protein, 108 aa, Artificial Sequence
  anti-HIV_119-039892_VR-Chain
QSVLTQPPSVSAAPGQKVTISCSGSNANIGNKDVSWYQQLPATAPKLLIYESNKRPSGIPDRFSGSKSGTSATLAITGLQTGDEADYYCATWDGRVSGIGTGTKVTVL

SEQ ID NO: 2461 - protein, 108 aa, Artificial Sequence
  anti-HIV_119-039764_VR-Chain
QSVLTQPPSVSAAPGQKVTISCSGSASNIGKNFVSWYQQVPGTAPKLLIYENNRRPSGTPDRFSGSKSGTSGTLAISGLQTGDEADYYCETWDGSGGVFGTGTKVTVL

SEQ ID NO: 2462 - protein, 111 aa, Artificial Sequence
  anti-HIV_119-039188_VR-Chain
QSVLTQPPSLSGAPGQTVTISCSGSSSNIGNNYVSWYQQLPGTAPKLLIYDSNRRPSGIPDRFSGSKSGTSATLAISGLQTGDEADYCCAVWGVRRGAGAVFGAGTKVTVL

SEQ ID NO: 2463 - protein, 107 aa, Artificial Sequence
  anti-HIV_119-039058_VR-Chain
QSVLTQPPSVSGAPGQRVTISCTGSSSNIGNNYVSWYRRLPGTAPKLLIYENNKRPSGIPDRFSGAKSGTSATLAITGLQTGDEADYFCSTWSGSLNFGTGTRVTVL

SEQ ID NO: 2464 - protein, 107 aa, Artificial Sequence
  anti-HIV_119-038837_VR-Chain
QSVLTQPPSVSAAPGQKVTISCSGGTSNIGNNFVSWYQHLPGTAPKLLIFENNKRPSGVPDRFSGAKSGTSATLAITGLQTGDEGDYYCATWSGSLNIGTGTKVTVL

SEQ ID NO: 2465 - protein, 107 aa, Artificial Sequence
  anti-HIV_119-038396_VR-Chain
QSVLTQPPSVSATPGQKVTISCSGSNSNIGNKYVSWYQLFPGTAPKLLISENNRRPSGTPDRFSGSKSGTSATLAITGLQTGDEADYYCATWSGSLNIGTGTKVTVL

SEQ ID NO: 2466 - protein, 107 aa, Artificial Sequence
  anti-HIV_119-036918_VR-Chain
QSVLTQPPSVSAAPGQKVTISCSGATSNIWDHYVSWYLQVPGTAPRLLIYDNDKRPSGIPDRFSGSKSGTSATLAITGLQTGDEGDYYCATWSGSLNIGTGTKVTVL

SEQ ID NO: 2467 - protein, 108 aa, Artificial Sequence
  anti-HIV_119-036592_VR-Chain
QSVLTQPPSVSAAPGQKVTISCSGSNSNTGNKDVSWYQQVPATAPKLLIYESNKRPSGIPDRFSGSKSGTSATLAITGLQTGDEADYYCAIWDGRVSVIGTGTKVTVL

SEQ ID NO: 2468 - protein, 108 aa, Artificial Sequence
  anti-HIV_119-036310_VR-Chain
QSVLTQPPSVSAAPGQKVTISCSGSTSNIGQNYVSWYQQLPGTAPKLLIYENNRRPSGSPDRFSGSKSGTSATLAITGLQTGDEADYYCETWDGSGGVFGTGTKVTVL

SEQ ID NO: 2469 - protein, 111 aa, Artificial Sequence
  anti-HIV_119-035618_VR-Chain
QSVLTQPPSVSAAPGQKVTISCSGSSFTIGNNHVSWYQQLPGTAPKLLIFESHKRPSGVPDRFSGSKSGTSATLAITGLQTGDEADYYCTVWGVRKGVGAVFGTGTKVTVL

SEQ ID NO: 2470 - protein, 107 aa, Artificial Sequence
  anti-HIV_119-035569_VR-Chain
QSVLTQPPSVSGAPGQTVTISCTGSSSNIGGYDVHWYQQLPGTAPKLLIYENNRRPSGTPDRFSGAKSGTSATLAITGLQTGDEGDYYCATWSGSLNIGTGTKVTVL

SEQ ID NO: 2471 - protein, 108 aa, Artificial Sequence
  anti-HIV_119-035466_VR-Chain
QSVLTQPPSVSAAAGQNVNISCSGKKSNIGNNYVSWYQQFPGTAPKLLIYGNTNRPSGIPDRFSGSKSGTSATLAITGLQTGDDADYYCETWDGSGGVFGTGTKVTVL

SEQ ID NO: 2472 - protein, 111 aa, Artificial Sequence
  anti-HIV_119-035157_VR-Chain
QSVLTQPPSVSAAPGQKVTISCSGSSSNIGNNFVSWYQQRPGTAPKLLIYETNKRPSGIPDRFSGSKSGTSATLAITGLQTGDEADYYCATWAPRLNSARVFGNGTMVTVL

SEQ ID NO: 2473 - protein, 111 aa, Artificial Sequence
  anti-HIV_119-035121_VR-Chain
QSVLTQPPSVSAAPGQKVTISCSGSTSYIGNKYVSWYQQFPGAAPKLLIYENNKRPSGIPDRFSASKSATSATLAITGLQTGDEADYCCAVWGVRRGAGAVFGAGTKVTVL

SEQ ID NO: 2474 - protein, 108 aa, Artificial Sequence
  anti-HIV_119-035046_VR-Chain
QSALTQPASVSGSPGQSITISCTGTSSDVGYDYVSWYRQVPATTPKLLIYENNKRPSGIPDRFSGSKSGTSATLAITGLQTGDEADYYCATWDGRVSVIGTGTKVTVV

SEQ ID NO: 2475 - protein, 108 aa, Artificial Sequence
  anti-HIV_119-034754_VR-Chain
QSVLTQPPSVSAAPGEKVTISCSGSSSNIGNNYVSWYQQLPGTVPKLLIYDNNKRPSGTPDRFSGSKSGTSATLAITGLQTGDEADYYCETWDGSGGVFGTGTKVTVL

SEQ ID NO: 2476 - protein, 108 aa, Artificial Sequence
  anti-HIV_119-034318_VR-Chain
QSVLTQPPSVSAAPGQKITISCSGSSSNIGNNDVSWYQQLPGTAPKLLIYENDRRPSGTPDRFSGSKSGTSATLAITGLQTGDEADYYCETWDGSGGVFGTGTKVTVL

SEQ ID NO: 2477 - protein, 111 aa, Artificial Sequence
  anti-HIV_119-033780_VR-Chain
QSVLTQPPSVSAAPGQRVTISCSGTSSNIGENYVSWYQQIPGTAPKLLIYENNKRPSGIPDRFSGSKSGTSATLVITGLQTGDEADFYCGTWGGSLRTGGVLGTGTRVTVL

SEQ ID NO: 2478 - protein, 111 aa, Artificial Sequence
  anti-HIV_119-033632_VR-Chain
QSVLTQPPSVSAAPGQRVTISCSGGSSNIGSNYVSWYQQLPGTAPKLLIYQNNKRPSGIPDRFSGSKSGTSATLGITGLQTGDEADYYCTVWGVRKGVGAVFGTGTKVTVL

SEQ ID NO: 2479 - protein, 111 aa, Artificial Sequence
  anti-HIV_119-033183_VR-Chain
QSVLTQPPSVSAAPGQMVTISCSGGASNLGKNSVSWYQQLPGTAPKLLIYEDNRRPSGTPDRFSGSRSGTSATLAITGLQTGDEADYYCTIWGVRKGVGAVFGTGTKVTVL

SEQ ID NO: 2480 - protein, 111 aa, Artificial Sequence
  anti-HIV_119-030696_VR-Chain
QSVLTQPPSVSGAPGQIVTLSCTGAMTNIGNNDVHWYQHLPGTGPKLLIYENNKRPSGIPDRFSGSKSGTSATLVITGLQTGDEADFYCGTWDGSLRTGGVIGTGTRVTVL

SEQ ID NO: 2481 - protein, 108 aa, Artificial Sequence
  anti-HIV_119-030059_VR-Chain
QSVLTQPPSVSAAPGQKVVISCSGSSSIIEKNSISWYQQGPGAAPKLLIYENDKRPSGISDRFSGSKSATSATLAITGLHTGDEADYYCETWDGSGGVFGTGTKVTVL

SEQ ID NO: 2482 - protein, 111 aa, Artificial Sequence
  anti-HIV_119-029589_VR-Chain
QSVLTQPPSVSAAPGQKVTISCSGTSSNIGNNFVSWYQLLPGTAPRLLIYDNNKRPSGTPDRFSGSKSGTSATLGITGLQTGDEADFYCGTWDGSLRTGGVIGTGTRVTVL

SEQ ID NO: 2483 - protein, 108 aa, Artificial Sequence
  anti-HIV_119-029448_VR-Chain
QSVLTQPPSVSAAPGQKVTISCSGNSSNIGKNSVSWYHQLPGTAPKLLIYENDRRPSGTPDRFSGSKSGTSATLAITGLQTGDEADYYCETWDGSGGVFGTGTKVTVL

SEQ ID NO: 2484 - protein, 111 aa, Artificial Sequence
  anti-HIV_119-029220_VR-Chain
QSVLTQPPSVSAAPGQKVTISCSGSTSNIGQNYVSWYQQLPGTAPKLLIYENDRRPSGIPDRFSGSKSGTSATLAISGLQTGDEADYCCAVWGVRRGAGAVFGPGTKVTVL

SEQ ID NO: 2485 - protein, 111 aa, Artificial Sequence
  anti-HIV_119-028317_VR-Chain
QSVLTQPPSVSAAPGQKVTISCSGSSSNIGNDYVSWYQQLPGTAPKLLIYENNKRPSGIPDRFSGSKSGTSATLAITGLQTGDEADYYCTIWGVRKGVGAVFGTGTKVTVL

SEQ ID NO: 2486 - protein, 108 aa, Artificial Sequence
  anti-HIV_119-028165_VR-Chain
QSVLTQPPSVSAAPGQTVTISCSGITSNIGKNDVSWYQQLPGTAPKLLISENNRRPSGIPDRFSGSKSGTSATLAITGLQTGDEADYYCAIWDGRVSVIGTGTKVTVL

SEQ ID NO: 2487 - protein, 108 aa, Artificial Sequence
  anti-HIV_119-027147_VR-Chain
QSVLTQPPSVSAAPGQTVTISCSGSTSDIGKNDVSWYQQLPGIAPKLLISENNRRPSGTPDRFSGSKSGTSATLAITGLQTGDEADYYCETWDGSGAVFGTGTKVTVL

SEQ ID NO: 2488 - protein, 111 aa, Artificial Sequence
  anti-HIV_119-026743_VR-Chain
QSVLTQPPSVSAAPGQNVTISCSGSSSNIGNNFVSWYQQRPGTGPKLLIYETNRRPSGIPDRFSGSKSGTSATLAITGLQTGDEADYYCATWAPSLNSARVFGTGTKVTVL

SEQ ID NO: 2489 - protein, 111 aa, Artificial Sequence
  anti-HIV_119-026508_VR-Chain
QSVLTQPPSVSAAPGQKVTISCSGSSSTIGNNYISWYQVLPGTAPKLVIFKNNERPSRVPDRFSGSKSGTSATLGITGLQLGDEGDYYCGTWETSLSGGGVFGTGTKVTVL

SEQ ID NO: 2490 - protein, 108 aa, Artificial Sequence
  anti-HIV_119-025683_VR-Chain
QSVLTQPPSVSAAPGQKVTISCSGSSSNIGNNYVSWYQQLPGTAPKLLIYENNKRPSGIPDRFSDSQSGTSATLAITGLQTGDEADYYCETWDGSGGVFGTGTKVTVL

SEQ ID NO: 2491 - protein, 111 aa, Artificial Sequence
  anti-HIV_119-025614_VR-Chain
QSLLTQPPSVSAAPGQNVIISCSGSSSNIGKNYVAWYQQVPGTAPKIVVFETTNRPSGIPDRFSGSKSGTSATLAITGLQTGDEADYYCTVWGVRKGVGAVFGTGTKVTVL

SEQ ID NO: 2492 - protein, 108 aa, Artificial Sequence
  anti-HIV_119-025548_VR-Chain
QSILTQPPSVSAAPGQKVTISCSGSSSNIGNNYVSWYQHVPGTAPKLLIYENNRRPSGTPDRFSGSKSGTSATLAITGLQSGDEADYYCGTWDGSGGVFGTGTKVTVL

SEQ ID NO: 2493 - protein, 111 aa, Artificial Sequence
  anti-HIV_119-025526_VR-Chain
QSVLTQPPSVSAAPGQKVTISCSGSASNIGKNFVSWYQQLPGTAPKLLIYENNRRPSGTPDRFSGSKSGTSATLAITGLQTGDEADYYCTVWGVRKGVGAVFGTGTKVTVL

SEQ ID NO: 2494 - protein, 108 aa, Artificial Sequence
  anti-HIV_119-023552_VR-Chain
QSVLTQPPSVSAAPGQTVTISCSGSTSNIGKNDVSWYQQLPGTAPKLLISENNRRPSGTPDRFSASKSGTSATLAITGLQTGDEADYYCETWHGSGGVFGTGTKVTVL

SEQ ID NO: 2495 - protein, 107 aa, Artificial Sequence
  anti-HIV_119-023092_VR-Chain
QSVLTQPPSVSAAPGQKVTISCSGSTSDLGQTRVSWYQQLPRSAPELLIFENNRRPSGIPDRFSGAKSGTSATLAITGLQTGDEADYFCSTWSGSLNFGTGTRVTVL

SEQ ID NO: 2496 - protein, 108 aa, Artificial Sequence
  anti-HIV_119-022793_VR-Chain
QSVLTQPPSVSAAPGQKVTISCSGGTSNIGNNYVSWYRRLPGTAPKLLIYENNKRPSGIPDRFSGAKSGTSATLGITGLQTGDEADYYCETWDDSGGVFGTGTKVTVL

SEQ ID NO: 2497 - protein, 108 aa, Artificial Sequence
  anti-HIV_119-022395_VR-Chain
QSVLTQPPSVSAAPGQTVTISCSGSTSNIGKNDVSWYQQLPGTAPKLLISDNNRRPSWTPDRFSGSKSGTSATLAITGLQTGDEADYYCETWDGSGGVFGPGTRVTVL

SEQ ID NO: 2498 - protein, 111 aa, Artificial Sequence
  anti-HIV_119-022334_VR-Chain
QSVLTQPPSVSAAPGQNVNISCSGGSSNIGSNYVSWYQQFPGTAPKHLIYENNKRPSGIPDRFSDSQSGTSATLGITGLQTGDEADYYCGTWDGSLRTGGVIGTGTRVTVL

SEQ ID NO: 2499 - protein, 107 aa, Artificial Sequence
  anti-HIV_119-021866_VR-Chain
QSVLTQPPSVSAAPGQRVTISCSGSASNIGKNFVSWYQQLPGKAPKLIIYEVTKRPSGVPARFSGSKSGTSATLAITGLQTGDEADYFCSTWSGSLNFGTGTRVTVL

SEQ ID NO: 2500 - protein, 108 aa, Artificial Sequence
  anti-HIV_119-021278_VR-Chain
QSVLTQPPSVSAAPGQKVTISCSGSASNIGKNFVSWYQQLPGTAPKLLIYENNRRPSGTPDRFSGSRSGTSATLGITGLQTGDEAHYYCETWDDSGGVFGTGTKVTVL

SEQ ID NO: 2501 - protein, 111 aa, Artificial Sequence
  anti-HIV_119-021183_VR-Chain
QSVLTQPPSVSAAPGQKVTISCSGNSSNIGNNFVSWYQQFPGTAPKLLVFETHRRPSGIPDRFSGSKSGTSATLAITGLQTGDEADYYCAVWGVRRGVGAVFGAGTKVTVL

SEQ ID NO: 2502 - protein, 111 aa, Artificial Sequence
  anti-HIV_119-019376_VR-Chain
QSVLTQPPSVSAAPGQKVTISCSGSSSNIGNNYVSWYQQVPGTAPKLLVYETYRRPSGIPDRFSGSKSGTSATLAITGLQTGDEADYYCTIWGVRKGVGAVFGTGTKVTVL

SEQ ID NO: 2503 - protein, 107 aa, Artificial Sequence
  anti-HIV_119-019238_VR-Chain
QSVLTQPPSVSAAPGQKVTISCSGTSSNIGNNHVSWYQQVPGTAPKLLIYENNKRPSGIPARFSAAKSGTSATLAITGLQTGDEADYFCATWSGRLNIGTGTKVTVL

SEQ ID NO: 2504 - protein, 111 aa, Artificial Sequence
  anti-HIV_119-018500_VR-Chain
QSVLTQPPSVSAAPGQKVNISCSGSSSNIGNNFVSWYQQRPGTAPKLLIYETNRRPSGIPDRFSGSKSGTSATLAITGLQTGDEADYYCATWAASLTSARVFGIGTKVTVL

SEQ ID NO: 2505 - protein, 108 aa, Artificial Sequence
  anti-HIV_119-018318_VR-Chain
QSVLTQPPSVSAAPGQTVIISCSGSTSNIGKNDVSWYQQLPGTAPKLLISENNRRPSGTPDRFSGSKSGTSATLAITGLQTGDDADYYCETWDGSGGVFGTGTKVTLV

SEQ ID NO: 2506 - protein, 111 aa, Artificial Sequence
  anti-HIV_119-018218_VR-Chain
QSVLTQPPSVSAAPGQKVTISCSGNSSNIGNNFVSWYQQLPGTAPKLLIYENNRRPSGIPDRFSGSKSGTSATLAISGLQTGDEADYWCAVWGVRRGAGAVFGAGTKVTVL

SEQ ID NO: 2507 - protein, 108 aa, Artificial Sequence
  anti-HIV_119-017876_VR-Chain
QSVLTQPPSVSAAPGQKVTISCSGSTSKIGQNSVSWYQQLPGTAPKLLIYENDRRPSGTPDRFSASKSGTSATLAITGLQTGDEADYYCETWDDSGGVFGTGTKVTVL

SEQ ID NO: 2508 - protein, 108 aa, Artificial Sequence
  anti-HIV_119-017740_VR-Chain
QSVLTQPPSVSAAPGQKVTISCSGSNSNIGNKDVSWYRQVPATAPKLPIYENKNEPSGVPDRFSGSKSGTSATLAITGLQTGDEADYYCATWDGRVSVIGTGTKVTVV

SEQ ID NO: 2509 - protein, 107 aa, Artificial Sequence
  anti-HIV_119-017128_VR-Chain
QSVLTQPPSVSAAPGQKVTISCSGSSSNIGNNYVSWYQQLPGTAPKLLIYENNKRPSGIPDRFSGAKSGTSATLAITGLQTGDEADYFCSTWSGSLNFGTGTRVTVL

SEQ ID NO: 2510 - protein, 108 aa, Artificial Sequence
  anti-HIV_119-017044_VR-Chain
QSVLTQPPSVSAAPGQKVTISCSGSNSNIGNNYVSWYHHLPGTAPRLLIYDNNKRPSGIPDRFSGSKSGTSATLAITGLQTGDEADYYCATWDGRVSVIGTGTQVTVL

SEQ ID NO: 2511 - protein, 107 aa, Artificial Sequence
  anti-HIV_119-016644_VR-Chain
QSVLTQPPSVSAAPGQKVTISCSGGTSNIGNNYVSWYQQLPGTAPKLLIYENNKRPSGIPARFSAAKSGTSATLAITGLQTEDEADYYCATWSGSLNIGTGTKVTVL

SEQ ID NO: 2512 - protein, 111 aa, Artificial Sequence
  anti-HIV_119-015878_VR-Chain
QSALTQPPSASGSPGQSVTISCSGSSSNIGNNFVSWYQQRPGTAPKLLIYETNKRPSGIPDRFSGSKSGTSATLAITGLQTGDEADYYCATWAPRLNSARVFGNGTMVTVL

SEQ ID NO: 2513 - protein, 107 aa, Artificial Sequence
  anti-HIV_119-015538_VR-Chain
QSVLTQPPSVSATPGQKVTISCSGSSSNIGNNYVSWYRRLPGTAPKHLIYETNNRPSGVPARLSAAKSGTSATLAITGLQTEDEADYYCATWSGSLNIGTGTKVTVL

SEQ ID NO: 2514 - protein, 107 aa, Artificial Sequence
  anti-HIV_119-015455_VR-Chain
QSVLTQPPSVSATPGQKVTISCSGSNSNIGNKDVSWYQHFPGTAPKLLIYENNKRPSGIPDRFSGSKSATSATLTITGLQTEDEADYYCATWSGSLNIGTGTKVTVL

SEQ ID NO: 2515 - protein, 107 aa, Artificial Sequence
  anti-HIV_119-014425_VR-Chain
QSVLTQPPSVSAAPGQKVTISCSGGTSNIGNNYVSWYQHLPGTAPKLLIYENNKRPSGIPDRFSGAKSGTSATLAITGLQTGDEGDYYCATWSGSLNIGTGTKVTVL

SEQ ID NO: 2516 - protein, 108 aa, Artificial Sequence
  anti-HIV_119-013582_VR-Chain
QSMVTQSPSVSAAPGQKVTISCSGTSSNIGQNYVSWYQQLPGTAPKLLISENNRRPSGTPDRFSGSKSGTSATLAITGLQTGDEADYYCETWDGSGGVFGTGTKVTVL

SEQ ID NO: 2517 - protein, 111 aa, Artificial Sequence
  anti-HIV_119-013364_VR-Chain
QSVLTQPPSVSAAPGQKVTISCSGSSSNIGNNYVSWYQQLPGTAPKLLIYDNNKRPSGIPDRFSGSKSGTSATLAITGLHTGDEADYYCTVWGVRKGVGAVFGTGTKVTVL

SEQ ID NO: 2518 - protein, 111 aa, Artificial Sequence
  anti-HIV_119-012886_VR-Chain
QSILTQPPSVSAAPGQKVTISCSGSSSTIGTNYVSWYQQFPGTAPKLLVFETHRRPSGIPDRFSGSKSGTSATLAITGLQTGDEADYYCAVWGVRRGVGAVFGAGTKVTVL

SEQ ID NO: 2519 - protein, 111 aa, Artificial Sequence
  anti-HIV_119-012249_VR-Chain
QSVLTQPPSVSGAPGQKVTISCSGSSSNIGRNYVSWYQQLPGTAPKLLIYENNKRPSGIPDRFSGSKSGTSATLVITGLQTGDEADFYCGTWDGSLSGGGVIGTGTRVTVL

SEQ ID NO: 2520 - protein, 108 aa, Artificial Sequence
  anti-HIV_119-012161_VR-Chain
QSFLTQPPSVSAAPGQKVTISCSGSNSNIGKNYVSWYQYLPGTVPKLLIYENDKRPSGIPGRFSASKSGTSATLAITGLQTGDEADYYCGTWDGSGGVFGTGTKVTVL

SEQ ID NO: 2521 - protein, 108 aa, Artificial Sequence
  anti-HIV_119-012110_VR-Chain
QSVLTQPPSVSAAPGQTVTISCSGSTSNIGKNDVSWYQQLPGTAPKLLISENNRRPSGTPDRFSGSKSGTSATLAISGLQTGDEADYYCGTWDGSGGVFGTGTKVTVL

SEQ ID NO: 2522 - protein, 111 aa, Artificial Sequence
  anti-HIV_119-012100_VR-Chain
QAVLTQPPSVSAAPGQKVAISCSGSSSNIGNNYVSWYQQLPGTVPKLLIYDTDKRPSGIPDRFSGSKSGTSATLGITRLQTGDEADYYCATWAPRLNSARVFGNGTMVTVL

SEQ ID NO: 2523 - protein, 108 aa, Artificial Sequence
  anti-HIV_119-011651_VR-Chain
QSVLTQPPSVSAAPGQKVTISCSGNSSNIGNNYVSWYQQLPGTAPKLLIYENNKRPSGIPDRFSGSKSGTSATLAITGLQTGDEADYYCATWDGRVSVFGTGTKVAVL

SEQ ID NO: 2524 - protein, 111 aa, Artificial Sequence
  anti-HIV_119-011479_VR-Chain
QSVLTQPPSVSATPGQKVTISCSGSNSNIGNKYVSWYQHFPGTAPKLLIYENNRRPSGIPDRFSGSKSGTSATLAITGLQTGDEADYYCTIWGVRKGVGAVFGTGTKVTVL

SEQ ID NO: 2525 - protein, 111 aa, Artificial Sequence
  anti-HIV_119-011232_VR-Chain
QSVLTQPPSVSAAPGQNVNISCSGGSSNIGSNYVSWYQQFPGTAPKLLIYDDDKRPSGIPHRFSASKSGTSATLAISGLQTGDEADYCCAVWGVRRGAGAVFGAGTKVTVL

SEQ ID NO: 2526 - protein, 111 aa, Artificial Sequence
  anti-HIV_119-011175_VR-Chain
QSVLTQPPSVSAAPGQKVTISCSGSNSYIGNKYVSWYQQFPGTAPKLLIYENNRRPSGIPDRFSGSKSGTSATLAISGLQTGDEADYCCAVWGVRRGAGAVFGPGTKVTVL

SEQ ID NO: 2527 - protein, 107 aa, Artificial Sequence
  anti-HIV_119-008396_VR-Chain
QSVLTQPPSVSAAPGQKVTISCSGSSSNIGNNYVSWYQQVPGTAPKLLVYENTRRPSGVPDRFSGAKSGTSATLAITGLQTGDEGDYYCATWSGSLNIGTGTKVTVL

SEQ ID NO: 2528 - protein, 108 aa, Artificial Sequence
  anti-HIV_119-007148_VR-Chain
QSVLTQPPSVSAAPGQKVTISCSGSTSNIGKNYVSWYQHLPGTAPKLLLYENDRRPSGTPDRFSGSKSGTSATLAITGLHTGDEADYYCETWDGSGGVFGTGTKVTVL

SEQ ID NO: 2529 - protein, 111 aa, Artificial Sequence
  anti-HIV_119-007029_VR-Chain
QSVLTQPPSVSAAPGQKVTISCSGNSSNIGNNFVSWYQQVPGTAPKLLLYETYRRPSGISDRFSGSKSGTSATLAITGLQTGDEADYYCTVWGVRKGVGAVFGTGTKVTVL

SEQ ID NO: 2530 - protein, 108 aa, Artificial Sequence
  anti-HIV_119-004707_VR-Chain
QSVLTQPPSVSAAPGQKVTISCSGSTSNIGKNDVSWYQQLPGTAPKLLISENNRRPSGTPDRFSGSKSGTSATLAITGLQTGDEADYYCETWDGSGGVFGTGTKVTVL

SEQ ID NO: 2531 - protein, 111 aa, Artificial Sequence
  anti-HIV_119-003910_VR-Chain
QSVLTQPPSVSAAPGQKVAISCSGNTSSIGNNFVSWYQQVPGTAPKLLVYETYRRPSGIPDRFSGSKSGTSATLAITGLQTGDEADYYCTVWGVRKGVGAVFGTGTKVTVL

SEQ ID NO: 2532 - protein, 107 aa, Artificial Sequence
  anti-HIV_119-002450_VR-Chain
QSVLTQPPSVSGAPGQRVTISCTGSSSNIGNNYVSWYQGLPGTAPKLLIYENNKRPSGIPDRFSGAKSGTAATLAITGLQTGDEADYYCATWSGSLNFGTGTKVTVL

SEQ ID NO: 2533 - protein, 107 aa, Artificial Sequence
  anti-HIV_119-001552_VR-Chain
QSVLTQPPSVSAAPGQKVTISCSGSNSYLGNKYVSWYQQFPGTAPKLLIYENNKRPSGIPDRFSASKSAASATLAITGLQTGDEGDYYCATWTGSLNIGTGTKVTVL

SEQ ID NO: 2534 - protein, 111 aa, Artificial Sequence
  anti-HIV_059-188169_VR-Chain
QSVLTQPPSVSAAPGQKVTISCSGSTSNIGDNYVSWYQQVPGTAPKLLIYENNRRPSGTPDRFSGSKSGTSATLAITGLQTGDEADYYCGTWDTSLSTGGVFGTGTKVTVL

SEQ ID NO: 2535 - protein, 111 aa, Artificial Sequence
  anti-HIV_059-183739_VR-Chain
QSVLTQPPSVSAAPGQKVTISCSGSTSNIGKNYVSWYQQLPGTAPKLLIYENNRRPSGTPDRFSGSKSGTSATLGISGLQTGDEADYYCGTWDTSLSGGGVFGTGTKVTVL

SEQ ID NO: 2536 - protein, 111 aa, Artificial Sequence
  anti-HIV_059-182376_VR-Chain
QSVLSQPPSVSAAPGQKVTISCSGSSSNIGNYYVSWYQQFPGTAPKLLIYKNDNRPSGIPDRFSGSKSGTSATLGISGLQTGDEADYYCGTWGTSLSGGGVFGTGTKVTVL

SEQ ID NO: 2537 - protein, 111 aa, Artificial Sequence
  anti-HIV_059-182199_VR-Chain
QSVLTQPPSVSAAPGQNITISCSGSSSNIGSHSISWYQHLPGTAPKIVIYDNDKRPLGIPDRFSGSKSGTSATLGITGLQTGDEADYYCGTWDTSLSGGGVFGPGTKVTVL

SEQ ID NO: 2538 - protein, 108 aa, Artificial Sequence
  anti-HIV_059-169202_VR-Chain
HSVLTQPPSVSAAPGQKVTISCSGSSSKIGNNFVSWYQQLPGTAPKLLIYENNKRPSGIPDRFSGSKSGTSATLAITGLQTGDEADYYCGTWDGRVSVIGSGTKLTVL

SEQ ID NO: 2539 - protein, 108 aa, Artificial Sequence
  anti-HIV_059-155645_VR-Chain
QSALTQPASVSGSPGQSITISCTGTSSDVGYNYVSWYQQLPGTAPKLLIYENNKRPSGIPDRFSGSKSGTSATLAITGLQTGDEADYYCGTWDGRLSVIGTGTKVTVL

SEQ ID NO: 2540 - protein, 111 aa, Artificial Sequence
  anti-HIV_059-151619_VR-Chain
QSVLTQPPSVSAAPGQKVTISCSGSSSNIGNNFVSWYQLLPGTPPKLLIFKNNERPSGIPDRFSGSKSGTSATLGITGLQTGDEGDYYCGTWDTSLSGGGVFGTGTRVTVL

SEQ ID NO: 2541 - protein, 111 aa, Artificial Sequence
  anti-HIV_059-146503_VR-Chain
QSVLTQPPSVSATPGQKVTISCSGSASNIGNNYVSWYQQFPGTAPKLLIYDTNKRPSGIPDRFSGSKSGTSAILGITGLQIGDEADYYCGTWDTSLSGGGVFGTGTKVTVL

SEQ ID NO: 2542 - protein, 108 aa, Artificial Sequence
  anti-HIV_059-136098_VR-Chain
QSVLTQPPSVSAAPGQRVTISCSGSSSNIGNNYVSWYQQLPGTAPKLLIYENNRRPSGIPDRFSGSKSGTSATLAITGLQTGDEGDYYCARWDGRLSVIGSGTKVTVL

SEQ ID NO: 2543 - protein, 111 aa, Artificial Sequence
  anti-HIV_059-105516_VR-Chain
QSALTQPPSVSAAPGQKVTISCSGSSSNIGNNYVSWYQQLPGTAPKLLIYDNNKRPSGIPDRFSGSKSGTSATLAIAGLQTGDEANYYCGTWDGSLRTGGVFGTGTKVTVL

SEQ ID NO: 2544 - protein, 111 aa, Artificial Sequence
  anti-HIV_059-095709_VR-Chain
QSVLTQPPSVSAAPGQKVTISCSGRSSNIGNNFVSWYQLLPGTAPKLLIYKNNERPSGIPDRFSASKSGTSATLGITGLQTGDEADYYCGTWDTSLSGGGVFGTGTKVTVL

SEQ ID NO: 2545 - protein, 111 aa, Artificial Sequence
  anti-HIV_059-069468_VR-Chain
QSVLTQPPSVSGAPRQSVIISCTGSSSNIGGFDVHWYQQLPGTAPKLLIYENNRRPSGTPDRFSGSKSGTSATLAITGLQTGDEADYYCGTWDGSLSTGGVIGTGTKVTVL

SEQ ID NO: 2546 - protein, 111 aa, Artificial Sequence
  anti-HIV_059-060026_VR-Chain
QSVLTQPPSVSAAPGQKVTISCSGSSSNIGNNYVSWYQQLPGTVPKLLIYKNDKRPSGIPDRFSGSKSATSATLGITGLQTGDEADYYCGIWDTSLSAGGVFGTGTRVTVL

SEQ ID NO: 2547 - protein, 111 aa, Artificial Sequence
  anti-HIV_059-053668_VR-Chain
QSVLTQPPSVSAAPGQKVTISCSGSSSNIGNNYVSWYQQLPGTAPKLLIYENNKRSSGIPDRFSGSKSGTSATLAITGLQTGDEADYYCGTRDSSLSGGGVIGTGTKVTVL

SEQ ID NO: 2548 - protein, 111 aa, Artificial Sequence
  anti-HIV_059-052864_VR-Chain
QSVLTQPPSLSAAPGQRVTISCSGSSSNIGNNYVSWYQQLPGTAPKLLIYESNKRPSGTPDRFSGSKSGTSATLAITGLQTGDEADYYCGTWDASLSSGGVMGTGTKVTVL

SEQ ID NO: 2549 - protein, 111 aa, Artificial Sequence
  anti-HIV_059-050968_VR-Chain
QSVLTQAPSVSAAPGEKVTISCSGTSSNIGYYYVSWYQQFPGTAPKVVIYENNRRPSGTPDRFSGSKSGTSATLAITGLQTGDEADYYCGTWGGSLSTGGVIGTGTKVTVL

SEQ ID NO: 2550 - protein, 111 aa, Artificial Sequence
  anti-HIV_059-046422_VR-Chain
QSVLTQPPSVSAAPGQKVTISCSGSSSTIGNNYISWYQLLPGTPPNYLIFKISERPSGVPDRFSGSKSGTSATLHITGLQTGDEGDYYCGTWDTSLSGGGVFGTGTKVTVL

SEQ ID NO: 2551 - protein, 111 aa, Artificial Sequence
  anti-HIV_059-045120_VR-Chain
QSVLTQPPSVSAAPGQKVAISCSGSSSTIGNNYVSWYQLLPGTPPKLLIFKSHERPSGIPDRFSGSKSGTSATLGITGLQTGDEGDYYCGTWDSSLSVGGVFGTGTKVTVL

SEQ ID NO: 2552 - protein, 111 aa, Artificial Sequence
  anti-HIV_059-039932_VR-Chain
QSVLTQPPSVSAAPGQKVTISCSGSSSIIGKNYVSWYQHLPGTAPKLLIYENNKRPSGIPDRFSGSKSGTSATLAIAGLQTGDEANYYCGTWGGSLSTGGVFGTGTKVTVL

SEQ ID NO: 2553 - protein, 111 aa, Artificial Sequence
  anti-HIV_059-038595_VR-Chain
QSVLTQPPSVSAAPGQKVTISCSGRSSNIGNNFVSWYQQLPGTAPKLLIYENNKRPSGIPDRFSGSKSGTSATLGITGLQTGDEADYYCGTWDTSLSAGGVFGSGTKVIVL

SEQ ID NO: 2554 - protein, 111 aa, Artificial Sequence
  anti-HIV_059-035082_VR-Chain
QSVLTQPPSVSAAPGQKVTISCSGSTSNIGKSFVSWYQQLPGTAPKLLIYDNNRRPSGTPDRFSGSKSGTSATLAITGLQTGDEADYYCGTWGGSLSTGGVIGTGTKVTVL

SEQ ID NO: 2555 - protein, 111 aa, Artificial Sequence
  anti-HIV_059-029204_VR-Chain
QSVLTQPPSVSAAPGQKVTISCSGSTSNIGKILVSWYQQLPGTAPKPSIYDNNRRPSGTPDRFSGSKSGTSATLAITGLQTGDEADYYCGTWDGSLSTGGVIGTGTKVTVP

SEQ ID NO: 2556 - protein, 108 aa, Artificial Sequence
  anti-HIV_059-025235_VR-Chain
QSVLTQPPSVSGAPGQKITISCSGSTSNIGKSYVSWYQQLPGTAPKLLIYENNRRPSGTPDRFSGSKSGTSATLAITGLQTGDEADYYCGTWDGSGGVIGTGTKVTVL

SEQ ID NO: 2557 - protein, 111 aa, Artificial Sequence
  anti-HIV_059-015192_VR-Chain
QSVLTQPPSVSAAPGQKVTISCSGSSSTIGDKYVSWYQLLPGTAPKLLIYKNNKRPSGIPDRFSGSKSGTSATLGITGLQTGDEADYYCGTWDTSLSVGGVFGTGTKVTVL

SEQ ID NO: 2558 - protein, 111 aa, Artificial Sequence
  anti-HIV_059-007060_VR-Chain
QSVLTQPPSVSAAPGQKVTISCSGSSSNIGNKYVSWYQQLPGTAPKLLIYENKKRPSGIPDRFSGSKSGTSATLGITGLQTGDEADYFCGTWDTSLSGGGVFGSGTKVTVL

SEQ ID NO: 2559 - protein, 108 aa, Artificial Sequence
  anti-HIV_059-006953_VR-Chain
QSVLTQPPSVSAAPGQKVTISCSGSSSNIGVSWYQQVPGTAPKLLIYDNDKRPTGIPDRFSGSKSGTSAILAITGLQTGDEGDYYCGTWETSLSGGGVFGTGTKVTVL

SEQ ID NO: 2560 - protein, 111 aa, Artificial Sequence
  anti-HIV_059-005953_VR-Chain
HSVLTQPPSVSAAPGQKVTISCSGTSSNIGKNYVSWYQQLPGTAPKLLIYENNRRPSGTPDRFSGSKSGTSATLAITGLQTGDEADYYCGTWDTSLSTGGVFGTGTKVTVL

SEQ ID NO: 2561 - protein, 108 aa, Artificial Sequence
  anti-HIV_059-003725_VR-Chain
QSVLTQPPSVSAAPGQKLTISCSGSTSKIGNNYVSWYQHLPGTAPKLLVYENNKRPSGIPDRFSGSKSGTSATLAITGLQTGDEADYYCGTWDGRLSVIGTGTKVTVL

SEQ ID NO: 2562 - protein, 111 aa, Artificial Sequence
  anti-HIV_059-002618_VR-Chain
QLVLTQPPSVSAAPGQKVTISCSGSSSNIGNNFVSWYQQLPGTAPKLLIYENNKRPSGIPDRFSGSKSGTSATLGITGLQTGDEADYYCGTWDTRLSAGGVFGTGTKVTVL

SEQ ID NO: 2563 - protein, 108 aa, Artificial Sequence
  anti-HIV_059-001522_VR-Chain
QSVLTQPPSVSAAPGQKVTISCSGSNSNIGNNYVSWYQQLPGTAPKLLIYENNKRPSGIPDRFSGSKSGTSATLAITGLQTGDEADYYCGTWDGRLSVIGAGTKVIVV

SEQ ID NO: 2564 - protein, 111 aa, Artificial Sequence
  anti-HIV_059-000731_VR-Chain
QSVLTQPPSVSAAPGQKVTISCSGSTSNIGNKYVSWYQQVPGTAPKLLIYENNRRPSGIPDRFSGSKSGTSATLAITGLQTGDEADYYCGTWDASLRTGGVIGTGTKVTVL

SEQ ID NO: 2565 - protein, 111 aa, Artificial Sequence
  anti-HIV_059-000634_VR-Chain
QSVLTQPPSVSAAPGQKVTISCSGSSSTIGNNYVSWYQVVPGTAPKLLIYKINERPSGIPDRFSGSKSGTSATLGITGLQTGDEADYYCGTWDTSLSGGGVFGPGTKVTVL

SEQ ID NO: 2566 - protein, 111 aa, Artificial Sequence
  anti-HIV_048-250757_VR-Chain
QSVLTQPPSVSGAPGQRVTISCTGTTSNIGSNYVAWYQQLPGTAPKLLIYDNDKRPSGIPDRFSGSKSGTSATLGITGLQTGDEADYYCGTWDTSLSAGGVFGTGTKVTVL

SEQ ID NO: 2567 - protein, 111 aa, Artificial Sequence
  anti-HIV_048-250716_VR-Chain
QSVLTQPPSVSAAPGQKVTISCSGSSSNIGNKYVSWYQQLPGTAPKLLIYENSKRPSGIPDRFSGSKSGTSATLGITGLQTGGQADYYCGTWDTSLSAGGVFGSGTKVTVL

SEQ ID NO: 2568 - protein, 111 aa, Artificial Sequence
  anti-HIV_048-250463_VR-Chain
QSVLTQPPSVSAAPGQKVTISCSGSRSNNGNNYVSWYQQLPGTAPKLLIYENNKRPSGIPDRFSGSKSGTSATLAITGLQTGDEADYYCGTWDSSLSGGGVIGTGTKLTVL

SEQ ID NO: 2569 - protein, 111 aa, Artificial Sequence
  anti-HIV_048-248153_VR-Chain
QSALTQPASVSASFGQSITISCTGAASDVGYNYVSWYQQLPGTTPKLLIYRNNQRPSGIPDRFSGSKSGTSATLGITGLQTGDEADYYCGTWDTSLSAGGVFGTGTKVTVL

SEQ ID NO: 2570 - protein, 111 aa, Artificial Sequence
  anti-HIV_048-247532_VR-Chain
QSVLTQPPSVSAAPGQQVTISCSGTTSNIGTNYVSWYQQMPPAAPKLLIYDNKKRPSDIPDRFSGSKSGTSATLGITGLQTGDEADYYCGTWDTSLSAGGVFGTGTKVTVL

SEQ ID NO: 2571 - protein, 111 aa, Artificial Sequence
  anti-HIV_048-245846_VR-Chain
QSVLTQPPSVSATPGQRVTISCTGSSSNIGGYDVSWYQVLPGTAPKLLIYDSDKRPSGIPDRFSGSQSGTSATLGITGLQTGDEADYYCGTWDTSLSGGGVFGTGTKVTVL

SEQ ID NO: 2572 - protein, 111 aa, Artificial Sequence
  anti-HIV_048-244016_VR-Chain
QSVLTQPPSVSGAPGQRVTISCTGSSSNIGGYDVHWYQQLPGTAPKLLIYKNDKRPSGIPDRFSGSKSGTSAILGITGLQTGDEADYYCGAWDTSLSAGGVFGTGTKVTVL

SEQ ID NO: 2573 - protein, 111 aa, Artificial Sequence
  anti-HIV_048-243682_VR-Chain
QSLLTQPPSVSAAPGQKVTISCTGSSSNIGGYDVHWYQQLPGTAPKLLIYENNKRPSGIPDRFSGSKSGTSATLGITGLQTGDEADYYCGTWDSSLSAGGVFGTGTKVTVL

SEQ ID NO: 2574 - protein, 111 aa, Artificial Sequence
  anti-HIV_048-243588_VR-Chain
QSLLTQPPSVSAPPGQMVSISCSGSSHNIGDNYVSWYQHLPGTAPKLLIYDNNSRPSGIPDRFSGSKSGTSATLGITGLQTGDEADYYCGTWDTSLSGGGVFGTGTKVTVL

SEQ ID NO: 2575 - protein, 111 aa, Artificial Sequence
  anti-HIV_048-241775_VR-Chain
QSVLAQPPSVSGAPGQRVTISCTGSSSNIGEYDVHWYQQLPGTAPKLLIYENNKRPSGIPDRFSGSKSGTSATLGITGLQTGDEADYYCGTWDSSLSAGGVFGTGTKVTVL

SEQ ID NO: 2576 - protein, 111 aa, Artificial Sequence
  anti-HIV_048-237996_VR-Chain
QSVLTQPPSVSGAPGQRVTISCTGSSSNIGGYDVHWYRQLPGTAPKLLIYDTVKRPSGIPDRFSGSKSGTSATLGITGLQTGDEADYYCGTWDTSLSAGGVFGTGTKVTVL

SEQ ID NO: 2577 - protein, 110 aa, Artificial Sequence
  anti-HIV_048-237730_VR-Chain
SVLTQPPSVSGAPGQRVTISCTGTNSNFGSNYAHWYQQVPGTAPKLLIYSNNARPSGIPDRFSGSKSGTSATLGITGLQTGDEADYYCGTWDTSLSAGGVFGTGTKVTVL

SEQ ID NO: 2578 - protein, 111 aa, Artificial Sequence
  anti-HIV_048-237253_VR-Chain
QSVLTQPPSVSAAPGQKVTVSCSGSSSNIGSNDVSWYQQFPGAAPKLLIYKNNERPSGIPDRFSGSKSGTSATLGITGLQTGDEADYYCGTWDTSLSAGGVFGTGTKVTVL

SEQ ID NO: 2579 - protein, 111 aa, Artificial Sequence
  anti-HIV_048-234100_VR-Chain
QSMLTQPPSVSAAPGEKVTISCSGSSSNIGKTFVSWYQQVPGTAPKLLIYKNDNRPSGIPDRFSGSKSGTSATLGISGLQTGDEADYYCGTWDTSLSGGGVFGTGTKVTVL

SEQ ID NO: 2580 - protein, 111 aa, Artificial Sequence
  anti-HIV_048-230882_VR-Chain
QSVLTQPPSVSAAPGQKVTISCSGNSSNIGSNFVSWYQQLPGTAPKLLIYENNKRPSGIPDRFSGSKSGTSATLGITGLQTGDEADYYCGTWDTSLSPGGVFGTGTKVTVL

SEQ ID NO: 2581 - protein, 111 aa, Artificial Sequence
  anti-HIV_048-229473_VR-Chain
QSVLTQPPSVSAAPGQKVTISCSGSSSNIGNNYVSWYQQFPGTAPKLLIYENNKRPSGIPDRFSGSKSGTTATLAITRLQTGDEADYYCGTWGGSLSAGGVFGTGTKVTVL

SEQ ID NO: 2582 - protein, 111 aa, Artificial Sequence
  anti-HIV_048-228238_VR-Chain
QSVLTQPPSVSAAPGQKVTISCSGSSSNIGINYVSWYQQLPGTAPKLLIYDNTKRPQGIPDRFSGSKSGTSATLAITGLQTGDEADYYCGTWDGSLSTGGVIGTGTKVTVL

SEQ ID NO: 2583 - protein, 111 aa, Artificial Sequence
  anti-HIV_048-228027_VR-Chain
QSLLTQSPSASGPPGQRVTISCSGSNSNIGSNTVNWYHHLPGAAPKLLIYENSKRPSGIPDRFSGSKSGTSATLGITGLQTGDEADYYCGTWDTSLSAGGVFGSGTKVTVL

SEQ ID NO: 2584 - protein, 111 aa, Artificial Sequence
  anti-HIV_048-227795_VR-Chain
QSVLTQPPSVSAAPGQKVTISCSGSSSNIESRSVHWYQQKPGQAPVLVIYYDSDRPSGIPDRFSGSKSGTAATLGITGLQTGDEADYYCGTWDTSLSAGGVFGTGTKVTVL

SEQ ID NO: 2585 - protein, 111 aa, Artificial Sequence
  anti-HIV_048-227770_VR-Chain
QSVLTQPPSVSGAPGQRVTISCTGSSSNIGPRDVHWYQQLPGTVPKLLIYDTYTRPSGIPDRFSGSKSGASATLDITGLQTGDEADYYCGIWDTSLSAGGVFGTGTKVTVL

SEQ ID NO: 2586 - protein, 111 aa, Artificial Sequence
  anti-HIV_048-225298_VR-Chain
QSALTQPRSVSGSPGQSVTISCTGTSNDVGYDYVSWYQQLPGTAPKLLIYDINKRPSGIPDRFSGSKSGTSATLGITGLQTGDEADYYCGTWDTSLSAGGVFGTGTKVTVL

SEQ ID NO: 2587 - protein, 109 aa, Artificial Sequence
  anti-HIV_048-225090_VR-Chain
ELTQPPSVSGAPGQRVTISCTGSSSNIGGYDVHWYQQLPGTAPKLLIYDNNKRPSGIPDRFSGSKSGTSATLGITGLQTGDEADYYCGTWDTSLSTGGVFGTGTKVTVL

SEQ ID NO: 2588 - protein, 111 aa, Artificial Sequence
  anti-HIV_048-224187_VR-Chain
QSVLTQPPSASGTPGQRVTISCSGSSANIGTNYVFWYQHLPGTTPRLLIFRNNERPSGIPDRFSGSKSGTSATLGITGLQTGDEADYYCGTWDTSLSAGGVFGTGTKVTVL

SEQ ID NO: 2589 - protein, 111 aa, Artificial Sequence
  anti-HIV_048-223055_VR-Chain
QSVLTQPPSVSAAPGQKVTISCSGSSSNIGNNYVSWYQQFPGTAPKVLIYGNSKRPSGIPDRFSGSKSGTSATLGITGLQTGDEADYYCGTWDTSLSAGGVFGSGTKVTVL

SEQ ID NO: 2590 - protein, 111 aa, Artificial Sequence
  anti-HIV_048-222711_VR-Chain
QPVLTQPPSVSGAPGQRVTISCTGSSSNIGGYDVHWYQQVPGTAPKLLIFENNRRPSGIPDRFSGSKSGTSATLAITGLQTGDEADYYCGTWDGSLSTGGVIGTGTKVTVL

SEQ ID NO: 2591 - protein, 111 aa, Artificial Sequence
  anti-HIV_048-221209_VR-Chain
QSVLTQPPSVSGAPGQRVTISCTGNSSNIGDYDVHWYQQVAGTAPKLLIFKNNERPSGIPDRFSGSKSGTSATLGITGLQTGDEADYYCGTWDTSLSAGGVFGSGTKVTVL

SEQ ID NO: 2592 - protein, 111 aa, Artificial Sequence
  anti-HIV_048-220629_VR-Chain
QSALTQPASVSGSLGQSITISCTGTSRDVGYSYVSWYQHLPGTAPKLLIYENNKRPSGIPDRFSGSKSGTSATLGITGLQTGDEADYYCGTWDSSLSAGGVFGTGTKVTVL

SEQ ID NO: 2593 - protein, 111 aa, Artificial Sequence
  anti-HIV_048-219430_VR-Chain
QSVLTQPPSVSAAPGQMVTISCSGSTSNIGINYVSWYQHVPGTAPKLLIYDNNKRPSGIPDRFSGSKSGTSATLGITGLHTGDEADYYCGTWDTSLSAGGVFGTGTKVTVL

SEQ ID NO: 2594 - protein, 111 aa, Artificial Sequence
  anti-HIV_048-216250_VR-Chain
QSVLTQPPSVSAAPGQKVTISCTGTTSDFGYNCVSWYQQHPGRAPKVIISGVNKRPSGIPDRFSGSKSGTSATLGITGLQTGDEADYYCGTWDSSLSAGGVFGTGTKVTVL

SEQ ID NO: 2595 - protein, 107 aa, Artificial Sequence
  anti-HIV_048-216133_VR-Chain
TQPPSLSATPGQRVSISCSGGGSNIGNNDVFWFQQFPGAGPRLLIYDNHKRHYGTPDRFSGSKSGTSATLAITGLQTGDEAAYYCGTWDGSLSTGGVIGTGTKVTVL

SEQ ID NO: 2596 - protein, 111 aa, Artificial Sequence
  anti-HIV_048-214886_VR-Chain
QSALTQPRSVSGSPGQSVTISCTGTSSDVGYNYVSWYQHHPGTAPKLLIYKNNNRPSGIPDRFSGSKSGTSATLGITGLQTGDEADYYCGTWDTSLSAGGVFGTGTKVTVL

SEQ ID NO: 2597 - protein, 111 aa, Artificial Sequence
  anti-HIV_048-214709_VR-Chain
QSVLTQPPSVSAAPGQKVTISCSGSSSNIGNNYVSWYQQLPGTAPKLLIYENDRRPSGIPDRFSGSKSGTSATLGITGLQTGDEADYYCGTWDTSLSAGGVFGTGTKVTVL

SEQ ID NO: 2598 - protein, 111 aa, Artificial Sequence
  anti-HIV_048-214001_VR-Chain
QSVLTQPPSVSGAPGQTVTISCSGSNSNIGNHDVHWYQHVPGTAPKLLIYDNNKRPSGIPDRFSGSKSGTSATLGITGLQTGDEAEYYCATWDASLSGGGVFRTGTKVTVL

SEQ ID NO: 2599 - protein, 111 aa, Artificial Sequence
  anti-HIV_048-213230_VR-Chain
QSVLTQPPSMSAAPGQKVTISCSGSSNNIGKNVVSWYQQLPGTAPKVLIYENNKRLSGIPDRFSGSKSGTSATLVITGLQTGDEADYYCGTWDSSLSAGGVFGTGTKVTVL

SEQ ID NO: 2600 - protein, 111 aa, Artificial Sequence
  anti-HIV_048-212574_VR-Chain
QSVLTQPPSVSAAPGQRVTVSCSGSTSNIESNYVSWYQQVPGTAPKLLIYENNKRPSGIPDRFSGSKSGTSATLAITGLQTGDEAAYYCGTWDGSLSTGGVIGTGTKVTVL

SEQ ID NO: 2601 - protein, 111 aa, Artificial Sequence
  anti-HIV_048-212207_VR-Chain
QSVLTQPPSLSAAPGQKVTISCSGGSSNIGNNYVSWYQHLPGTAPKLLIYDNYKRPSGIPDRFSGSKSGTSATLDITGLQTGDEADYYCGTWDTSLSAGGVFGTGTKVTVL

SEQ ID NO: 2602 - protein, 111 aa, Artificial Sequence
  anti-HIV_048-209146_VR-Chain
QSVLTQPPSVSGAPGQKITVSCTGTTSNIGPHDVHWYQLVPGRPPKLLIFHNNIRPSGIPDRFSGSKSGMSATLGITGLQTGDEADYYCGTWDSSLSAGGVFGTGTKVTVL

SEQ ID NO: 2603 - protein, 111 aa, Artificial Sequence
  anti-HIV_048-208206_VR-Chain
QSVLTQPPSVSAAPGQKVTISCSGSSSNIGSNYVSWYQQFPGTAPRLLIYENDKRPSAIPDRFSGSKSGTSATLGITGLHTGDEADYYCGTWDGSLSTGGVIGTGTKVTVL

SEQ ID NO: 2604 - protein, 111 aa, Artificial Sequence
  anti-HIV_048-208194_VR-Chain
QSALTQPPSASGSPGQSVTISCTGTSSDIGYKYVSWYQLLPGTPPKLLIFKNNERPSGIPDRFSGSKSGTSATLGITGLQTGDEADYYCGAWDTSLSAGGVFGTGTKVTVL

SEQ ID NO: 2605 - protein, 111 aa, Artificial Sequence
  anti-HIV_048-207744_VR-Chain
QSALTQPASVSASFGQSITISCTGAASTIGNNLVSWYRLLPGTAPKLLIYKNDNRPSGIPDRFSGSKSGTSATLGISGLQTGDEADYYCGTWDTSLSGGGVFGTGTKVTVL

SEQ ID NO: 2606 - protein, 111 aa, Artificial Sequence
  anti-HIV_048-206501_VR-Chain
QSVLTQPPSVSGAPGQRVTISCSGSSSNIGNNAVNWYQQLPGKAPKLLIYENNKRPSGIPDRFSGSKSGTSATLGITGLQTGDEADYYCGTWDSSLSAGGVFGTGTKVTVL

SEQ ID NO: 2607 - protein, 111 aa, Artificial Sequence
  anti-HIV_048-204221_VR-Chain
QSVLTQPPSASGTPGQRVTISCFGSSSNIASSAVNWYQQLPGTAPKLLIYKNDKRPSGIPDRFSGSKSGTSATLGITGLQTGDEADYYCGTWDTSLSAGGVFGTGTKVTVL

SEQ ID NO: 2608 - protein, 111 aa, Artificial Sequence
  anti-HIV_048-204015_VR-Chain
QSVLTQPPSASGTPGQRVTISCSGSSSNIGSKYVYWYQQLPGTAPKLLIYKNDNRPSGIPDRFSGSKSGTSATLGISGLQTGDEADYYCGTWDTSLSGGGVFGTGTKVTVL

SEQ ID NO: 2609 - protein, 111 aa, Artificial Sequence
  anti-HIV_048-201240_VR-Chain
QSVLTQPPSVSAAPGQKVTISCSGSSSNIGNNYVAWYQQLPGTAPKLLIKENSQRPSGIPDRFSGSKSGTSATLAITGLQTGDEADYYCGTWDTSLSTGGVFGTGTKVTVL

SEQ ID NO: 2610 - protein, 111 aa, Artificial Sequence
  anti-HIV_048-200455_VR-Chain
QSALTQPASVSGSPGQSITISCTGTSSDVGYNYVSWYQVLPGTAPKLLIYKNTERPSGIPDRFSGSKSGTSATLDITGLQTGDEADYYCGTWDTSLSAGGVFGTGTKVTVL

SEQ ID NO: 2611 - protein, 111 aa, Artificial Sequence
  anti-HIV_048-200319_VR-Chain
QSVVTQPPSASGTPGQRVTISCSGSSSNIGSKYVYWYHQHPGTAPKLLIYDNNNRPSGIPDRFSGSKSGTSATLGITGLQTGDEADYYCGTWDTSLSRGGVFGTGTKVTVL

SEQ ID NO: 2612 - protein, 111 aa, Artificial Sequence
  anti-HIV_048-197896_VR-Chain
QSVLTQPPSVSAAPGQKVTISCSGASYNIGKNSVSWYQQLPGTPPKLLIFKNNERPSGIPDRFSGSKSGTSATLGITGLQTGDEADYYCATWDTSLSAGGVFGTGTKVTVL

SEQ ID NO: 2613 - protein, 111 aa, Artificial Sequence
  anti-HIV_048-193813_VR-Chain
QSVLTQSPSVSAAPGQKVTISCSGSNSNVGNYYVSWYQHLPGTAPKVLIYEGNKRPSGVPDRFSGSKSGTSASLAITGLQTGDEADYYCGTWDTSLSAGGVFGSGTKVTVL

SEQ ID NO: 2614 - protein, 111 aa, Artificial Sequence
  anti-HIV_048-192098_VR-Chain
QSVLTQPPSASGTPGQRVTISCSGSTSNIGSNYVYWYQQLPGTTPKLLIYENNKRPSGITDRFFGSKSGPSATLDITGLQTGDEADYYCGTWDASLSAGGVFGTGTKVTVL

SEQ ID NO: 2615 - protein, 111 aa, Artificial Sequence
  anti-HIV_048-191786_VR-Chain
QSVLTQPPSVSAAPGQNVNISCSGSSSNIENNFVSWYQKLPGTAPKLLIYDNNKRPSGIRDRFSGSKSGTSATLGITGLQTGDEADYYCGTWDTSLSAGGVFGSGTKVTVL

SEQ ID NO: 2616 - protein, 111 aa, Artificial Sequence
  anti-HIV_048-188746_VR-Chain
QSVLTQPPSASGTPGQKVTISCSGSNSNIGSNFVSWYQLLPGTTPKLLIYRNNQRPSGVPDRFSGSKSGTSATLGITGLQTGDEADYYCGTWDSSLSAGGVFGTGTKVTVL

SEQ ID NO: 2617 - protein, 111 aa, Artificial Sequence
  anti-HIV_048-185937_VR-Chain
QSVLTQPPSVSAAPGQKVTISCSGSSSNIGNNYVSWYQQLPGTAPKLLIYENNKRPSGIPYPISGSKSGTSATLGITGLQTGDEADYYCGTWDSSLSAGGVFGTGTKVTVL

SEQ ID NO: 2618 - protein, 111 aa, Artificial Sequence
  anti-HIV_048-184849_VR-Chain
QSVLTQAPSASGTPGQTVTISCSGSSSNIGTKYVYWYQQLPGTAPKLLIYKNNERPSGIPDRFSGSKSGTSATLGITGLQTGDEADYYCGTWDTSLSPGGVFGTGTKVTVL

SEQ ID NO: 2619 - protein, 111 aa, Artificial Sequence
  anti-HIV_048-183089_VR-Chain
QSVLTQPPSASGTPGQRVTISCSGSSSNIGSSYVYWYQLLPGTPPKLLIFKNNERPSGIPDRFSGSKSGTSATLGITGLQTGDEADYYCGTWDTSLSAGGVFGTGTKVTVL

SEQ ID NO: 2620 - protein, 111 aa, Artificial Sequence
  anti-HIV_048-181509_VR-Chain
QSVLTQPPSVSGAPGQRVTISCTGSSSNIGGYDVHWYHQLPGAAPKLLIYKNDNRPSGIPDRFSGSKSGTSATLGISGLQTGDEADYYCGTWDTSLSGGGVFGTGTKVTVL

SEQ ID NO: 2621 - protein, 111 aa, Artificial Sequence
  anti-HIV_048-180990_VR-Chain
QSVLTQPPSVSAAPGQRVTISCSGSTSNIGNNYVSWYQHFPGKVPKVVISETTKRPSGIPDRFSGSKSGTSATLGITGLQTGDEADYYCGTWDSSLSAGGVFGTGTKVTVL

SEQ ID NO: 2622 - protein, 111 aa, Artificial Sequence
  anti-HIV_048-177532_VR-Chain
QSALTQPPSASGSLGQSVTISCTGTSSDVGNNFVSWYQKKPGKAPKLIVYEVNKRPSGIPDRFSGSKSGTSATLGITGLQTGDEADYYCGTWDTSLSTGGVFGTGTKVTVL

SEQ ID NO: 2623 - protein, 108 aa, Artificial Sequence
  anti-HIV_048-177426_VR-Chain
LTQPHSVSESPGKTVTISCTGTSSDVGYNYVSWYQHHPGKAPKLLIYEVTKRPSGIPDRFSGSKSGTSATLGITGLQTGDEADYYCGTWDSSLSAGGVFGTGTKVTVL

SEQ ID NO: 2624 - protein, 111 aa, Artificial Sequence
  anti-HIV_048-177389_VR-Chain
QSVLTQPPSMSAAPGERVTISCSGSSSNIGNHHVSWYQQRPGTAPKLLIYENNERPSGIPDRFSGSKSGTSATLGITGLQTGDEADYYCGTWDTSLSAGGVFGSGTKVTVL

SEQ ID NO: 2625 - protein, 111 aa, Artificial Sequence
  anti-HIV_048-174266_VR-Chain
QSVLTQPPSVSGAPGQRVTISCSGSSSNIGSHYVSWYQQVPGTAPRLVIYDTIKRHSGIPDRFSGSKSGTSATLGITGLQTGDEADYYCGTWDTSLSAGGVFGTGTKVTVL

SEQ ID NO: 2626 - protein, 111 aa, Artificial Sequence
  anti-HIV_048-172847_VR-Chain
QSVLTQPPSVSAAPGQRVTVSCSGSTSNIESNYVSWYQQVPGTAPKLLIYENNKRPSGIPDRFSGSKSGTSATLGITGLQTGDEADYYCGTWDTSLSAGGVFGTGTKVTVL

SEQ ID NO: 2627 - protein, 111 aa, Artificial Sequence
  anti-HIV_048-172845_VR-Chain
QSALTQPPSASGSPGQSVTISCTGTSSDVGYNYVSWYQQLPGTAPKLLIYRNNQRPSGVPDRFSGSKSGTSATLGITGLQTGDEADYYCATWDTSLSAGGVFGTGTKVTVL

SEQ ID NO: 2628 - protein, 111 aa, Artificial Sequence
  anti-HIV_048-172363_VR-Chain
QSVLTQPPSVSAAPGQKVTISCSGSGSNIGNTYVSWYQQLPGTAPKLLIFEDNKRPSGIPDRFSGSKSGTSATLAITGLQTGDEADYYCGTWDSSLSGGGVIGTGTKLTVL

SEQ ID NO: 2629 - protein, 111 aa, Artificial Sequence
  anti-HIV_048-171609_VR-Chain
QSVLTQPPSVSAAPGQEVTISCSASSSSIGNDFVSWYQQLPGTAPKLLIYGNSNRPSGIPDRFSGSKSGTSATLGITGLQTGDEADYYCGTWDTSLSTGGVFGTGTKVTVL

SEQ ID NO: 2630 - protein, 111 aa, Artificial Sequence
  anti-HIV_048-170705_VR-Chain
QSVLTQPPSVSAAPGQMVTISCSGSTSNIGINYVSWYQHVPGTAPKLLIYENVERRSGIPDRFSASKSATSATLGITGLQTGDEADYYCGTWDTSLSAGGVFGSGTKVTVL

SEQ ID NO: 2631 - protein, 111 aa, Artificial Sequence
  anti-HIV_048-168381_VR-Chain
QSALTQPASVSGSPGQSITISCTGTSSNIGSNYVSWYQQLPGTAPKLLIYENNQRPSGIPDRFSGSKSGTSATLGITGLQTGDEADYYCGTWDTSLSAGGVFGSGTKVTVL

SEQ ID NO: 2632 - protein, 111 aa, Artificial Sequence
  anti-HIV_048-166619_VR-Chain
QSVLTQPPSVSGAPGQRVTISCTGSSSNIGGYHTHWYQQLPGTAPKLLIYENSKRPSGIPDRFSGSKSGTSATLGITGLQTGDEADYYCGTWDTSLSAGGVFGSGTKVTVL

SEQ ID NO: 2633 - protein, 111 aa, Artificial Sequence
  anti-HIV_048-162036_VR-Chain
QSVLAQPPSVSGAPGQTVTISCTGSSSNIGGYDVHWYQQLPGTAPKLLIYKDDKRPSGIPDRFSGSKSGTSATLGITGLQTGDEADYYCGTWDTSLNRGGVFGTGTKVTVL

SEQ ID NO: 2634 - protein, 111 aa, Artificial Sequence
  anti-HIV_048-160042_VR-Chain
QSVLTQPPSVSAAPGQKVTISCSGSSSNIGINYISWYQQLPGTAPKILIYDNDKRPLGIPDRFSGSKSGTSATLGITGLQTGDEADYYCGTWDASLSAGGVFGTGTKVTVL

SEQ ID NO: 2635 - protein, 111 aa, Artificial Sequence
  anti-HIV_048-159676_VR-Chain
QSVLTQPPSVSASPGQKVTISCSGSSSDIGSNYVSWYVQLPGTAPKLLIYKNNERPSGIPDRFSGSKSGTSATLGITGLQTGDEADYYCGTWDTSLSAGGVFGTGTKVTVL

SEQ ID NO: 2636 - protein, 111 aa, Artificial Sequence
  anti-HIV_048-159500_VR-Chain
QSVLTQPPSVSAAPGQNVTISCSGSWSNIGANYVSWYQQLPGTAPKLLIYENNKRPSGIPDRFSGSKSGTSATLGFTGLQTGDEADYYCGTWDTSLSAGGVFGTGTKVTVL

SEQ ID NO: 2637 - protein, 111 aa, Artificial Sequence
  anti-HIV_048-159421_VR-Chain
QSLLTQAPSVSAAPGQTVTISCSGSNADIGKNFVSWYQQSPGAAPKLLIYENDRRPSGIPDRFSGSKSGTSATLGITGLQTGDEAEYYCATWDASLSGGGVFGTGTKVTVL

SEQ ID NO: 2638 - protein, 111 aa, Artificial Sequence
  anti-HIV_048-159333_VR-Chain
QSVLTQPPSASGTPGQRVTISCSGSNSNIGSDSVYWYQQLPGRSPKLLIYRNNERPSGIPDRFSGSKSGTSATLGITGLQTGDEADYYCGTWDTSLSAGGVFGTGTKVTVL

SEQ ID NO: 2639 - protein, 111 aa, Artificial Sequence
  anti-HIV_048-158932_VR-Chain
QSVLTQPASVSGSPGQSITISCSGSSSNIGDIFVSWYQQVPGAAPKLLIYDNDKRPSGIPDRFSGSKSGTSATLDITGLQTGDEADYYCGTWDTSLSAGGVFGTGTKVTVL

SEQ ID NO: 2640 - protein, 111 aa, Artificial Sequence
  anti-HIV_048-155811_VR-Chain
QSALTQPASVSGSPGQSITISCTGTSSDVGYDYVSWYQLLPGTPPKLLIFKNNERPSGIPDRFSGSKSGTSATLGITGLQTGDEADYYCATWDTSLSAGGVFGTGTKVTVL

SEQ ID NO: 2641 - protein, 111 aa, Artificial Sequence
  anti-HIV_048-155464_VR-Chain
QSALTQPASVSGSPGQSITISCTGATGDSGHTYVSWYQQLPGTAPKLLIYSNNERPSGVPDRFSGSKSGTSATLGITGLQTGDEADYYCGTWDTSLSAGGVFGSGTKVTVL

SEQ ID NO: 2642 - protein, 111 aa, Artificial Sequence
  anti-HIV_048-155392_VR-Chain
QSVLTQPPSVSAAPGQMVTISCSGSSSNIGDNYVSWYQQLPGRGPKLLVYDTYKRYLETPDRFSGSKSGTSATLGITGLQTGDEADYYCGTWDTSLSAGGVFGTGTKVTVL

SEQ ID NO: 2643 - protein, 111 aa, Artificial Sequence
  anti-HIV_048-155389_VR-Chain
QSVLTQPPSVSAAPGQKVTISCSGISSNIGNNPVSWYQQFPGTAPKLLIYKNDKRPSGIPDRFSGSKSGTSATLGITGLQTGDEADYYCGTWDTSLSTGGVFGTGTKVTVL

SEQ ID NO: 2644 - protein, 111 aa, Artificial Sequence
  anti-HIV_048-154449_VR-Chain
QSVLKQPPSVSGAPGLRVTISCTGGSSNIGGFDVHWYQHFPGTAPKLLIYDNDQRPSGIPDRFSGSKSGTSATLGITGLQTGDEADYYCGTWDSSLSAGGVFGTGTKVTVL

SEQ ID NO: 2645 - protein, 111 aa, Artificial Sequence
  anti-HIV_048-153379_VR-Chain
QSVLTQPPSVSATPGQKVTISCSGSRSNIGSHYVSWYQQFPESAPKLLIYKNDNRPSGIPDRFSGSKSGTSATLGISGLQTGDEADYYCGTWDTSLSGGGVFGTGTKVTVL

SEQ ID NO: 2646 - protein, 111 aa, Artificial Sequence
  anti-HIV_048-153171_VR-Chain
QSVLTQPPSVSAAPGQKVTISCSGSTSNIEDIYVSWYQHLPGTAPKLLIYDNNKRPSGIPDRFSGSKSGTSATLAITGLQTGDEADYYCGTWDTSLSAGGVFGTGTKVTVL

SEQ ID NO: 2647 - protein, 111 aa, Artificial Sequence
  anti-HIV_048-152324_VR-Chain
QSMVTQSPSVSAAPGQKVTISCSGTSSNIGQNYVSWYQQLPGTAPKLLIYENSKRPSGIPDRFSGSKSGTSATLGITGLQTGDEADYYCGTWDTSLSAGGVFGSGTKVTVL

SEQ ID NO: 2648 - protein, 111 aa, Artificial Sequence
  anti-HIV_048-146102_VR-Chain
QSVLTQPPSVSAAPGQKVTISCSGSSSTIGNNYISWYQLLPGTPPKLLIYKNNERPSGIPDRFSGSKSGTSATLGITGLQTGDEADYYCGTWDTSLSAGGVFGTGTKVTVL

SEQ ID NO: 2649 - protein, 111 aa, Artificial Sequence
  anti-HIV_048-145984_VR-Chain
QSVLTQPLSVSGAPGQRVTISCTGSSSNIGSNFVSWYQVLPGTTPKLLIFKNNERPSGIPDRFSGSKSGTSATLGITGLQTGDEADYYCGAWDTSLSAGGVFGTGTKVTVL

SEQ ID NO: 2650 - protein, 111 aa, Artificial Sequence
  anti-HIV_048-145371_VR-Chain
QSVLTQPPSVSAASGQKVSIPCSGGTSNIGDNYVSWFQQFPGSAPKILIYDSDKRPSRISDRFSASKSGTSATLDITRLQTGDEADYYCGTWDTSLSAGGVFGTGTKVTVL

SEQ ID NO: 2651 - protein, 111 aa, Artificial Sequence
  anti-HIV_048-144907_VR-Chain
QSALTQPASVSGSPGQSITISCTGTRRDVGFNYVSWYQQHPGTAPKLLIYENNKRPSGIPDRFSGSKSGTSATLGITGLQTGDEADYYCGTWDSSLSAGGVFGTGTKVTVL

SEQ ID NO: 2652 - protein, 111 aa, Artificial Sequence
  anti-HIV_048-142298_VR-Chain
QSVLTQPPSASGTPGQRVTISCSGSSSTIGNNYISWYQLLPGTPPKLLIFKNNERPSGIPDRFSASKSGTSATLGITGLQTGDEADYYCGTWDTSLSAGGVFGTGTKVTVL

SEQ ID NO: 2653 - protein, 111 aa, Artificial Sequence
  anti-HIV_048-142277_VR-Chain
QSVLTQPPSVSGAPGQRITISCTGSSSNIGAYDVQWYQHLPGTAPKLLIYKNTERPSGIPDRFSGSKSGTSATLDITGLQTGDEADYYCGTWDTSLSAGGVFGTGTKVTVL

SEQ ID NO: 2654 - protein, 111 aa, Artificial Sequence
  anti-HIV_048-141934_VR-Chain
QSVLTQPPSVSGAPGQRVTISCTGNSSNIGAYDVHWYQQLPGTAPKLMIYEVSKRPSGIPDRFSGSKSGTSATLGITGLQTGDEADYYCGTWDTSLSAGGVFGSGTKVTVL

SEQ ID NO: 2655 - protein, 111 aa, Artificial Sequence
  anti-HIV_048-141207_VR-Chain
QSVLTQPPSVSAAPGQKVTIACSGSSSNIGNNYVSWYQQLPGTAPKLLIYANNRRPSGIPDRFSASKSGTSATLGITGLQTGDEADYYCGTWDTSLSAGGVFGTGTKVTVL

SEQ ID NO: 2656 - protein, 111 aa, Artificial Sequence
  anti-HIV_048-140796_VR-Chain
QSVLTQPPSVSATPGQKVTISCSGTRSNIGNNYVSWYRQFPGTAPKLLIYEDNKRPSGIPARFSGSKSGTSATLGITGLQTGDEADYYCGTWDTSLSAGGVFGTGTKVTVL

SEQ ID NO: 2657 - protein, 111 aa, Artificial Sequence
  anti-HIV_048-139893_VR-Chain
QSVLTQPPSVSATPGQKVTFSCSGSSSTIGKNYVSWYQVLPGTAPKLLIYKNNKRPSGIPDRFSGSKSGTSATLGITGLQTGDEADYYCGTWDSSLSAGGVFGTGTKVTVL

SEQ ID NO: 2658 - protein, 111 aa, Artificial Sequence
  anti-HIV_048-138820_VR-Chain
QSVLTQPPSVSGAPGQKVTISCSGSGSNIGNTYVSWYQHLPGTAPKLLIYENNKRPSGIPDRFSGSKSATSATLGITGLQTGDEADYYCGTWDTSLSAGGVFGTGTKVTVL

SEQ ID NO: 2659 - protein, 111 aa, Artificial Sequence
  anti-HIV_048-135858_VR-Chain
QSVLTQPPSASGTPGQRVTISCSGSSSNIGSSYVYWYQQFPGRSPRLLIYRNNERPSGIPDRFSGSKSGTSATLGITGLQTGDEADYYCGTWDTSLSAGGVFGTGTKVTVL

SEQ ID NO: 2660 - protein, 111 aa, Artificial Sequence
  anti-HIV_048-134968_VR-Chain
QSVLTQPPSVSAAPGQKVTIFCSGSSSNIGKNYVSWYQQLPGTAPKLLIYENSKRPSGIPDRFSGSKSGTSATLGITGLQTGDEADYYCGTWDTSLSAGGVFGSGTKVTVL

SEQ ID NO: 2661 - protein, 111 aa, Artificial Sequence
  anti-HIV_048-134312_VR-Chain
QSVLTQPPSASGTPGQRVTISCSGSSSNIGNNYVSWYRLLPGTAPKLLIYKNDNRPSGIPDRFSGSKSGTSATLGISGLQTGDEADYYCGTWDTSLSGGGVFGTGTKVTVL

SEQ ID NO: 2662 - protein, 110 aa, Artificial Sequence
  anti-HIV_048-132253_VR-Chain
SALTQPASVSGSPGQSIAISCTGTSSDVGYDLVSWYQQHPGTAPKLLIYDNNKRPSGIPDRFSGSKSGTSATLGITGLQTGDEADYYCGTWDTSLSAGGVFGSGTKVTVL

SEQ ID NO: 2663 - protein, 111 aa, Artificial Sequence
  anti-HIV_048-130710_VR-Chain
QSVLTQPPSVAGAPGQRVTISCTGNTSNIGGYDVHWYQQLPGTPPKLLIFKNNERPSGIPDRFSGSKSGTSATLGITGLQTGDEADYYCGTWDTSLSAGGVFGTGTKVTVL

SEQ ID NO: 2664 - protein, 111 aa, Artificial Sequence
  anti-HIV_048-128564_VR-Chain
QSVLTQPPSASGTPGQRVTISCSGSSSNIGSNTVNWYQQLPGTAPKLLIYKNTERPSGIPDRFSGSKSGTSATLDITGLQTGDEADYYCGTWDTSLSAGGVFGTGTKVTVL

SEQ ID NO: 2665 - protein, 111 aa, Artificial Sequence
  anti-HIV_048-126702_VR-Chain
QSVLTQPPSASAAPGQRVTISCSGSNSNIGNNYVSWYQQLPGTAPKLLIYDNSKRPSGIPDRFSASKSGTSATLGITGLQTGDEADYYCGTWDTSLSAGGVFGTGTKVTVL

SEQ ID NO: 2666 - protein, 111 aa, Artificial Sequence
  anti-HIV_048-124521_VR-Chain
QSVLTQPPSVSGAPGQRVTISCTGSSSTFGGYDVYWYQQIPGTAPKLLIYENNKRPSGIPDRFSGSKSGTSATLAITGLQTGDEADYYCGTWDGSLSTGGVIGTGTKVTVL

SEQ ID NO: 2667 - protein, 111 aa, Artificial Sequence
  anti-HIV_048-122740_VR-Chain
QSVLTQPPSMSAAPGQSVTISCSGSTFNIEKHQVTWLRHLPGTAPTSVIIMNSQRPSGTPDRFSGSKSGTSATLAITGLQTGDEADYYCGTWDGSLSTGGVIGTGTKVTVL

SEQ ID NO: 2668 - protein, 109 aa, Artificial Sequence
  anti-HIV_048-119536_VR-Chain
ELTQSPSVSAAPGEKVTISCSGTNSNIGYYYVSWYQQFPGTAPKVVIYENTKRPSGIPDRFSGSKSGTSATLGITGLQTGDEADYYCGTWDTSLSAGGVFGSGTKVTVL

SEQ ID NO: 2669 - protein, 111 aa, Artificial Sequence
  anti-HIV_048-116929_VR-Chain
QSVLTQPPSVSGAPGQRVTISCTGSSSNIGDYDVHWYQQLPGTAPKLLIYRNNQRPSGVPDRFSGSKSGTSATLGITGLQTGDEADYYCGTWDASLSAGGVFGTGTKVTVL

SEQ ID NO: 2670 - protein, 111 aa, Artificial Sequence
  anti-HIV_048-116577_VR-Chain
QSVLTQPPSASGTPGQRVTISCSGSSSNIGSNYVSWYQVLPGTAPKLLIYKNNKRPSGIPDRFSGSKSGTSATLGITGLQTGDEADYYCATWDTSLSAGGVFGTGTKVTVL

SEQ ID NO: 2671 - protein, 111 aa, Artificial Sequence
  anti-HIV_048-116046_VR-Chain
QSVLTQPPSVSGAPGQRVTISCTGSSSNIGGYDVHWYQQFPGTAPKLLIYDNDKRPSGIPDRFSGSKSGTSATLGITGLQTGDEANYYCGAWDTSLSAGGVFGTGTKVTVL

SEQ ID NO: 2672 - protein, 111 aa, Artificial Sequence
  anti-HIV_048-115875_VR-Chain
QSVLTQPPSVSAAPGQRVTVSCSGSSSNIGNNFVSWYQHLPGTAPKLLIYDNSNRPSGIPDRFSGSKSGTSATLGITGLHTGDEADYYCGTWDTSLSAGGVFGSGTKVTVL

SEQ ID NO: 2673 - protein, 111 aa, Artificial Sequence
  anti-HIV_048-115599_VR-Chain
QSVLTQPPSVSAAPGQMVTISCSGSSSNIGSHSVSWYQHFPGTAPKLVIEENDQRPSGIPDRFSGSKSGTSATLGITGLQTGDEGDYYCGTWDTSLSGGGVFGTGTKVTVL

SEQ ID NO: 2674 - protein, 111 aa, Artificial Sequence
  anti-HIV_048-113988_VR-Chain
QSVLTQPPSVSAAPGQMVTISCSGSSHNIGENYVSWYQHLPGTAPKLLIFKNNERPSGIPDRFSGSKSGTSATLGITGLQTGDEADYYCGTWDTSLSAGGVFGTGTKVTVL

SEQ ID NO: 2675 - protein, 111 aa, Artificial Sequence
  anti-HIV_048-112989_VR-Chain
QSVLTQPPSASGTPGQRVTLSCSGGSSNIGNDNVYWYQQRPGTTPKLLIYNDNRRPSGTPDRFSGSKSGTSATLAITGLQTGDEADYYCGTWDGSLSTGGVIGTGTKVTVL

SEQ ID NO: 2676 - protein, 111 aa, Artificial Sequence
  anti-HIV_048-112435_VR-Chain
QSVLTQPPSVSAAPGQKVSISCSGSSSNIGKNYVSWYQQLPGTAPKLLIFKNNERPSGIPDRFSGSKSGTSATLGITGLQTGDEADYYCATWDTSLSAGGVFGTGTKVTVL

SEQ ID NO: 2677 - protein, 111 aa, Artificial Sequence
  anti-HIV_048-111339_VR-Chain
QSVLTQPPSVSAAPGQKVTISCTGSSSNIGGYAVHWYQQVPATAPKLLIYENNERPSGIPDRFSGSKSGTSATLGITGLQTGDEADYYCGTWDTSLSAGGVFGTGTKVTVL

SEQ ID NO: 2678 - protein, 111 aa, Artificial Sequence
  anti-HIV_048-111055_VR-Chain
QSALTQPASVSGSPGQSITISCTGTRSDVGYNYVSWYQQHPGKAPKLLIYENTKRPSGIPDRFSGSKSGTSATLGITGLQTGDEADYYCGTWDTSLSAGGVFGSGTKVTVL

SEQ ID NO: 2679 - protein, 111 aa, Artificial Sequence
  anti-HIV_048-111027_VR-Chain
QSVLTQPPSVSAAPGQKVTISCSGSNSNLGNNYVSWYQHLPGTAPRLLIYEDKKRPSGIPDRFSGSKSGASATLDITGLQTGDEADYYCGIWDTSLSAGGVFGTGTKVTVL

SEQ ID NO: 2680 - protein, 111 aa, Artificial Sequence
  anti-HIV_048-109721_VR-Chain
QSVLTQPPSVSAAPGQKVTISCSGSSSDIGSNFVSWYQHLPGTAPRLLIYENNRRPSGIPDRFSGSKSGTSATLAITGLQTGDEADYYCGTWDTSLNRGGVFGTGTKVTVL

SEQ ID NO: 2681 - protein, 111 aa, Artificial Sequence
  anti-HIV_048-109666_VR-Chain
QSVLTQPPSMSAAPGERVTISCSGSSSNIGNHHVSWYQQRPGTAPKLLIYENNERPSGIPDRFSGSKSGSSATLAITGLQTGDEADYYCGTWDGRLNIGGVIGTGTKVTVL

SEQ ID NO: 2682 - protein, 111 aa, Artificial Sequence
  anti-HIV_048-109196_VR-Chain
QSVLTQPPSVSAAPGQKVTISCSGSSSNIGNNYVSWYQQLPGTAPKLLIYETNKRPSGIPDRFSGSKSGTSATLAITGLQTGDEADYYCGTWDTSLSGGGVFGTGTKVTVL

SEQ ID NO: 2683 - protein, 111 aa, Artificial Sequence
  anti-HIV_048-109051_VR-Chain
QSVLTQPPSVSAAPGQKVTISCSGNNSNMVNNYISWYQLLPGTPPKLLIFKNNERPSGIPDRFSGSKSGTSATLGITGLQTGDEADYYCGTWDTSLSAGGVFGTGTKVTVL

SEQ ID NO: 2684 - protein, 111 aa, Artificial Sequence
  anti-HIV_048-108570_VR-Chain
QSALTQPPSVSAAPGQKVTISCSGKSSNIGTNFVSWYQQFPEAAPKLLIYDNNKRPSGIPDRFSGSKSGTSATLGITGLQTGDEADYYCGTWDGSLSTGGVIGTGTKVTVL

SEQ ID NO: 2685 - protein, 109 aa, Artificial Sequence
  anti-HIV_048-108033_VR-Chain
ELTQSPSVSAAPGQRVTISCSGNSSNIGNNYVSWYQLLPGTAPKLLIYKNDKRPSGIPDRFSGSKSGTSATLGITGLQTGDEADYYCGTWDTSLSTGGVFGTGTKVTVL

SEQ ID NO: 2686 - protein, 111 aa, Artificial Sequence
  anti-HIV_048-107279_VR-Chain
QSVLTQPPSVSAAPGQKVIISCSGSSSNIGKNYVSWYQHLPGTAPKLLIYENNKRPSGIPDRFSGSKSGTSATLGITGLQTGDEADYYCGTWDASLSAGGVLGTGTKVTVL

SEQ ID NO: 2687 - protein, 111 aa, Artificial Sequence
  anti-HIV_048-106271_VR-Chain
QSVLTQPPSVSAAPGQKVTISCSGSRSNIGSNYISWYQQLPGTAPKLLIYKNDKRPSGIPDRFSGSKSGTSAILGITGLQTGDEADYYCGAWDTSLSAGGVFGTGTKVTVL

SEQ ID NO: 2688 - protein, 111 aa, Artificial Sequence
  anti-HIV_048-106054_VR-Chain
QSVLTQPPSVSAAPGQQVTISCSGSTSNIGNNYVSWYQQVPGTAPKLLIYDNNNRPSGIPDRFSGSKSGTSATLGISGLQTGDEADYYCGTWDTSLSGGGVFGTGTKVTVL

SEQ ID NO: 2689 - protein, 111 aa, Artificial Sequence
  anti-HIV_048-104848_VR-Chain
QSALTQPASVSGSPGQSITISCTGTSSDVGYNYVSWYQQLPGTAPKLLIFDNDDRPSEIPDRFSGSKSGTSATLGITGLQPGDEADYYCGTWDSSLSAGGVFGTGTKVTVL

SEQ ID NO: 2690 - protein, 111 aa, Artificial Sequence
  anti-HIV_048-104638_VR-Chain
QSVLTQPPSASGTPGHRVTISCSGNSSNIGGNHVYWYQQVPGTTPKLLIYRNNERPSGIPDRFSGSKSGTSATLGITGLQTGDEADYYCGTWDTSLSAGGVFGTGTKVTVL

SEQ ID NO: 2691 - protein, 111 aa, Artificial Sequence
  anti-HIV_048-104567_VR-Chain
QSVLTQPPSASGTPGQRVTISCSGSNSNIGTNFVNWYQHVPGRAPKLLIYKNTERPSGIPDRFSGSKSGTSATLDITGLQTGDEADYYCGTWDTSLSAGGVFGTGTKVTVL

SEQ ID NO: 2692 - protein, 111 aa, Artificial Sequence
  anti-HIV_048-102804_VR-Chain
QSVLTQPPSVSTAPGQKVTISCSGSSSNIGYSYVSWFQHLPGTAPKLLIYGNSNRPSGVPDRFSGSKSGTSASLAITGLQTGDEADYYCGTWDSSLSAGGVFGTGTKVTVL

SEQ ID NO: 2693 - protein, 111 aa, Artificial Sequence
  anti-HIV_048-101676_VR-Chain
QSVLTQPPSVSGAPGQSVTISCTGTSSNIGDFDVHWYQQLPGTAPKLLLYENNKRPSGIPDRFSGSKSGTSATLAITGLQTGDEADYYCGTWDGSLSTGGVIGTGTKVTVL

SEQ ID NO: 2694 - protein, 111 aa, Artificial Sequence
  anti-HIV_048-097603_VR-Chain
QSVLTQPPSVSAAPGQKVTISCSGSSSNIGNNYVSWYQQLPGTAPKLLIYDTVKRPSGIPDRFSGSKSGTSATLGITGLQTGDEADYYCGTWDSSLSGGGVFGTGTKVTVL

SEQ ID NO: 2695 - protein, 111 aa, Artificial Sequence
  anti-HIV_048-097107_VR-Chain
QSVLTQPPSVSAAPGQKVTISCSGSSSNIENNYVSWYRQVPGTAPKLLIYKNDNRPSGIPDRFSGSKSGTSATLGITGLQTGDEADYYCGIWDTSLSAGGVFGTGTKVTVL

SEQ ID NO: 2696 - protein, 111 aa, Artificial Sequence
  anti-HIV_048-096871_VR-Chain
QPVLTQPPSASGTPGQRVTISCSGSSSNIGSNYVYWYQQLPGTTPKLLIYRNNQRPSGIPDRFSGSKSGTSATLGITGLQTGDEADYYCGTWDTSLSTGGVFGTGTKVTVL

SEQ ID NO: 2697 - protein, 111 aa, Artificial Sequence
  anti-HIV_048-096668_VR-Chain
QSVLTQPPSVSAAPGQKVTISCSGSGSNIGNNYVSWYQQLPGTAPKLLIYKNTERPSGIPDRFSGSKSGTSATLDITGLQTGDEADYYCGTWDTSLSAGGVFGTGTKVTVL

SEQ ID NO: 2698 - protein, 111 aa, Artificial Sequence
  anti-HIV_048-095236_VR-Chain
QSVLTQPPSVSAPPGQKVTISCSGTTSNIGSNYVAWYQQLPGTAPKLVIYENSKRPSGIPDRFSGSKSGTSATLGITGLQTGDEADYYCGTWDTSLSAGGVFGSGTKVTVL

SEQ ID NO: 2699 - protein, 111 aa, Artificial Sequence
  anti-HIV_048-094155_VR-Chain
QSVLTQPPSVSAAPGQKVTVSCSGSSSDIGENYVSWYQQFPETAPKLLIYDNNKRPSGIPDRFSGSKSGTSATLAITGLQTGDEADYYCGTWDSSLSAGGVFGTGTKVTVL

SEQ ID NO: 2700 - protein, 111 aa, Artificial Sequence
  anti-HIV_048-093219_VR-Chain
QPLLTQPPAVSATPGQRVTISCTGSSSNIGRTFVNWYQQLPGTAPKLLIYENSKRPSGIPDRFSGSKSGTSATLGITGLQTGDEADYYCGTWDTSLSAGGVFGSGTKVTVL

SEQ ID NO: 2701 - protein, 111 aa, Artificial Sequence
  anti-HIV_048-092976_VR-Chain
QSVLTQPPSVSAASGQKVTISCSGSSSNIGNNYVSWYQHLPGTAPKLLIYKNDKRPSGIPDRFSGSKSGTSATLGITGLQTGDEADYYCGTWDTSLSAGGVFGTGTKVTVL

SEQ ID NO: 2702 - protein, 111 aa, Artificial Sequence
  anti-HIV_048-090866_VR-Chain
QSVLTQPPSVSAAPGQKVTISCSGSRSNIGSNYISWYQQLPGTAPKLLIYDNNKRPSGIPDRFSGSKSGTSATLGITGLQTGDEAYYYCGTWDTSLSAGGVFGSGTKVTVL

SEQ ID NO: 2703 - protein, 111 aa, Artificial Sequence
  anti-HIV_048-090650_VR-Chain
QSALTQPASVSGSLGQSITISCSGSSSTIGNNYVSWYQVLPGAAPKLLICKNNERPSGIPDRFSGSKSGTSATLGITGLQTGDEADYYCGTWDTSLSAGGVFGTGTKVTVL

SEQ ID NO: 2704 - protein, 111 aa, Artificial Sequence
  anti-HIV_048-089009_VR-Chain
QSVLTQPPSVSAAPGQKVTISCSGGSSNIGNNYVSWYQQLPETAPKLIIYDNNKRPSGIHDRFSGSKSGTSATLDITALQTGDEADYYCGTWDTSLSAGGVFGTGTKVTVL

SEQ ID NO: 2705 - protein, 111 aa, Artificial Sequence
  anti-HIV_048-088654_VR-Chain
QSALTQPRSVSAAPGQKVSISCSGRSTNLGYNYVSWYQHLPGAAPKVLIYENNKRPSGIPDRFSGSKSGTSATLGITGLQTGDEADYYCGTWDTSLSAGGVFGSGTKVTVL

SEQ ID NO: 2706 - protein, 111 aa, Artificial Sequence
  anti-HIV_048-086513_VR-Chain
QSALTQPPSVSAAPGQKVTISCSGSTSNIGNNYVSWYQQLPGTAPKLLIYKNDNRPSGIPDRFSSSKSGTSATLGITGLQTGDEADYYCGIWDTSLSAGGVFGTGTKVTVL

SEQ ID NO: 2707 - protein, 108 aa, Artificial Sequence
  anti-HIV_048-086024_VR-Chain
LAQPPSVSGTPGQRVTISCSGSSSNIGSNAVNWYQQFPGTAPKLLIYDTDKRPSGIPDRFSGSKSGTSAILGITGLQTGDEADYYCGAWDTSLSAGGVFGTGTKVTVL

SEQ ID NO: 2708 - protein, 111 aa, Artificial Sequence
  anti-HIV_048-085857_VR-Chain
QSALTQPRSVSGSLGQSVTISCTGTTSDVGFDYVSWYQVLPGTAPKLLIYKNDKRPSGIPDRFSGSKSGTSATLGITGLQTGDEADYYCGTWDTSLSTGGVFGTGTKVTVL

SEQ ID NO: 2709 - protein, 111 aa, Artificial Sequence
  anti-HIV_048-084277_VR-Chain
QSVLRQPPSLSGAPGQRVTLSCTGSSSNIGGYDVHWYQHVPGTAPKLLIYENTKRPSGIPDRFSGSKSGTSATLGITGLQTGDEADYYCGTWDTSLSAGGVFGSGTKVTVL

SEQ ID NO: 2710 - protein, 111 aa, Artificial Sequence
  anti-HIV_048-084245_VR-Chain
QSTLTQPPSVSAAPGQKVTISCSGSNSNIGKHYVSWYQQFPGAVPKLLIYENKKRPSGIPDRFSGSKSDTSATLDITGLQTGDEADYYCGTWDTSLSAGGVFGSGTKVTVL

SEQ ID NO: 2711 - protein, 111 aa, Artificial Sequence
  anti-HIV_048-082487_VR-Chain
QSLLTQPPSVSAAPGQKVTISCSGSSSTIGNNYVSWYQVLPGAAPKLLICKNNERPSGIPDRFSGSKSGTSATLGITGLQTGDEADYYCGTWDTSLSAGGVFGSGTKVTVL

SEQ ID NO: 2712 - protein, 111 aa, Artificial Sequence
  anti-HIV_048-081787_VR-Chain
QSVLTQPPSVSGAPGQRVTISCTGSSSNIGSYDVHWYQQLPGTAPKLLIYENSKRPSGIPDRFSGSKSGTSATLGITGLQTGDEADYYCGTWDTSLSGGGVFGTGTKVTVL

SEQ ID NO: 2713 - protein, 111 aa, Artificial Sequence
  anti-HIV_048-081062_VR-Chain
QSVLTQPPSVSAAPGQKVTISCSGTSSNIGANYVSWYQQVPGTAPKLLIYENNKRPSGTPDRFSGSKSGTSATLGITGLQTGDEADYYCGTWDTSLSAGGVFGSGTKVTVL

SEQ ID NO: 2714 - protein, 111 aa, Artificial Sequence
  anti-HIV_048-079639_VR-Chain
QSVLTQPPSVSAAPGQKVTISCSGSSSNIGKNYVSWYQHLPGTAPKLLIYENNKRPSGIPDRFSGSKSGTAATLGITGLQTGDEAGYYCGTWDTSLSAGGVFGTGTKVTVL

SEQ ID NO: 2715 - protein, 111 aa, Artificial Sequence
  anti-HIV_048-079126_VR-Chain
QSVLTQPPSVSAAPGQKVTISCSGSSSNIGNNYVSWYQHLPGTPPKLLIFKNNERPSGIPDRFSGSKSGTSATLGITGLQTGDEADYYCGTWDTSLSAGGVFGTGTKVTVL

SEQ ID NO: 2716 - protein, 111 aa, Artificial Sequence
  anti-HIV_048-073118_VR-Chain
QSVLTQPPSVSAAPRHNVTISCSGGSSNIGNNFVSWYQYLPGTAPKLLIYDNNKRPSGIPDRFSGSKSGTSATLGITGLQTGDEADYYCATWDTSLSAGGVFGTGTKVTVL

SEQ ID NO: 2717 - protein, 111 aa, Artificial Sequence
  anti-HIV_048-070264_VR-Chain
QSVLTQSPSVSAAPGQKVTISCSGTSSNIGNTYVSWYQQLPGTAPKLLIYKNDKRPSGIPDRFSGSKSGTSATLGITGLQTGDEADYYCGTWDSSLSAGGVFGTGTKVTVL

SEQ ID NO: 2718 - protein, 111 aa, Artificial Sequence
  anti-HIV_048-069426_VR-Chain
QSVLTQPPSVSAAPGQKVTISCSGSSSTIGNNYVSWYQQLPGTAPKLLIYKNNKRPSGVPDRFSGSKSGTSATPGITGLQTGDEADYYCGTWDTSLSAGGVFGTGTKVTVL

SEQ ID NO: 2719 - protein, 111 aa, Artificial Sequence
  anti-HIV_048-068564_VR-Chain
QSALTQPRSVSGSPGQSVAISCTGTSSDVGYNYVSWYQVLPGTAPKLLIYKNNERPSGIPDRFSGSKSGTSATLGITGLQTGDEADYYCGTWDTSLSAGGVFGTGTKVTVL

SEQ ID NO: 2720 - protein, 111 aa, Artificial Sequence
  anti-HIV_048-068345_VR-Chain
QSVLTQTPSVSAAPGQRVTISCSGSTSNIGNNYVSWYQQLPGTAPKLLIYENNKRPSGIRDRFSASKSGTSATLGITGLQTGDEADYYCGTWDTSLSAGGVFGTGTKVTVL

SEQ ID NO: 2721 - protein, 111 aa, Artificial Sequence
  anti-HIV_048-067337_VR-Chain
QSVLTQPPSVSAAPGQKVTISCSGASYNIGKNSVSWYQQLPGTAPKLLIYKNDKRPSGIPDRFSGSKSGASATLDITGLQTGDEADYYCGIWDTSLSAGGVFGTGTKVTVL

SEQ ID NO: 2722 - protein, 111 aa, Artificial Sequence
  anti-HIV_048-067180_VR-Chain
QSVLTQPPSVSAAPGQKVTISCSGSSPNIGNNYVSWYQRLPGTAPKLLIYENDQRPSGIPDRISGSKSGTSATLGITGLQTGDEADYYCGTWDTSLSTGGVFGTGTKVTVL

SEQ ID NO: 2723 - protein, 111 aa, Artificial Sequence
  anti-HIV_048-063017_VR-Chain
QSVLTQPPSVSAAPGQKVTISCSGSSSNIGNNYVSWYQHHPGKAPKLMIYEVSKRPSGIPDRFSGSKSGTSATLGITGLQTGDEADYYCGTWDTSLNRGGVFGTGTKVTVL

SEQ ID NO: 2724 - protein, 111 aa, Artificial Sequence
  anti-HIV_048-061885_VR-Chain
QSVLTQPPSVSAAPGQKVTISCSGSSSNIGSHYISWYQQFPGAAPKLLIYENDKRPSGIPDRFSASKSGTSATLGITGLQTGDEADYYCGTWDTSLSAGGVFGTGTKVTVL

SEQ ID NO: 2725 - protein, 111 aa, Artificial Sequence
  anti-HIV_048-061671_VR-Chain
QSVLTQPPSASGTPGQRVTISCSGSRSNIGSNYVYWYQQFPGTAPKLLIYENNKRPSGIPDRFSGSKSGTSATLGITGLQTGDEADYYCATWDTSLSAGGVFGTGTKVTVL

SEQ ID NO: 2726 - protein, 111 aa, Artificial Sequence
  anti-HIV_048-060700_VR-Chain
QSVLTQLPSLSAAPGQKVTISCSGSSSNIGNNYVSWYQQLPGTAPKLLIYENNKRPSGIPDRFSGSKSGTSATLGITGLQTGDEAEYYCATWDASLSGGGVFGTGTKVTVL

SEQ ID NO: 2727 - protein, 111 aa, Artificial Sequence
  anti-HIV_048-060592_VR-Chain
QSVLTQPPSVSAAPGQKVTISCSGSSSNIGKNYVSWYQQFPGTAPKLLIYENNKRPSGIPDRFSASKSATSATLVITGLQTGDEAVYYCGTWDTSLSAGGVFGSGTKVTVL

SEQ ID NO: 2728 - protein, 111 aa, Artificial Sequence
  anti-HIV_048-060300_VR-Chain
QPVLTQPPSASGTPGQRVTISCSGSSSNIGTNTVNWYQQFPGTAPKLLIYKNNERPSGIPDRFSGSKSGTSATLGITGLQTGDEADYYCGTWDTSLSGGGVFGTGTKVTVL

SEQ ID NO: 2729 - protein, 111 aa, Artificial Sequence
  anti-HIV_048-059141_VR-Chain
QPVLTQPPSASGTPGQRVSISCSGNFSNIGSKYVYWYQQIPGTAPNVIIYRTNLRPSGIPDRFSASKSGTSATLGITGLQTGDEADYYCGTWDTSLSAGGVFGTGTKVTVL

SEQ ID NO: 2730 - protein, 111 aa, Artificial Sequence
  anti-HIV_048-057777_VR-Chain
QSVLTQPPSLSAAPGQRVTISCSGSSSNIGNNYVSWYQQFPGTAPTLLIYENDKRPSGIPDRFSASKSGTSATLGITGLQAGDEADYYCGTWDTSLSAGGVFGTGTKVTVL

SEQ ID NO: 2731 - protein, 111 aa, Artificial Sequence
  anti-HIV_048-056928_VR-Chain
QSVLTQPPSVSAAPGQKVTISCSGSSSTIGNNYVSWYQLLPGTAPKLLIYDNDNRPSDIPDRFSGSKSGTSATLGITGLQTGDEADYYCGAWDTSLSAGGVFGTGTKVTVL

SEQ ID NO: 2732 - protein, 111 aa, Artificial Sequence
  anti-HIV_048-056131_VR-Chain
QFVLTQPASVSGSPGQSITISCSGTSSDVGYNYVSWYQQLPGTAPKLLIYENTKRPSGIPDRFSGSKSGTSATLGITGLQTGDEADYYCGTWDTSLSAGGVFGSGTKVTVL

SEQ ID NO: 2733 - protein, 111 aa, Artificial Sequence
  anti-HIV_048-055864_VR-Chain
QSVLTQPPSVSVAPGQKVTIYCSGSSSNIGKNSVSWYVQVPGTAPKFLIYENNQRPSGISDRFSGSKSGTSATLGISGLQTGDEADYYCGTWDTSLSGGGVFGTGTKVTVL

SEQ ID NO: 2734 - protein, 111 aa, Artificial Sequence
  anti-HIV_048-055094_VR-Chain
QSVLTQPPSVSGAPGQRVTISCSASSSSIGNDFVSWYQQLPGTAPKLLISENNKRPSGIPDRFSGSKSGTSATLGITGLQTGDEADYYCGTWDSSLSAGGVFGTGTKVTVL

SEQ ID NO: 2735 - protein, 111 aa, Artificial Sequence
  anti-HIV_048-054343_VR-Chain
QSVLTQPPSVSGAPGQRVTISCTGSSSNIGGYDVNWYQQLPGTAPKLLIFKNNERPSGIPDRFSGSKSGTSATLGITGLQTGDEADYYCGTWDTSLSAGGVFGTGTKVTVL

SEQ ID NO: 2736 - protein, 111 aa, Artificial Sequence
  anti-HIV_048-054193_VR-Chain
QSVLTQPPSVSAAPGQKVTISCSGGSSNIGNNYVSWYHQVPGTAPKLLIFENNKRPSGIPDRFSGSKSGTSATLGITGLQTGDEADYYCGTWDTSLSGGGVFGTGTKVTVL

SEQ ID NO: 2737 - protein, 111 aa, Artificial Sequence
  anti-HIV_048-052521_VR-Chain
QSVLTQPPSVSAAPGQKVTISCSGSSSNIGRHSVSWYQQLPGTAPKLLIYDTDKRPSGIPDRFSGSKSGTSATLGITGLQTGDEADYYCGTWDTSLSGGGVFGTGTKVTVL

SEQ ID NO: 2738 - protein, 111 aa, Artificial Sequence
  anti-HIV_048-049037_VR-Chain
QSVLTQPPSVSAAPGQKVTISCSGSSFNIGNNYVSWYQHLPGTAPKLLIYAAVTRPSGIPDRFSGSKSGTSATLDITGLQTGDEADYYCGTWDTSLSAGGVFGTGTKVTVL

SEQ ID NO: 2739 - protein, 111 aa, Artificial Sequence
  anti-HIV_048-048720_VR-Chain
QSVLTQPPAVSAAPGQRVAISCSGTSSNIGSNLVSWYQQLPGKAPRLLIYDNYKRPSGIPDRFSGSKSGTSATLGITGLQTGDEADYYCGTWDTSLSTGGVFGTGTKVTVL

SEQ ID NO: 2740 - protein, 111 aa, Artificial Sequence
  anti-HIV_048-048542_VR-Chain
QSVLTQPPSVSAAPGQKVTISCSGSSSNIGNNFVSWYQQLPGTAPKLLIYNNDRRPSGVPDRFSASKFGTAATLGITGLQTGDEADYYCGTWDSSLSAGGVFGTGTKVTVL

SEQ ID NO: 2741 - protein, 111 aa, Artificial Sequence
  anti-HIV_048-047777_VR-Chain
QSVLTQPPSASGTPGQRVTISCSGSSANIGTNYVFWYQHLPGTAPKLLIYENNKRPSGIPDRFSGSKSGTSATLGITGLQTGDEADYYCGTWDSSLSAGGVFGTGTKVTVL

SEQ ID NO: 2742 - protein, 111 aa, Artificial Sequence
  anti-HIV_048-046841_VR-Chain
QSVLTQPPSVSAALGQKVTITCSGDNGNIGYHYVSWYQQVGRAAPKLLIYANNKRPSGIPDRFSGSKSGTSATLGITGLQTGDEADYYCGTWDTSLSAGGVFGSGTKVTVL

SEQ ID NO: 2743 - protein, 111 aa, Artificial Sequence
  anti-HIV_048-046202_VR-Chain
QSVLTQPPSVSAAPGQKVTISCSGSSSNIGNNYVSWYQHLPGTAPKLLIYDTYKRHSGVPDRFSNSKSGTSATLAITGLQTGDEGDYYCGAWDTSLSAGGVFGTGTKVTVL

SEQ ID NO: 2744 - protein, 111 aa, Artificial Sequence
  anti-HIV_048-046059_VR-Chain
QSVLTQPPSVSAAPGQNVTISCSGTSSNIENNYVSWYQTLPGTAPKLLIYDNNKRPSGIPDRFSGSKSGTSATLGITGLQTGDEADYYCGTWDSSLSAGGVFGTGTKVTVL

SEQ ID NO: 2745 - protein, 111 aa, Artificial Sequence
  anti-HIV_048-043568_VR-Chain
QSVLTQPPSVSAAPGQKVTISCSGSDSNIGSNYVSWYQQLPGAAPKLLIYKNNNRPSGIPDRFSGSKSGTSATLGISGLQTGDEADYYCGTWDTSLSGGGVFGTGTKVTVL

SEQ ID NO: 2746 - protein, 111 aa, Artificial Sequence
  anti-HIV_048-042713_VR-Chain
QSVLTQPPSVSAAPGQKVTISCSGSSSNIGRHYVSWYQQLPGTAPKLLIYDNNSRPSGIPDRFSGSKSGTSATLGITGLQTGDEADYYCGTWDTSLNRGGVFGTGTKVTVL

SEQ ID NO: 2747 - protein, 111 aa, Artificial Sequence
  anti-HIV_048-042440_VR-Chain
QSVLTQPPSASGTPGQRVTISCSGSSSNIGTNTVNWYQQLPGTAPKLLIYENSKRPSGIPDRFSGSKSGTSATLGITGLQTGDEADYYCGTWDTSLSAGGVFGSGTKVTVL

SEQ ID NO: 2748 - protein, 111 aa, Artificial Sequence
  anti-HIV_048-040511_VR-Chain
QSVLTQPPSVSAAPGQKVTISCSGSSSNIGNNYVSWYQHLPGTAPKLLIYENNKRSSGIPERFSGSQSGTSATLGITGLQTGDEADYYCGTWDTSLSTGGVFGTGTKVTVL

SEQ ID NO: 2749 - protein, 111 aa, Artificial Sequence
  anti-HIV_048-039195_VR-Chain
QSVLTQPPSVSAAPGQRVTISCSGSTSNIGNHYVSWYQQLPGTAPKLLIYDNGNRPSGIPDRFSGSKSGTSATLDITGLQTGDEADYYCGTWDTSLNRGGVFGTGTKVTVL

SEQ ID NO: 2750 - protein, 111 aa, Artificial Sequence
  anti-HIV_048-036935_VR-Chain
QSVLTQPPSMSAAPGERVTISCTGSSSNIGGYDVHWYQQLPGIAPKILIYRNSIRPSGIPDRFSGSKSGTSATLGITGLQTGDEADYYCGTWDTSLSTGGVFGTGTKVTVL

SEQ ID NO: 2751 - protein, 111 aa, Artificial Sequence
  anti-HIV_048-034478_VR-Chain
QSVLTQPPSVSAAPGQKVTISCTGSGSNIGNNDVSWYQQLPGTAPRLLIYGDNKRPSGIPDRFSGSKSGTSATLGITGLQTGDEADYYCGTWDTSLSAGGVFGTGTKVTVL

SEQ ID NO: 2752 - protein, 111 aa, Artificial Sequence
  anti-HIV_048-031641_VR-Chain
QSVLTQPPSVSAAPGQKVTISCSGNNSNIGNNYVSWYQQLPGTAPKLLIYENSKRPSGIPDRFSGSKSGTSATLGITGLQTGDEADYYCGTWDTSLSAGGVFGSGTKVTVL

SEQ ID NO: 2753 - protein, 111 aa, Artificial Sequence
  anti-HIV_048-029760_VR-Chain
QSALTQPASVSGSSGQSITISCTGTNSDVGYDYVCWYQQLPGTAPKLLIYENNKRPSGIPDRFSGSKSGTSATLGITGLQTGDEADYYCGTWDTSLSAGGVFGTGTKVTVL

SEQ ID NO: 2754 - protein, 111 aa, Artificial Sequence
  anti-HIV_048-027970_VR-Chain
QSVLTQPPSVSAPPGQKVTISCSGTTSNIGSNYVAWYQQFPGTAPKLLIYENNKRPSGIPDRFSGSKSGTSATLGITGLQTGDEADYYCATWDTSLSAGGVFGTGTKVTVL

SEQ ID NO: 2755 - protein, 111 aa, Artificial Sequence
  anti-HIV_048-027337_VR-Chain
QSVLTQPPSVSAAPGQKVTISCSGSYSNIGNNYLSWYQQLPGTAPKLLIYKNNKRPSGVPDRFSGSKSGASATLDITGLQTGDEADYYCGIWDTSLSAGGVFGTGTKVTVL

SEQ ID NO: 2756 - protein, 111 aa, Artificial Sequence
  anti-HIV_048-027217_VR-Chain
QSVLTQPPSVSAAPGQKVTISCSGSSSIIGNNYVSWYQQLPGTAPKLLIYENNKRPSGIPDRFSGSKSGTSATLAIAGLQTGDEADYYCATWDTSLSAGGVFGTGTKVTVL

SEQ ID NO: 2757 - protein, 111 aa, Artificial Sequence
  anti-HIV_048-026760_VR-Chain
QSVLTQPPSVSAAPGQKVTISCSGSSSNIGNNYVSWYQHLPGTAPKLLIYDTVKRHSGVPDRFSGSKSGTSATLGISGLQTGDEADYYCGTWDTSLSAGGVFGSGTKVTVL

SEQ ID NO: 2758 - protein, 111 aa, Artificial Sequence
  anti-HIV_048-024800_VR-Chain
QSVLTQPPSVSAAPGQKVTISCSGSYSNIGNNYVSWYQVLPGTAPKLLIYKNNERPSGIPDRFSGSKSGTSATLGITGLQTGDEADYYCGTWDTSLSAGGVFGTGTKVTVL

SEQ ID NO: 2759 - protein, 111 aa, Artificial Sequence
  anti-HIV_048-024313_VR-Chain
QSVLTQPPSVSAAPGQKVTISCSGSSSTIGNSHVSWYQILPGTAPKLLIYKDDKRPSGIPDRFSGSKSGTSATLGITGLQTGDEADYYCGTWDTSLNRGGVFGTGTKVTVL

SEQ ID NO: 2760 - protein, 111 aa, Artificial Sequence
  anti-HIV_048-021748_VR-Chain
QSVLTQPPSVSAAPGQRVTISCSGSTSNIGNNYVSWYQQLPGTAPKLLIYENNKRPSGIPDRFSGSKSGTSATLGISGLQTGDEADYYCGTWDSSLSGGGVFGTGTKVTVL

SEQ ID NO: 2761 - protein, 111 aa, Artificial Sequence
  anti-HIV_048-020991_VR-Chain
QSVLTQPPSASGTPGQKVTISCSGSSSTIGNNYVSWYQVLPGTAPKLLIYKNDKRPSGIPDRFSGSKSGTSATLGITGLQTGDEADYYCGTWDTSLSTGGVFGTGTKVTVL

SEQ ID NO: 2762 - protein, 111 aa, Artificial Sequence
  anti-HIV_048-020340_VR-Chain
QSVLTQPPSVSAAPGQRVTISCSGSSSNVGNNYVSWYQQLPGTAPKLLIYENNKRPSGIPDRFSGSKSGTSATLGITGLQTGDEADYYCGTWDASLSAGGVFGTGTKVTVL

SEQ ID NO: 2763 - protein, 111 aa, Artificial Sequence
  anti-HIV_048-019993_VR-Chain
QSVLTQPPSVSGAPGQRVTISCTGSSSSIGGFDVHWYQRLPGTAPRLLIYENNKRPSGIPDRFSGSKSGTSATLGITGLQTGDEADYYCGTWDSSLSAGGVFGTGTKVTVL

SEQ ID NO: 2764 - protein, 111 aa, Artificial Sequence
  anti-HIV_048-019947_VR-Chain
QSVLTQPPSVSAAPGQRVTISCSGSSSNIGSKYVSWYQQLPGTAPKLLIYENSKRPSGIPDRFSGSKSGTSATLGITGLQTGDEADYYCGTWDTSLSTGGVFGTGTKVTVL

SEQ ID NO: 2765 - protein, 111 aa, Artificial Sequence
  anti-HIV_048-017871_VR-Chain
QSVLTQPPSVSAAPGQKVTISCSGSSSNIGNRYVSWYQQLPGTAPKLLIYKNNKRPSGIPDRFSGSKSGTSATLGITGLQTGDEADYYCGTWDGSLSTGGVIGTGTKVTVL

SEQ ID NO: 2766 - protein, 111 aa, Artificial Sequence
  anti-HIV_048-015931_VR-Chain
QSVLTQPPSVSAAPGQKVTISCSGGSSNIGSTYVSWYQQVPGTAPKLLIYENNKRPSGIPDRFSGSKSGTSATLDITGLQTGDEADYYCGTWDTSLSGGGVFGTGTKVTVL

SEQ ID NO: 2767 - protein, 111 aa, Artificial Sequence
  anti-HIV_048-015920_VR-Chain
QSLLTQPPSVSAAPGQKVTISCSGSSSTIGNNYVSWYQVLPGTAPKLLIYKNNERPSGIPDRFSGSKSGTSATLGITGLQTGDEAEYYCATWDASLSGGGVFGTGTKVTVL

SEQ ID NO: 2768 - protein, 111 aa, Artificial Sequence
  anti-HIV_048-013898_VR-Chain
QSVLTQPPSVSAAPGQKVTISCSGSSSNIGKHSVSWYQQLPGTAPELLIYDNNNRPSGIPDRFSGSKSGTSATLGITGLQTGDEADYYCGTWDTSLSAGGVFGTGTKVTVL

SEQ ID NO: 2769 - protein, 111 aa, Artificial Sequence
  anti-HIV_048-013429_VR-Chain
QSVLTQPPSVSAAPGQKVTISCSGSSSNIGNNYVSWYQQLPGTAPTLLIYENDKRPSGIPDRFSGSKSGTSATLGITGLQTGDEADYYCGTWDSSLSAGGVFGTGTKVTVL

SEQ ID NO: 2770 - protein, 111 aa, Artificial Sequence
  anti-HIV_048-012358_VR-Chain
QSVLTQPPSVSAAPGQKVTISCSGSNSAIGNNYVSWYQVLPGTAPKLLIYKNNERPSGIPDRFSGSKSGTSATLDITGLQTGDEADYYCGTWDTSLSAGGVFGTGTKVTVL

SEQ ID NO: 2771 - protein, 111 aa, Artificial Sequence
  anti-HIV_048-011158_VR-Chain
QSVLTQPPSVSAAPGQKVTISCSGISSNIGNNDVSWYQQLPGTAPKLLIYDNDKRPSGIPDRFSGSKSGTSATLGITGLQTGDEADYYCGTWDSSLSAGGVFGTGTKVTVL

SEQ ID NO: 2772 - protein, 111 aa, Artificial Sequence
  anti-HIV_048-010720_VR-Chain
QSVLTQPPSVSAAPGQKVTISCSGSSSNIGSHYVSWYQQVPGTAPRLVIYENSKRPSGIPDRFSGSKSGTSATLGITGLQTGDEADYYCGTWDTSLSAGGVFGSGTKVTVL

SEQ ID NO: 2773 - protein, 111 aa, Artificial Sequence
  anti-HIV_048-009445_VR-Chain
QSVLTQPPSVSAAPGQKVTISCSGSSSNIGNNYVSWYQQLPGTVPKLLIYDTYTRPSGTPDRFSGSKSGTSATLAITGLQTGDEADYYCGTWDGSLSTGGVIGTGTKVTVL

SEQ ID NO: 2774 - protein, 108 aa, Artificial Sequence
  anti-HIV_048-006126_VR-Chain
QSVLTQPPSVSGAPGQKVTISCSGISSNFGISWYQQVPGTAPKLLIYENDKRPSGIPDRFSGSKSGTSATLGITGLQTGDEADYYCGTWDTSLSAGGVFGTGTKVTVL

SEQ ID NO: 2775 - protein, 111 aa, Artificial Sequence
  anti-HIV_048-005652_VR-Chain
QSVLTQPPSVSAAPGQKVTISCSGSNSAIGNNYVSWYQVLPGTAPKLLIYDTYKRASGIPDRFSGSKSGTSATLGITGLQTGDEADYYCGTWDTSLSGGGVFGTGTKVTVL

SEQ ID NO: 2776 - protein, 111 aa, Artificial Sequence
  anti-HIV_048-005532_VR-Chain
QSVLTQPPSVSAAPGQKVTISCSGTSSNIGNTYVSWYQQLPGTAPNYLIYKIDKRPSGIPDRFSGSKSGTSATLGITGLQTGDEADYYCGTWDTSLSAGGVFGTGTKVTVL

SEQ ID NO: 2777 - protein, 111 aa, Artificial Sequence
  anti-HIV_048-005189_VR-Chain
QSVLTQPPSVSAAPGQKVTISCSGSGSTIGNNDVSWYQQLPGAAPKLLIYEDNKRPSGIPARFSGSKSGTSATLRITGLQTGDEADYYCGTWDSSLSAGGVFGTGTRVSVL

SEQ ID NO: 2778 - protein, 111 aa, Artificial Sequence
  anti-HIV_048-005088_VR-Chain
QSVLTQPPSVSAAPGQKVTISCSGSSSNIGKNYVSWYQQLPGTAPKLLIYDNNNRPSGIPDRFSGSKSGTSATLGITGLQTGDEADYYCGAWDTSLSAGGVFGTGTKVTVL

SEQ ID NO: 2779 - protein, 111 aa, Artificial Sequence
  anti-HIV_048-004023_VR-Chain
QSVLTQPPSVSATPGQKVTISCSGGSSNIGKNDVSWYQQLPGTAPKLLIYDTNKRPSGIPDRFSAARSGTSATLDITGLQTGDEADYYCGTWDTSLSAGGVFGTGTKVTVL

SEQ ID NO: 2780 - protein, 111 aa, Artificial Sequence
  anti-HIV_048-001580_VR-Chain
QSVLTQPPSVSAAPGQKVTISCSGSSSNIGNNYVSWYQQLPGTAPKLLLYENNKRPSGIPDRFSGSKSGTSATLAITGLQTGDEAAYYCGTWDGSLSTGGVIGTGTKVTVL

SEQ ID NO: 2781 - protein, 111 aa, Artificial Sequence
  anti-HIV_038-221120_VR-Chain
QSVLTQPPSVSAAPGQKVTISCSGSTSNIGKNYVSWYQQLPGTAPKLLIYDNNERPSGIPDRFSGSKSGTSATLGITGLQTGDEADYYCATWDSSLSGGGVFGTGTRVTVL

SEQ ID NO: 2782 - protein, 111 aa, Artificial Sequence
  anti-HIV_038-197677_VR-Chain
QSVLTQPPSVSAAPGQKVTVSCSGSNSNIGNHYVSWYQQLPGTAPKLLIYDNNKRPSGIPDRFSGSKSGTSATLGITGLQTGDEADYYCGTWDSSLSAGGVFGTGTKVTVL

SEQ ID NO: 2783 - protein, 111 aa, Artificial Sequence
  anti-HIV_038-196765_VR-Chain
QSALTQPASVSGSPGQSITISCTGTSGDVGYNLVSWYQQLPGTAPKVLIYENNKRPSGIPDRFSGSKSGTSATLGITGLQTGDEADYYCGTWDSSLSAGGVFGTGTKVTVL

SEQ ID NO: 2784 - protein, 111 aa, Artificial Sequence
  anti-HIV_038-186200_VR-Chain
QSVLTQPPSASGTPGQRITISCSGTSSNIGSNIVSWYQHLPGTTPKLVIFRNNQRPSGIPDRFSGSKSGTSATLGITGLQTGDEADYYCGTWDSSLSAGGVFGTGTKVTVL

SEQ ID NO: 2785 - protein, 111 aa, Artificial Sequence
  anti-HIV_038-126170_VR-Chain
QSVLTQPPSVSAPPGQKVTISCSGTTSNIGSNYVAWYQQLPGTAPKLLIYDNVKRPTNIPDRFSGSKSGTSATLGITGLQTGDEADYYCGTWDSSLSAGGVFGTGTKVTVL

SEQ ID NO: 2786 - protein, 111 aa, Artificial Sequence
  anti-HIV_038-108545_VR-Chain
QSVLTQPPSASGTPGQRVTISCSGSSSNIGYNTVSWYQQLPGTAPKLLIYENNKRPSGIPDRFSGSKSGTSATLGITGLQTGDEADYYCGTWDSSLSAGGVFGTGTKVTVL

SEQ ID NO: 2787 - protein, 111 aa, Artificial Sequence
  anti-HIV_038-107263_VR-Chain
QSVLTQPPSASGTPGQRVTISCSGSSSNIGSNTVNWYQQVPGTAPNLLIYSNDQRPSGIPDRFSGSKSGTSATLGITGLQTGDEADYYCGTWDSSLSAGGVFGTGTKVTVL

SEQ ID NO: 2788 - protein, 111 aa, Artificial Sequence
  anti-HIV_038-104530_VR-Chain
QSVLTQPPSVSAAPGQKVTISCSGSSSNIGSNYVSWYQHLPGKAPKLLIYDNNKRPSGIPDRFSGSKSGTSATLGITGLQTGDEADYYCGTWDSSLSAGGVFGTGTKVTVL

SEQ ID NO: 2789 - protein, 111 aa, Artificial Sequence
  anti-HIV_038-099169_VR-Chain
QSVLTQPPSASGTPGQRVSISCSGITSSLGSNHMSWYQQLPGTAPKLLIYENNKRPSGIPDRFSGSKSGTSATLGITGLQTGDEADYYCGTWDSSLSAGGVFGTGTKVTVL

SEQ ID NO: 2790 - protein, 111 aa, Artificial Sequence
  anti-HIV_038-075067_VR-Chain
QSVLTQPPSVSGAPGQRVTISCSGSSSTIGNNYVSWYQLLPGTAPKLLIYKNNKRPSGIPDRFSGSKSGTSATLGITGLQTGDEADYYCGTWDTSLSAGGVFGTGTKVTVL

SEQ ID NO: 2791 - protein, 111 aa, Artificial Sequence
  anti-HIV_038-072368_VR-Chain
QSVLTQSPSASGTPGQRVTISCSGSSSNIGNNYVSWYQQLPGTAPKLLIYENNKRPSGIPDRFSGSKSGTSATLGITGLQTGDEADYYCGTWDSSLSAGGVFGTGTKVTVL

SEQ ID NO: 2792 - protein, 111 aa, Artificial Sequence
  anti-HIV_038-068503_VR-Chain
QSVLTQPPSVSAAPGQMVTISCSGSRSNIENHYVSWYQHLPGAAPKLLIYDNGKRPSGIPDRFSGSKSGTSATLGITGLQTGDEADYYCGTWDSSLSAGGVFGTGTKVTVL

SEQ ID NO: 2793 - protein, 111 aa, Artificial Sequence
  anti-HIV_038-068016_VR-Chain
QSVLTQPPSASGTPGQRVTISCSGSSSNIESNFVYWYQQFPGTTPKLLIYRDGQRPSGIPDRFSGSKSGTSATLGITGLQTGDEADYYCGTWDSSLSAGGVFGTGTKVTVL

SEQ ID NO: 2794 - protein, 111 aa, Artificial Sequence
  anti-HIV_038-063958_VR-Chain
QSVLTQPPSVSGAPGQRVTISCTGSSSNIGNSGVHWYQQLPGTAPKLLIYENNKRPSGIPDRFSGSKSGTSATLGITGLQTGDEADYYCGTWDSSLSAGGVFGTGTKVTVL

SEQ ID NO: 2795 - protein, 111 aa, Artificial Sequence
  anti-HIV_038-033733_VR-Chain
QSVLTQPPSASGTPGQRVTISCSGSSSNIGSKYVYWYQQLPGTAPKLLIYDNDKRPSGIPDRISASKSGTSATLDITRLQTGDEADYYCGTWDSSLSAGGVFGTGTKVTVL

SEQ ID NO: 2796 - protein, 111 aa, Artificial Sequence
  anti-HIV_038-030557_VR-Chain
QSVLTQPPSVSAAPGQKVTISCSGSSSTIGNNYVSWYQLLPGTAPKLLIYKNNKRPSGIPDRFSGSKSGTSATLGITGLQTGDGADYYCGTWDTSLSAGGVFGTGTIVTVL

SEQ ID NO: 2797 - protein, 111 aa, Artificial Sequence
  anti-HIV_038-024298_VR-Chain
QSVLTQPPSVSAAPGQKVTISCSGSSSNIGNSHVSWYQQFPGTGPKLLIYENAKRPSGIPDRISGSKSDTSATLGITGLQTGDEADYYCGTWDSSLSAGGVFGTGTKVTVL

SEQ ID NO: 2798 - protein, 111 aa, Artificial Sequence
  anti-HIV_038-011154_VR-Chain
QSVLTQPPSVSAAPGQRITISCSGSSSNIGNNYVSWYQQLPGTAPKLLIYKNNKRPSGIPDRFSGSKSGTSATLGITGLQTGDEADYYCGTWDTSLSAGGVFGTGTKVTVL

SEQ ID NO: 2799 - protein, 106 aa, Artificial Sequence
  anti-HIV-1_LightChain
EIVLTQSPGTLSLSPGERATLSCRASQSVSNNFLAWYQYKPGQPPRVLIYGTSRRASGIPDRFSGSGSGTDGSLTISRLEAEDFAVYYCQQYEFFGQGTRLEMKRT

SEQ ID NO: 2800 - protein, 106 aa, Artificial Sequence
  anti-HIV-1_LightChain
EVVLTQSPGTLSLSPGERATLSCRASQSVSRNYLAWYQQKLGHGPRLLVYATSRRATGIPDRFIGSQSGTEYNLTITRLDPGDFAQYFCQQYEFFGPGTRLDIKRT

SEQ ID NO: 2801 - protein, 103 aa, Artificial Sequence
  anti-HIV-1_LightChain
EVVLTQSPGTLSLSPGERASFSCKSSQYGHTAWYQQKLGHGPRLLIYATSRRATGIPDRFIGSQSGTEYNLTITRLDPGDFAHYFCQQNEFFGPGTRLDMKRT

SEQ ID NO: 2802 - protein, 102 aa, Artificial Sequence
  anti-HIV-1_LightChain
EIVLTQSPSSLSLSPGERASLSCRGSHGHVAWYQHKPGQIPRLLIYATSKRASGISDRFSGSGSGTDATLSISRLEPEDFAVYFCQQYEFFGQGTRLEIKRT

SEQ ID NO: 2803 - protein, 102 aa, Artificial Sequence
  anti-HIV-1_LightChain
EIMLTQSPGTLSLSPGERATLSCRGSHGHVAWYQQKPGRIPRLLIYGTSKRASGIPDRFSGSGSGTDATLTISRLESEDFAVYFCQQYEFFGQGTRLDINRT

SEQ ID NO: 2804 - protein, 103 aa, Artificial Sequence
  anti-HIV-1_LightChain
ESVLTQSPGTLSLSPGETASLSCTAALYGHMTWYQKKPGQPPKLLLYASSKRASGIPDRFSGSQFGKQYTLIITKMEPEDFAEYYCQQFEVFGQGTRLDMRRT

SEQ ID NO: 2805 - protein, 102 aa, Artificial Sequence
  anti-HIV-1_LightChain
EVVLTQSPGTLSLSPGERATLSCRGSHGHLSWYQYKPGQPPRVLIYGTSRRASGIPDRFSGSGSGTDGSLTISRLEAEDFAVYYCQQYEFFGQGTRLEMKRT

SEQ ID NO: 2806 - protein, 103 aa, Artificial Sequence
  anti-HIV-1_LightChain
EVVLTQSPGTLSLSPGERASLSCKSSQYGHTAWYQQKLGQGPRLLIYATSRRATGIPDRFSGSQSGTEYNLTITRLDPGDFAQYFCQQYEFFGPGTRLDIKRT

SEQ ID NO: 2807 - protein, 102 aa, Artificial Sequence
  anti-HIV-1_LightChain
EIMLTQSPGTLSLSPGERATLSCRGSHGHVAWYQQKPGRIPRLLIYGTSKRASGIPDRFSGSGSGTDATLTISRLESEDFAVYYCQQYEFFGQGTRLDIKRT

SEQ ID NO: 2808 - protein, 103 aa, Artificial Sequence
  anti-HIV-1_LightChain
ESVLTQSPGTLSLSPGETASLSCTAASYGHMTWYQKKPGQPPKLLIFATSKRASGIPDRFSGSQFGKQYTLTITRMEPEDFAGYYCQQVEFFGQGTRLEIRRT

SEQ ID NO: 2809 - protein, 103 aa, Artificial Sequence
  anti-HIV-1_LightChain
DIQMTQSPSSLSASVGDRVTITCQASQDISNYLNWYQQKPGKAPKLLIYDASNLETGVPSRFSGSGFHTTFSLTISGLQRDDFATYFCAVLEFFGPGTKVDFN

SEQ ID NO: 2810 - protein, 103 aa, Artificial Sequence
  anti-HIV-1_LightChain
DIQMTQSPSSLSASVGDRVTITCQASQDITNYLNWYQQKPGRAPKLLVHGASNLQRGVPSRFSGSGFHTTFTLTISSLQPDDVATYFCEVFQWFGPGTRVDFN

SEQ ID NO: 2811 - protein, 103 aa, Artificial Sequence
  anti-HIV-1_LightChain
GFQLTQSPSSLSASVGDRVSINCQAGEGIGSSLNWYQQKPGRAPKLLVHGASNLQRGVPSRFSGSGFHTTFTLTISSLQPDDVATYFCEVFQWFGPGTRVDFN

SEQ ID NO: 2812 - protein, 103 aa, Artificial Sequence
  anti-HIV-1_LightChain
GIQLTQSPSSLSVSVGDRVTITCRASQGIGNSLNWYQQKPGKAPNLMVFGTTKLNRGVPSRFSGSGSGTTATLTINSLQPEDIATYFCQVFEFLGPGTKLDMK

SEQ ID NO: 2813 - protein, 103 aa, Artificial Sequence
  anti-HIV-1_LightChain
DIQMTQSPSSLSASVGDRVTITCQAGQGIGSSLKWYQQKPGRAPRLLVHGASNLHRGVPSRFSGSGFHTTFSLTISGLQRDDFATYFCAVLEFFGPGTKVDFN

SEQ ID NO: 2814 - protein, 103 aa, Artificial Sequence
  anti-HIV-1_LightChain
GIQLTQSPSSLSASVGDRVTITCQASQGIGSSLQWYQQKPGRAPNLLVHGASNLHRGVPSRFSGSGFHTTFSLTISGLQRDDFATYFCAVLEFFGPGTKVEIK

SEQ ID NO: 2815 - protein, 103 aa, Artificial Sequence
  anti-HIV-1_LightChain
GVQLTQSPSSLSASVGDRVSINCQAGQGIGSSLNWYQQKRGKAPKLLVHGASTLQRGVPSRFSGSGFHTTFTLTISSLQPDDVATYFCEVFQWFGPGTRVDFN

SEQ ID NO: 2816 - protein, 102 aa, Artificial Sequence
  anti-HIV-1_LightChain
YIQLTQSPSSLSASIGDRVTIACRASQGIGYVHWYQQKRGKPPKLLIHGASILERGVPSRFSGSGSGTLFNLTVSGLQPEDFATYMCQVFESFGPGTKVQMK

SEQ ID NO: 2817 - protein, 103 aa, Artificial Sequence
  anti-HIV-1_LightChain
GIQLTQSPSSLSASLGDRVTITCQASQGIGSSLQWYQQKPGKAPKLLVHGASKLHRGVPSRFSGSGFHTTFSLTISSLQPEDFATYLCQVLEFFGPGTKVDFN

SEQ ID NO: 2818 - protein, 103 aa, Artificial Sequence
  anti-HIV-1_LightChain
GIQLTQSPSSLSASVGDTVTITCQASQGIGSSLQWYQQKRGRAPKLLVHGASNLQGGVPSRFSGSGFHTTFTLAIRGLQPDDFATYFCQSLEFFGPGTKVDMK

SEQ ID NO: 2819 - protein, 102 aa, Artificial Sequence
  anti-HIV-1_LightChain
YIQLTQSPSSLSASVGDRVTITCRASQDIGYVSWYAQKRGRAPKLLIHGASGLERGVPSRFSGSGSGTLFTLTIESLQPEDFATYMCQVFESFGPGTKVEMK

SEQ ID NO: 2820 - protein, 103 aa, Artificial Sequence
  anti-HIV-1_LightChain
GIQLTQSPSSLSASVGDRVSINCQAGQGIGSSLNWYQQKPGRAPKLLVHGASNLQRGVPSRFSGSGFHTTFTLTISSLQPDDVATYFCAVFQWFGPGTRVDFN

SEQ ID NO: 2821 - protein, 122 aa, Artificial Sequence
  anti-HIV-1_HeavyChain
SQQLVQSGTQVKKPGASVRISCQASGYTFTDYVLHWWRQAPGQGLEWMGWIKPVYGARNYARRFQGRIDFSRDIYREIAYMDLSGLRSDDTALYFCARDGSGDDTSWHLDPWGQGTLVIVSA

SEQ ID NO: 2822 - protein, 122 aa, Artificial Sequence
  anti-HIV-1_HeavyChain
SQQLVQSGTQVKKPGASVRISCQASGYTFTDYLLHWWRQAPGQRLEWMGWIKPVYGARNYAHRFQGRINFDRDIYREIAFMDLSGLRSDDTAVYFCARDGGGDDRTWLLDTWGQGTLVVVSS

SEQ ID NO: 2823 - protein, 122 aa, Artificial Sequence
  anti-HIV-1_HeavyChain
QVHLEQPGSVVRWPGASLTLSCTASGYIFVNYHIHWLRQAPGQRLELLGTINPVGGATSYAQKFRGRLVLTRDIGSSTVTLLLNHLRRDDSAVYFCARESNASGRGRSMDHWGRGSRVIVSQ

SEQ ID NO: 2824 - protein, 122 aa, Artificial Sequence
  anti-HIV-1_HeavyChain
QVQLVQSGAEVKKPGASVRVSCQASGYTFTNYILHWWRQAPGQGLEWMGLIKPVYGAVNYARQFQGRIQLTRDIYREIAFLDLSGLRSDDTAVYYCARDESGDDLKWHLHPWGQGTQVIVSP

SEQ ID NO: 2825 - protein, 122 aa, Artificial Sequence
  anti-HIV-1_HeavyChain
QVQLVQSGAEVKKPGASVRISCQASGYTFTDYVLHWWRQAPGQGLEWMGWIKPVYGARNYARRFQGRINFDRDIYREIAYMDLSGLRSDDTARYFCARDGSGDDTSWHLHPWGQGTLVIVSA

SEQ ID NO: 2826 - protein, 122 aa, Artificial Sequence
  anti-HIV-1_HeavyChain
SQQLVQSGTQVKKPGASVRVSCQASGYTFTNYILHWWRQAPGQGLEWMGLIKPVYGAVNYARQFQGRIQLTRDIYREIAFLDLSGLRTDDTAVYYCARDESGDDLKWHLHPWGQGTQVIVSP

SEQ ID NO: 2827 - protein, 122 aa, Artificial Sequence
  anti-HIV-1_HeavyChain
QVHLEQSGSVVRWPGASLTLSCTASGYIFVNYHIHWLRQAPGQRLELMGTINPVGGATSYTQRFRGRLVLTRDIGSNTVTLLLNHLRSDDSAVYFCARESNASGRGRSMDHWGRGSHVIVSP

SEQ ID NO: 2828 - protein, 122 aa, Artificial Sequence
  anti-HIV-1_HeavyChain
SQHLVQSGTQVKKPGASVRVSCQASGYTFTNYILHWWRQAPGQGLEWMGLIKPVYGAVNYARQFQGRIQLTRDIYRDIAFLDLSGLRSDDTAVYYCARDESGDDLKWHLHPWGQGTQVIVSP

SEQ ID NO: 2829 - protein, 122 aa, Artificial Sequence
  anti-HIV-1_HeavyChain
SQQLVQSGTQVKKPGASVRISCQASGYTFTDYVLHWWRQAPGQGLEWMGWIKPVYGARNYARRFQGRINFDRDIYREIAYMDLSGLRSDDTARYFCARDGSGDDTSWHLHPWGQGTLVIVSA

SEQ ID NO: 2830 - protein, 122 aa, Artificial Sequence
  anti-HIV-1_HeavyChain
QVHLEQPGSVVRWPGASLTLSCTASGYIFVNYHIHWLRQAPGQRLELLGTINPVGGATSYAQKFRGRLVLTRDIGSSTVTLLLNHLRRDDSAVYFCARESNASGRGRSMDHWGRGKPVIVSP

SEQ ID NO: 2831 - protein, 107 aa, Artificial Sequence
  anti-HIV-1_HeavyChain
EIVMTQSPAILSVSPGDRATFSCRASQSVKNNLAWYQKRPGQAPRLLIFDASSRASGIPARFSGGGSGTEFTLTVNSMQSEDFATYYCQQYEEWPRTFGQGTKVEIM

SEQ ID NO: 2832 - protein, 107 aa, Artificial Sequence
  anti-HIV-1_HeavyChain
QIVLTQSPPTLSLSPGERATLSCRASQSVKNNLAWYQKRPGQAPRLLIFDTSSRASNIPARFSGGGSGTEFTLTVNSMQSEDFATYYCQQYEEWPRTFGQGTKVEII

SEQ ID NO: 2833 - protein, 107 aa, Artificial Sequence
  anti-HIV-1_HeavyChain
EIVMTQSPAVLSVSPGDRATLSCRASQSVKNNLAWYQKRPGQAPRLLIFDTSSRASNIPARFSGGGSGTEFTLTVNSMQSEDFATYYCQQYEEWPRTFGQGTKVEIN

SEQ ID NO: 2834 - protein, 107 aa, Artificial Sequence
  anti-HIV-1_HeavyChain
EIVLTQSPPTLSVSPGEAATLSCRASQSVKNNLAWYHLKAGQAPRLLIFDASSRAGDAPARVSGSGYGTEFTLTVNSVQSEDFGDYYCQQYEEWPRTFGQGTKVDLR

SEQ ID NO: 2835 - protein, 107 aa, Artificial Sequence
  anti-HIV-1_HeavyChain
EIVMTQSPPTLSVSPGETATLSCRASQNVKNNLAWYQLKPGQAPRLLIFDASSRAGGIPDRFSGSGYGTDFTLTVNSVQSEDFGDYFCQQYEEWPRTFGQGTKVDLR

SEQ ID NO: 2836 - protein, 107 aa, Artificial Sequence
  anti-HIV-1_HeavyChain
EIVMTQSPAVLSVSPGDRATLSCRASQSVKNNLAWYQKRPGQAPRLLIFDTSSRASNIPARFSGGGSGTEFTLTVNSMQSEDFATYYCQQYEEWPRTFGQGTKVEII

SEQ ID NO: 2837 - protein, 133 aa, Artificial Sequence
  anti-HIV-1_HeavyChain
EVHLQESGPGLVRPLETLSLTCTASGASIRGGEWGDNDYHWGWVRHSPEKGLEWIGSIHWRGTTHYNAPFRGRATLSIDTSRNQFFLRLTSMTADDTAVYYCVKHKYHDIVMVVPIAGWFDPWGQGLQVTVSA

SEQ ID NO: 2838 - protein, 133 aa, Artificial Sequence
  anti-HIV-1_HeavyChain
EVHLQESGPGLVRPLETLSLTCTASGASIRGGEWGDNDYHWGWVRHSPEKGLEWIGSIHWRGTTHYNAPFRGRATLSIDTSRNQFFLRLTSMTADDTAVYYCVKHKYHDIVMVVPIAGWFNPWGQGLQATVPS

SEQ ID NO: 2839 - protein, 133 aa, Artificial Sequence
  anti-HIV-1_HeavyChain
QVQLKESGPGLVKPSETLSLTCTVSGGSMRGTDWGENDFHYGWIRHSSAEGLEWIGSIHWRGTTHYKMSFRSRATISIDTSNNRFSLMFSFVTAEDTAVYYCARHKYHDIFRVVPVAGWFDPWGQGLLVTVSS

SEQ ID NO: 2840 - protein, 133 aa, Artificial Sequence
  anti-HIV-1_HeavyChain
EVHLQESGPGLVRPLETLSLTCTASGASIRGGEWGDNDYHWGWVRHSPEKGLEWIGSIHWRGTTHYNAPFRGRATLSIDTSKNQFSLRLTSMTADDTAVYYCVKHKYHDIVMVVPFAGWFDPWGQGLRVTVSA

SEQ ID NO: 2841 - protein, 133 aa, Artificial Sequence
  anti-HIV-1_HeavyChain
EVHLQESGPGLVRPLETLSLTCTASGASIRGGEWGDNDYHWGWVRHSPEKGLEWIGSIHWRGTTHYNAPFRGRATLSIDTSKNQFFLRLTSMTADDTAVYYCVKHKYHDICMVVPIAGWFDPWGQGLQVTVSQ

SEQ ID NO: 2842 - protein, 133 aa, Artificial Sequence
  anti-HIV-1_HeavyChain
QVHLQESGPGLVRPLETLSLTCTASGASIRGGEWGDNDYHWGWVRHSPEKGLEWIGSIHWRGTTHYNAPFRGRATLSIDTSRNQFFLRLTSMTADDTAVYYCVKHKYHDIVMVVPIAGWFDPWGQGLQVTVSS

SEQ ID NO: 2843 - protein, 133 aa, Artificial Sequence
  anti-HIV-1_HeavyChain
QVHLQESGPGLVRPLETLSLTCTASGASIRGGEWGDNDYHWGWVRHSPEKGLEWIGSIHWRGTTHYNAPFRGRATLSIDTSRNQFFLRLTSMTADDTAVYYCVKHKYHDIVMVVPIAGWFDPWGQGLRVTVSQ

SEQ ID NO: 2844 - protein, 133 aa, Artificial Sequence
  anti-HIV-1_HeavyChain
QVHLQESGPGLVRPLETLSLTCTASGASIRGGEWGDNDYHWGWVRHSPGKGLEWIGSIHWRGTTHYNAPFRGRATLSIDTFRNQFFLRLTSMTADDTAVYYCVKHKYHDIVMVVPIAGWFDPWGQGLQVTVSQ

SEQ ID NO: 2845 - protein, 133 aa, Artificial Sequence
  anti-HIV-1_HeavyChain
EVHLQESGPGLVRPLETLSLTCTASGASIRGGEWGDNDYHWGWVRHSPEKGLEWIGSIHWRGTTHYNAPFRGRATLSIDTSRNQFFLRLTSMTADDTAVYYCVKHKYHDIVMVVPIAGWFDPWGQGLRGTVSA

SEQ ID NO: 2846 - protein, 131 aa, Artificial Sequence
  anti-HIV-1_HeavyChain
QVQLVQSGAVIKTPGSSVKISCRASGYNFRDYSIHWVRLIPDKGFEWIGWIKPLWGAVSYARQLQGRVSMTRQLSRDPDDPDWGVAYMEFSGLTPADTAEYFCVRRGSCDYCGDFPWQYWGQGTVVVVSSA

SEQ ID NO: 2847 - protein, 131 aa, Artificial Sequence
  anti-HIV-1_HeavyChain
QVQLVQSGAVIKTPGSSVKLSCRASGYNFRDYSIHWVRLIPDKGFEWIGWIKPLWGAVSYARQLQGRVSMTRQLSQDPDDPDWGVAYMEFSGLTPADTAEYFCVRRGSCDYCGDFPWQYWGQGTVVVVSSA

SEQ ID NO: 2848 - protein, 101 aa, Artificial Sequence
  anti-HIV-1_LightChain
TAGLTQSPGTLSLSPGERAILSCRTSQYGSLAWYQQRPGQAPRLVIYAGLTRATGIPDRFSGSRWGAEYNLTISNLESEDFGVYYCQQYDFFGQGTKVQVD

SEQ ID NO: 2849 - protein, 126 aa, Artificial Sequence
  anti-HIV-1_HeavyChain
QVQLVQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSA

SEQ ID NO: 2850 - protein, 128 aa, Artificial Sequence
  anti-HIV-1_HeavyChain
QVQLVQSGSGVKKLGASVRVSCWTSEDIFERTELIHWVRQAPGQGLEWIGWVKAVTGTVNFGSLNFRQRVSLTRDRDLFTAHMDIRGLTQGDTATYFCARQKFEKYTGGQGWYFDLWGRGTLIVVSSA

SEQ ID NO: 2851 - protein, 126 aa, Artificial Sequence
  anti-HIV-1_HeavyChain
QVQLVQSGSAMKKPGASVRVSCWTSEDIFDTTELIYWVRQAPGQGLEWIGWVKIVSGTVNFASLDFRNRISLSRDRDLFTAHMDIRGLTQGDTATYFCARQKFYAGGQGWYFDLWGRGTLIVVSSA

SEQ ID NO: 2852 - protein, 129 aa, Artificial Sequence
  anti-HIV-1_HeavyChain
QVQLVQSGAEVKKPGASVRVSCWTSEDIFDTTELIYWVRQAPGQGLEWIGWVKIVSGTVNFASLDFRNRISLSRDRDLSTAHMDIRGLTQDDTATYFCARQKFESRYTGGQGWYFDLWGRGTHIVVSSA

SEQ ID NO: 2853 - protein, 129 aa, Artificial Sequence
  anti-HIV-1_HeavyChain
QVQLVQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSSA

SEQ ID NO: 2854 - protein, 129 aa, Artificial Sequence
  anti-HIV-1_HeavyChain
QVQLVQSGLEVKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSA

SEQ ID NO: 2855 - protein, 129 aa, Artificial Sequence
  anti-HIV-1_HeavyChain
QVQLVQSASGVRRPGASVRVSCWTSEDIFERSELIYWVRQAPGRGLEWIGWIKLVSGAVNFGSVDFRDRVSLTRDRDLFTAHMDIRGLTQDDTATYFCARQKFASRYSGDQGSYFDLWGRGTLIIVSSA

SEQ ID NO: 2856 - protein, 125 aa, Artificial Sequence
  anti-HIV-1_HeavyChain
QVQLVQSGSGVKKPGASVRVSCWTSEGIFEKSELIHWVRQAPGQGLEWIGWVKTVTGAVNFGHQISDRVSLTRDRDLFTAHMDIRGLTQGDTATYFCARQKFERGGQGWIFDLWGRGTLIAVSSA

SEQ ID NO: 2857 - protein, 126 aa, Artificial Sequence
  anti-HIV-1_HeavyChain
QVQLVQSGAEVKKPGASVRVSCWTSEDIFEKSELIHWVRQAPGQGLEWIGWVKTVTGAVNFGSSDFRQRVSLTRDRDLFTAHMDIRGLTQGDTATYFCARQKFERGGQGWYFDLWGRGTLIVVSSA

SEQ ID NO: 2858 - protein, 126 aa, Artificial Sequence
  anti-HIV-1_HeavyChain
QVQLVQSGAEVKRPGASVKVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSSA

SEQ ID NO: 2859 - protein, 126 aa, Artificial Sequence
  anti-HIV-1_HeavyChain
QVQLVQSGSGVKKPGASVRVSCWTSEDIFEGSELIHWVRQAPGQGLEWIGWVKTVTGAVNFGSAYFRHRVSLTRDRDLFTAHMDIRGLTQGDTATYFCARQKFMSGGQGWYFDLWGRGTVIVVSSA

SEQ ID NO: 2860 - protein, 129 aa, Artificial Sequence
  anti-HIV-1_HeavyChain
QVQLVPSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSA

SEQ ID NO: 2861 - protein, 126 aa, Artificial Sequence
  anti-HIV-1_HeavyChain
QVQLVQSGSGVKKVGASVRVSCWTSEDIFERTELIHWVRQAPGQGLEWIGWVKAVSGAVNYGSLDFRHRVSLTRDRDLFTAHMDIRGLTQDDTAIYFCARQKFYAGGQGWYFDLWGRGTLIVVSSA

SEQ ID NO: 2862 - protein, 129 aa, Artificial Sequence
  anti-HIV-1_HeavyChain
QVQLVQSGAEVKKPGSSVRVSCWTSEDIFERTELIHWVRQAPGQGLEWIGWVKTVTGAVNFGSPNFRHRVSLTRDRDLFTAHMDIRGLTQGDTATYFCARQKFESRYSGDQGSYFDLWGRGTLIIVSSA

SEQ ID NO: 2863 - protein, 125 aa, Artificial Sequence
  anti-HIV-1_HeavyChain
QVQLVQSGAEVKKPGASVKVSCKASGYTFTSYYMHWVRQAPGQGLEWIGWVKPVTGAVNFGSPNFRHRVSLTRDRDLFTAHMDIRGLTQGDTATYFCARQKYYAGGQGWYFDLWGRGTLIVVSSA

SEQ ID NO: 2864 - protein, 125 aa, Artificial Sequence
  anti-HIV-1_HeavyChain
QVQLVQSGAEVKKPGASVQVSCKASGYPFTKYYMHWVRQAPGQGLEWIGWVKAVSGAVNYGSLDFRHRVSLTRDRDLSTAHMDIRGLTQDDTATYFCARQKFARGDQGWFFDLWGRGTLIVVSSA

SEQ ID NO: 2865 - protein, 125 aa, Artificial Sequence
  anti-HIV-1_HeavyChain
QVQLVQSGAEVKKPGASVKVSCKASGYTFTGYYMHWVRQAPGQGLEWIGWVKTVSGAVNFGSLNFRHRVSLTRDRDLFTAHMDIRGLTQGDTATYFCARQKFARGDQGWFFDLWGRGTLIVVSSA

SEQ ID NO: 2866 - protein, 134 aa, Artificial Sequence
  anti-HIV-1_HeavyChain
QVQLVQSGSGVKKPGASVRVSCRASEDLFGDEIIYDDEVIHWLRQVPGQRPEWMGWIRPKTGARNQARQFQPRISLTRDRALSTAYLDLNSLTSADSGTYFCARQTFKPDFYFADQGWSFNLWGRGAHFIVSSA

SEQ ID NO: 2867 - protein, 127 aa, Artificial Sequence
  anti-HIV-1_HeavyChain
QVQLVQSGGGVKKPGASASFSCRTSEDPFDNEFFDSEFMHWVRLTPGQRPEWMGWMNPRSGGVNYAGQFRPRMSMWRDRELSTAYMELRDLTFADTGLYFCARRKEDDYDWYYDLWGRGAHIIVSAA

SEQ ID NO: 2868 - protein, 128 aa, Artificial Sequence
  anti-HIV-1_HeavyChain
QVQLVQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSA

SEQ ID NO: 2869 - protein, 128 aa, Artificial Sequence
  anti-HIV-1_HeavyChain
QVQLVQSGAEVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSA

SEQ ID NO: 2870 - protein, 128 aa, Artificial Sequence
  anti-HIV-1_HeavyChain
QVQLVQSEAEVKKPGASMTVSCETADEDIFDAAYMHWVRQAPGQTFEWLGWMKPVTGAVNYARKFQGRISFYRTRELAIAYMDLRDLRFDDTAVYFCARKTAGDVSGDNRGYFFDLWGRGSRVIVSSA

SEQ ID NO: 2871 - protein, 140 aa, Artificial Sequence
  anti-HIV-1_HeavyChain
QSHLEQSGSAMKKPGASVRVSCWTSEDIFDTTELLWVRQAPGQGLEWIGWVKIVSGTVNFASLDFRNRISLSRDRDLSTAHMDIRGLTQDDTATYYCARQKFASRYSGDQGSYFDLWGRGTLIIVSSASTKGPSVFPHDL

SEQ ID NO: 2872 - protein, 139 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLFTAHMDIRGLTQGDTATYFCARQKFERGGQGWYFDLWGRGTLIVVSSASTNGPIGLPPRSA

SEQ ID NO: 2873 - protein, 141 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFESLYSDDQGSYFDLWGRGTLIIVSSASTKGPSSSPTIC

SEQ ID NO: 2874 - protein, 139 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 2875 - protein, 137 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSSSLHQGPSGLPHD

SEQ ID NO: 2876 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 2877 - protein, 142 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYYCARQKFESLYSDDQGSYFDLWGRGTLIIVSSASTKGPSVFPHDLR

SEQ ID NO: 2878 - protein, 128 aa, Artificial Sequence
  anti-HIV-1_HeavyChain
QVHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFESRYTGGQGWYFDLWGRGTHIVVSS

SEQ ID NO: 2879 - protein, 141 aa, Artificial Sequence
  anti-HIV-1_HeavyChain
QVYMEQAGAGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVFPHDLR

SEQ ID NO: 2880 - protein, 138 aa, Artificial Sequence
  anti-HIV-1_HeavyChain
QAHLEQSGSGVKKPGTSVRVSCWTSEDIFERTELIHWVRQAPGQGLEWIGWVKTVTGAVNFGSPNFRHRVSLTRDRDLFTAHMDIRGLTQGDTATYFCARQKFARGDQGWFFDLWGRGTLIVVSSASTKGPSVFPTIC

SEQ ID NO: 2881 - protein, 137 aa, Artificial Sequence
  anti-HIV-1_HeavyChain
QVQLVQSGAEVKKPGASVKVSCKASGYTFTSYYMHWVRQAPGQGLEWIGWVKPVTGAVNFGSPNFRHRVSLTRDRDLFTAHMDIRGLTQGDTATYFCARQKYYAGGQGWYFDLWGRGTLIVVSSASTKGPVVFPTIC

SEQ ID NO: 2882 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 2883 - protein, 128 aa, Artificial Sequence
  anti-HIV-1_HeavyChain
QAHLEQSGSGVKKPGASVRVSCWTSEDIFERTELIHWVRQAPGQGLEWIGWIKTVTGAVNFGSLDFRHRISLTRDRDLFTAHMDIRGLTQGDTATYFCARQKFESRYTGGQGWYFDLWGRGTHIVVSS

SEQ ID NO: 2884 - protein, 140 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFERGGQGWYFDLWGRGTLIVVSSASTEGPSRSFPQILR

SEQ ID NO: 2885 - protein, 138 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLICVSSASPRAHRSSPRSA

SEQ ID NO: 2886 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTRGDTATYYCARQKFESRYTGGQGWYFDLWGRGTHIVVSS

SEQ ID NO: 2887 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIIVSS

SEQ ID NO: 2888 - protein, 141 aa, Artificial Sequence
  anti-HIV-1_HeavyChain
QSHLEQSGSAMKKPGASVRVSCWTSEDIFDTTSIFIGCDRPLDKDWSGLGGSKLSLAPSIFASLDFRNRISLSRDRDLSTAYMDIRGLTQDDTATYFCARQKFASRYSGDQGSYFDLWGRGTLIVVSSASTKGPSVFPHDL

SEQ ID NO: 2889 - protein, 133 aa, Artificial Sequence
  anti-HIV-1_HeavyChain
REYLEQSGGGVKKLGASVRVSCRASEDLFGDEVIYDDELIHWLRQVPGQRPEWMGWIRPKTGARNQARQFQPRINLSRDRALNTAYLDLSSLTSADSATYFCARQTFKPDFYFADQGWSFNLWGRGARVIVSS

SEQ ID NO: 2890 - protein, 128 aa, Artificial Sequence
  anti-HIV-1_HeavyChain
QVHLVQSGAEVKKPGSSVRVSCWTSEDIFERTELIHWVRQAPGQGLEWIGWVKTVTGAVNFGSPNFRHRVSLTRDRDLFTAHMDIRGLTQGDTATYFCARQKFESRYSGDQGSYFDLWGRGTLIIVSS

SEQ ID NO: 2891 - protein, 138 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVFPTIC

SEQ ID NO: 2892 - protein, 147 aa, Artificial Sequence
  anti-HIV-1_HeavyChain
REFLEQSGGGVKKLGASLRVSCRASEDLFGDEFIYDDEVIHWLRQVPGQRPEWMGWIRPKTGARNQATQFQPRISLTRDRALSTAYLDLNSLTSADSGTYFCARQTFKPDFYFADQGWSFNLWGRGAHFIVSSASTKGPSVFPHDSA

SEQ ID NO: 2893 - protein, 133 aa, Artificial Sequence
  anti-HIV-1_HeavyChain
REYLEQSGGGVKKLGASLRVSCRASEDLFGDEIIYDDEVIHWLRQVPGQRPEWMGWIRPKTGARNQARQFQPRISLTRDRALSTAYLDLNSLTSADSGTYFCARQTFKPDFYFADQGWSFNLWGRGAHFIVSS

SEQ ID NO: 2894 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 2895 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 2896 - protein, 138 aa, Artificial Sequence
  anti-HIV-1_HeavyChain
QAHLEQSGTGVKKPGASVRVSCWTSEDIFEKSELIHWVRQAPGQGLEWIGWVKIVSGAVNFGSPNFRQRVSLTRDRDLFTAQMDIRGLTQGDTATYFCARQKFERGGQGWIFDLWGRGTLIAVSSASTKGPSVFPHDL

SEQ ID NO: 2897 - protein, 133 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSG

SEQ ID NO: 2898 - protein, 138 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTHDRDLFTAHMDIRGLTQGDTATYFCARQKFYAGGQGWYFDLWGRGTLICVSSASTKGPSGLPPRS

SEQ ID NO: 2899 - protein, 142 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFESLYSDDQGSYFDLWGRGTLIIVSSASTKGPSVFPHDLR

SEQ ID NO: 2900 - protein, 138 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYYCARQKFERGGQGWYFDLWGRGTLIVVSSASTKGPSVFPTIY

SEQ ID NO: 2901 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYYCARQKFESRYTGGQGWYFDLWGRGTHIVVSS

SEQ ID NO: 2902 - protein, 138 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLFTAHMDIRGLTQGDTATYYCARQKFYKGGQGWYFDLWGRGTLIVVSSASTKGPSVFPTIC

SEQ ID NO: 2903 - protein, 133 aa, Artificial Sequence
  anti-HIV-1_HeavyChain
REYLEQSGGGVKKPGASVRVSCRASEDLFGDEIIYDDEVIHWLRQVPGQRPEWMGWIRPKNGGRNQARQFQPRISLTRDRALNTAYLDLNSLTSADSGTYFCARQTFKPDFYFADQGWSFNLWGRGARVIVSS

SEQ ID NO: 2904 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 2905 - protein, 140 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSASTKGPSVFPTIC

SEQ ID NO: 2906 - protein, 139 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLFTAHMDIRGLTQSDTATYFCARQKFYAGGQGWYFDLWGRGTLIVVSSASTKGPSVFPHDLR

SEQ ID NO: 2907 - protein, 142 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSSASPKGPSGLPPRSA

SEQ ID NO: 2908 - protein, 137 aa, Artificial Sequence
  anti-HIV-1_HeavyChain
QVQLVQSGAEVKKPGASVKVSCKASGYTFTTYGISWVRQAPGQGLEWIGWVKTVTGAVNFGHQISDRVSLTRDRDLFTAHMDIRGLTQGDTATYFCARQKFYAGGQGWYFDLWGRGTLIVVSSASTKGPSVFPHDLR

SEQ ID NO: 2909 - protein, 139 aa, Artificial Sequence
  anti-HIV-1_HeavyChain
QAQLEQSGSGVKKPGASVRVSCWTSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 2910 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYYCARQKFERGGQGWYFDLWGRGTLIVVSS

SEQ ID NO: 2911 - protein, 128 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYYCARQKFESRYTGGQGWYFDLWGRGTHIVVSS

SEQ ID NO: 2912 - protein, 138 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPTIC

SEQ ID NO: 2913 - protein, 127 aa, Artificial Sequence
  anti-HIV-1_HeavyChain
QVQLVQSGAEVQKPGASVTVSCKASGYTLISYGISWVRQAPGQGPEWMGWIRPKTGARNQARQFQPRISLTRDRALSTAYLDLNSLTSADSGTYFCARQTFKPDFYFADQGWSFNLWGRGAHFIVSS

SEQ ID NO: 2914 - protein, 138 aa, Artificial Sequence
  anti-HIV-1_HeavyChain
QAHLEQSGSGVKKPGASVRVSCWTSEDILRKKELIHWVRQAPGQGLEWIGWVKTVTGTVNFGSSDFRQRVSLTRDRDLFTAHMDIRGLTQGDTATYLCARQKFERGGQGWIFDLWGRGTLIAVSSASTKGPSVFPHDL

SEQ ID NO: 2915 - protein, 142 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTNGPIGLPHRSA

SEQ ID NO: 2916 - protein, 128 aa, Artificial Sequence
  anti-HIV-1_HeavyChain
QAHLEQSGSGVKKPGASVRVSCWTSEDIFGKSELIHWVRQAPGQGLEWIGWVKTVTGAVNFGSSDFRQRVSLTRDRDLFTAHMDIRGLTQGDTATYFCARQKFESLYSDDQGSYFDLWGRGTLIIVSS

SEQ ID NO: 2917 - protein, 139 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWYFDLWGRGTLIVVSSASTKGPSGLPHGSA

SEQ ID NO: 2918 - protein, 141 aa, Artificial Sequence
  anti-HIV-1_HeavyChain
QVQYGREAGAGMKKPGASMTVSCKTADEDIFDAAYMHRVRQAPGQTFEWLGWMKPVTGAVNYARQFQGRVSFYRTRELGIAYMDLRDLKFDDTAVYFCARKTKGDVSGDDRGFFFDLWGRGTRVIVSSASTKGPSVFPTIY

SEQ ID NO: 2919 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 2920 - protein, 141 aa, Artificial Sequence
  anti-HIV-1_HeavyChain
QVQLVQSEAELKKPGASVSVSCKASGYSFTSYGISWVRQVPGQGLEWIAWIRPKTGARNQARQFQPRISLTRDRALSTAYLDLNSLTSADSGTYFCARQTFKPDFYFADQGWSFNLWGRGAHFIVSSASTKGPSVFPHDLR

SEQ ID NO: 2921 - protein, 138 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYYCARQKFERGGQGWYFDLWGRGTLIVVSSASTKGPSVFPHDL

SEQ ID NO: 2922 - protein, 127 aa, Artificial Sequence
  anti-HIV-1_HeavyChain
QVQLVQSGAEVQKPGASVTVSCKASGYTLISYGISWVRQAPGQGPEWMGWIRPKTGARNQARQFQPRISLTRDRALSTAYLDLNSLTSADSGTYYCARQTFKPDFYFADQGWSFNLWGRGAHFIVSS

SEQ ID NO: 2923 - protein, 138 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPQIC

SEQ ID NO: 2924 - protein, 126 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLICVSSA

SEQ ID NO: 2925 - protein, 146 aa, Artificial Sequence
  anti-HIV-1_HeavyChain
QGYLAQSGGGVKKPGTSASFSCRTSDDIYDNEFFDSAFMHWVRLIPGQRPEWMGWMNPRSGAVNYARQLQPRVSMYRDRDLSTAYLDLNSLTSADSGTYFCARQTFKPDFYFADQGWSFNLWGRGAHFIVSSASTKGPSVLPHDLR

SEQ ID NO: 2926 - protein, 138 aa, Artificial Sequence
  anti-HIV-1_HeavyChain
QAHLEQSGSGVKKPGASVRVSCWTSEDIFERTELTHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVFPRSA

SEQ ID NO: 2927 - protein, 138 aa, Artificial Sequence
  anti-HIV-1_HeavyChain
QAHLEQSGSGVKKPGASVRVSCWTSEDIFEKKELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDL

SEQ ID NO: 2928 - protein, 128 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSLDFRHRISLTRDRDLFTAHMDIRGLTQGDTATYYCARQKFESRYTGGQGWYFDLWGRGTHIVVSS

SEQ ID NO: 2929 - protein, 138 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYYCARQKFYAGGQGWYFDLWGRGTLIVVSSASTKGPSVFPTIC

SEQ ID NO: 2930 - protein, 128 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFESLYSDDQGSYFDLWGRGTLIIVSS

SEQ ID NO: 2931 - protein, 142 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLFTAHMDIRGLTQGDTATYFCARQKFESRYTGGQGWYFDLWGRGTHIVVSSASTKGPSVFPHDLR

SEQ ID NO: 2932 - protein, 136 aa, Artificial Sequence
  anti-HIV-1_HeavyChain
QVQLVHSGAEVKKPGASMKVSCKTSGYSFTGYYMHWVRQAPGQGLEWMGWINPSSNDTNYAQKFQGRVTMTRDTSINTAYMELSRLRSGDTAIYFCARQKFYAGGQGWYFDLWGRGTLIVVSSASTKGPSVFPTIC

SEQ ID NO: 2933 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARRFQGRVSFYMTRELGMAYMDLRNLRFDDTAVYFCARKTAGDVSGDNRGYFFDLWGRGSRVIVSS

SEQ ID NO: 2934 - protein, 138 aa, Artificial Sequence
  anti-HIV-1_HeavyChain
QGTLEQSWSEVKKLGASVRVSCWTSEDIFKTELIHWVRQAPGQGLEWIGGMKAVSGAVNYGSLDFRHRVSLTPDRDLSTAHMDIRGLTQDDTATYFCARQKFARGDQGWFFDLWGRGTLIVVSSASTKGPSVFPHDLR

SEQ ID NO: 2935 - protein, 141 aa, Artificial Sequence
  anti-HIV-1_HeavyChain
QAHLEQSGSGVKKPGASVRVSCWTSEDIFEKSELIHWVRQAPGQGLEWIGWVKTVTGAVNFASLDFRNRISLSRDRDLSTAYMDIRGLTQDDTATYFCARQKFASRYSGDQGSYFDLWGRGTLICVSSASTRAHRLPPRSA

SEQ ID NO: 2936 - protein, 138 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFARGDQGWFFDLWGRGTLIVVSSASPRAHRSSPRSA

SEQ ID NO: 2937 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDSA

SEQ ID NO: 2938 - protein, 138 aa, Artificial Sequence
  anti-HIV-1_HeavyChain
QAHLVQSGSGVKKPGASVRVSCWTSEDIFKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 2939 - protein, 138 aa, Artificial Sequence
  anti-HIV-1_HeavyChain
QAQLEQSGSGVKKPGASVRVSCWTSEDIFKTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 2940 - protein, 139 aa, Artificial Sequence
  anti-HIV-1_HeavyChain
QAHLEQSGREVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 2941 - protein, 128 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRISLTRDRDLFTAHMDIRGLTQGDTATYYCARQKFESRYTGGQGWYFDLWGRGTHIVVSS

SEQ ID NO: 2942 - protein, 125 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLFTAHMDIRGLTQGDTATYYCARQKFYKGGQGWYFDLWGRGTLIVVSS

SEQ ID NO: 2943 - protein, 127 aa, Artificial Sequence
  anti-HIV-1_HeavyChain
QVQLVQSGAEVKKPGASVKVSCKASGYTFTDYYLHWVRQAPGQGLDWVGWINPNSGGTNYAQKFQGRVAMTRDTSLSSVYLDLNSLTSADSGTYFCARQTFKPDFYFADQGWSFNLWGRGAHFIVSS

SEQ ID NO: 2944 - protein, 138 aa, Artificial Sequence
  anti-HIV-1_HeavyChain
QADLEQSGSGVKKPGASVRVSCWTSEDIFERTNYVHWVRQAPGRGLEWIGWSKTVTGAVNFGSPNFRHRVSLTRDRDLFTAHMDIRGLTQGDTATYFCARQKFERGGQGWYFDLWGRGTLIVVSSASTKGPSVFPHDL

SEQ ID NO: 2945 - protein, 127 aa, Artificial Sequence
  anti-HIV-1_HeavyChain
QVYMEQAGGGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 2946 - protein, 128 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 2947 - protein, 138 aa, Artificial Sequence
  anti-HIV-1_HeavyChain
QAHLEQSGSGVKKLGASVRVSCWTSEDIFERTNLIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPHDL

SEQ ID NO: 2948 - protein, 127 aa, Artificial Sequence
  anti-HIV-1_HeavyChain
QVYMEQAGGGVKKPGASVTLSCKTAGEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 2949 - protein, 128 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLITVSS

SEQ ID NO: 2950 - protein, 143 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSGLPPTICR

SEQ ID NO: 2951 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFARGDQGWFFDLWGRGTLIVVSSASTKGPSVFPHDLR

SEQ ID NO: 2952 - protein, 139 aa, Artificial Sequence
  anti-HIV-1_HeavyChain
QAHLEQSGSGVKKPGTSVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 2953 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRGRDLFTAHMDIRGLTQGDTATYYCARQKFERGGQGWYFDLWGRGTLIVVSSASTKGPSVFPHDLR

SEQ ID NO: 2954 - protein, 137 aa, Artificial Sequence
  anti-HIV-1_HeavyChain
QAHLGANWSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPQI

SEQ ID NO: 2955 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 2956 - protein, 141 aa, Artificial Sequence
  anti-HIV-1_HeavyChain
QAQLEQSGVGVKKPGASVRVSCLASEDIFKTELIHWVRQAPGQGLEWIGWVKTVTGAVNFGSQIFRHRISLTRDRDLFTAHMDIRGLTQGDTATYFCARQKFESRYTGGQGWYFDLWGRGTHIVVSSASTKGPSVFPHDLR

SEQ ID NO: 2957 - protein, 137 aa, Artificial Sequence
  anti-HIV-1_HeavyChain
QAHLEQSGSGVKKPGASVRVSCWTSEDIFEKSELIHWVRQAPGQGLEWIGWVKTVTGAVNFAHQISDRVSLTRDRDLFTAHMDIRGLTQGDTATYFCARQKFYAGGQGWYFDLWGRGTLIVVSSASTKGPSVFPTIC

SEQ ID NO: 2958 - protein, 125 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSPNFRHRVSLTRDRDLFTAHMDIRGLTQGDTATYFCARQKYYAGGQGWYFDLWGRGTLICVSS

SEQ ID NO: 2959 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 2960 - protein, 125 aa, Artificial Sequence
  anti-HIV-1_HeavyChain
QAHLEQSGSGVKKLGASVRVSCWTSEDIFERTELIHWVRQAPGRGLEWIGWVKAVSGAVNYGSLDFRHRVSLTRDRDLFTAHMDIRGLTQDDTATYFCARQKFARGDQGWFFDLWGRGTLIVVSS

SEQ ID NO: 2961 - protein, 127 aa, Artificial Sequence
  anti-HIV-1_HeavyChain
QVYMEQAGGGVKKPGASVTLSCKTADEGVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 2962 - protein, 125 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLFTAHMDIRGLTQGDTATYFCARQKYYAGGQGWYFDLWGRGTLIVVSS

SEQ ID NO: 2963 - protein, 126 aa, Artificial Sequence
  anti-HIV-1_HeavyChain
QVYMEQPGVEVTKPGASVTLSCKTAEDVFDAAYMHWVRQAPGQTFEWLGWIKPVTGAVNYARKFQGRVSFYRTRELGIAYMDLRNLRFDDTAVYFCARKTAGDVSGDKRGFFFDLWGRGSRVIVSS

SEQ ID NO: 2964 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFERGGQGWIFDLWGRGTLIIVSS

SEQ ID NO: 2965 - protein, 128 aa, Artificial Sequence
  anti-HIV-1_HeavyChain
QAHLVQSGSEVKKPGAFVRVSCWTSEDIFEETELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 2966 - protein, 125 aa, Artificial Sequence
  anti-HIV-1_HeavyChain
QAHLEQSGSGVKKPGASVRVSCKASEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 2967 - protein, 125 aa, Artificial Sequence
  anti-HIV-1_HeavyChain
QAHLEQSGSEVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 2968 - protein, 125 aa, Artificial Sequence
  anti-HIV-1_HeavyChain
QAHLVQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 2969 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFERGGQGWYFDLWGRGTLICVSS

SEQ ID NO: 2970 - protein, 125 aa, Artificial Sequence
  anti-HIV-1_HeavyChain
QAHLEQSGSGVKKPRASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 2971 - protein, 127 aa, Artificial Sequence
  anti-HIV-1_HeavyChain
QVQLEQAGAGVKKPGPSVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 2972 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRQRVSLTRDRDLFTAHMDIRGLTQGDTATYFCARQKFYAGGQGWYFDLWGRGTLIVVSS

SEQ ID NO: 2973 - protein, 127 aa, Artificial Sequence
  anti-HIV-1_HeavyChain
QVFMEQAGAGMKKPGASMTVSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 2974 - protein, 125 aa, Artificial Sequence
  anti-HIV-1_HeavyChain
QAHLEQSGSGVKKPGASVRASCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 2975 - protein, 127 aa, Artificial Sequence
  anti-HIV-1_HeavyChain
QVYMEQAGGGMKKPGASMTVSCKTADEDIFDAAYMHWVRQARGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 2976 - protein, 128 aa, Artificial Sequence
  anti-HIV-1_HeavyChain
QAHLEQSGAGVKEPGASVRVSCWSSEDIFERTELIHWVRQAPGQGLEWIGWVKTVTGAVNFGSLDFRHRISLTRDRDLLTAHMDIRGLTQGDTATYFCARQKFESRYTGGQGWYFDLWGRGTHIVVSS

SEQ ID NO: 2977 - protein, 128 aa, Artificial Sequence
  anti-HIV-1_HeavyChain
QVQLVQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 2978 - protein, 128 aa, Artificial Sequence
  anti-HIV-1_HeavyChain
QAHLVQSASGVKRPGASVRVSCWTSEDIFERTELIYWVRQAPGQGLEWIGWVKTVSGAVNFGSQDFRHRISLTRDRDLFTAHMDIRGLTQGDTATYFCARQKFESRYTGGQGWYFDLWGRGTHIVVSS

SEQ ID NO: 2979 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDKRGFFFDLWGRGSRVIVSS

SEQ ID NO: 2980 - protein, 124 aa, Artificial Sequence
  anti-HIV-1_HeavyChain
QAHLEQSGSGVKKPGASVRVSCWTSEDIFEGYMIHWVRQAPGQGLEWIGWVKTVTGAVNFGSAYFRHRVSLTRDRDLFTAHMDIRGLTQGDTATYFCARQKFYKGGQGWYFDLWGRGTLIVVSS

SEQ ID NO: 2981 - protein, 125 aa, Artificial Sequence
  anti-HIV-1_HeavyChain
QAHLEQSGSGVKKLGASVRVSCWTSEDIFERTELIHWVRQAPGRGLEWIGWVKAVSGAVNYGSLDFRHRVSLTRDRDLFTAHMDIRGLTQDDTATYFCARQKFARGDQGWFFDLWGRGTLICVSS

SEQ ID NO: 2982 - protein, 125 aa, Artificial Sequence
  anti-HIV-1_HeavyChain
QAHLVQSGSGVKKSGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 2983 - protein, 126 aa, Artificial Sequence
  anti-HIV-1_HeavyChain
QVYMERAGAGVKKPGASVTLSCKTADEDVFGAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 2984 - protein, 125 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLFTAHMDIRGLTQGDTATYFCARQKFYKGGQGWYFDLWGRGTLIVVSS

SEQ ID NO: 2985 - protein, 125 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRVSLTRDRDLFTAHMDIRGLTQDDTATYFCARQKFARGDQGWFFDLWGRGTLIVVSS

SEQ ID NO: 2986 - protein, 128 aa, Artificial Sequence
  anti-HIV-1_HeavyChain
QAHLVQSGSGVKKPGASVRVSCWTSEDIFERTELIHWVRQAPGQGLEWIGWVKTVAGAVNFSSLDFRHRISLTRDRDLFTAHMDIRGLTQGDTATYFCARQKFESRYTGGQGWYFDLWGRGTHIVVSS

SEQ ID NO: 2987 - protein, 128 aa, Artificial Sequence
  anti-HIV-1_HeavyChain
QAHLEQSGSGVKKSGASARVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 2988 - protein, 123 aa, Artificial Sequence
  anti-HIV-1_HeavyChain
LLQLVQSGAEVKKPGASVKVTCKASGYTFTGYIHWVRQAPGQGLEWIGWVKAVSGAVNYGSLDFRHRVSLTHDRDLSTAHMDIRGLTQDDTATYFCARQKFARGDQGWFFDLWGRGTLIVVSS

SEQ ID NO: 2989 - protein, 123 aa, Artificial Sequence
  anti-HIV-1_HeavyChain
QVQLVQSGAEVKKPGASVKVSCKASGCTFTGYYMHWVRQAPGQGLEWMGWINPNSGGTNYAQKFQGRVTMTRDTSISTAYMELSRLRSDDTAVYYCARQKFARGDQGWFFDLWGRGTLIVVSS

SEQ ID NO: 2990 - protein, 123 aa, Artificial Sequence
  anti-HIV-1_HeavyChain
QVQLVQSGTELRKPGASVKVSCKASGYTFSGSYIHWVRQAPGQGLEWVGWINPSSGATQCAKKFQDKVTMTRDTTNNTVYMEVNRLISDDTATYFCARQKFARGDQGWFFDLWGRGTLIVVSS

SEQ ID NO: 2991 - protein, 124 aa, Artificial Sequence
  anti-HIV-1_HeavyChain
QVLLVQSGAEVKKPGSSVKVSCKTSGDSLTKYALHWARQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 2992 - protein, 124 aa, Artificial Sequence
  anti-HIV-1_HeavyChain
QVQLVQSGTEVKTPGASVKVSCKASGYTFTNYDINWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 2993 - protein, 124 aa, Artificial Sequence
  anti-HIV-1_HeavyChain
QVQLVQSGDEVKKPGASVKVSCKASGKGFPTSLVTWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 2994 - protein, 124 aa, Artificial Sequence
  anti-HIV-1_HeavyChain
QVQLVQSGAEVKKPGSSVKVSCKTSGDILTNYGLNWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 2995 - protein, 124 aa, Artificial Sequence
  anti-HIV-1_HeavyChain
QVQLVQSGAEVKKPGASVRVSCKTSGYPFSRYGISWVRQAPGQGLVWMAWVKAVSGAVNYGSLDFRHRVSLTRDRDLSTAHMDIRGLTQDDTATYFCARQKFARGDQGWFFDLWGRGTLIVVSS

SEQ ID NO: 2996 - protein, 124 aa, Artificial Sequence
  anti-HIV-1_HeavyChain
REQLVQSGAEVKKPGASVKVSCKTSGNTFGSYDFNWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 2997 - protein, 124 aa, Artificial Sequence
  anti-HIV-1_HeavyChain
QVQLVQSGAEVKKPGASVKVSCKASGYTFTSYYMHWVRQAPGQGLEWIGWVKTVTGAVNFGSPNFRHRVSLTRDRDLFTAHMDIRGLTQGDTATYFCARQKYYAGGQGWYFDLWGRGTLIVVSS

SEQ ID NO: 2998 - protein, 124 aa, Artificial Sequence
  anti-HIV-1_HeavyChain
QVQLVQSGAEVKKPGASVKVSCKASGYTFTSYYMHWVRQAPGQGLEWIGWVKTVTGTVNFGSLNFRQRVSLTRDRDLFTAHMDIRGLTQGDTATYFCARQKFERGGQGWYFDLWGRGTLIVVSS

SEQ ID NO: 2999 - protein, 124 aa, Artificial Sequence
  anti-HIV-1_HeavyChain
QVQLGQSGAEMKKPGSSVKVSCKASGGTFRHSPISWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3000 - protein, 123 aa, Artificial Sequence
  anti-HIV-1_HeavyChain
QVQLVQSGAEVRTPGASVKVSCKASGYNFIAYHVHWVRQAPGQGLTWMGWINPDSGDTVYAQNFVDRVMMTRNTSIQTVYLELNVLTLEDTATYFCARQKFARGDQGWFFDLWGRGTLIVVSS

SEQ ID NO: 3001 - protein, 124 aa, Artificial Sequence
  anti-HIV-1_HeavyChain
QVQLVQSGAEVKKPGASVKVSCKASGYTFTVYYMHWVRQAPGRGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3002 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQGDTATYFCARQKFERGGQGWYFDLWGRGTLIVVSS

SEQ ID NO: 3003 - protein, 124 aa, Artificial Sequence
  anti-HIV-1_HeavyChain
QVQLVQSGAEVKKPGASVKVSCKASGYTFIGYYMHWVRQAPGQGLEWMGWVKTVTGAVNFGSPNFRHRVSLTRDRDLFTAHMDIRGLTQGDTATYFCARQKFERGGQGWYFDLWGRGTLIVVSS

SEQ ID NO: 3004 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSLNFRHRVSLTRDRDLFTAHMDIRGLTQGDTATYFCARQKFARGDQGWFFDLWGRGTLIVVSS

SEQ ID NO: 3005 - protein, 124 aa, Artificial Sequence
  anti-HIV-1_HeavyChain
QAHLEQSGSGVKKLGASVRVSCWTSEDIFKDRIDHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3006 - protein, 125 aa, Artificial Sequence
  anti-HIV-1_HeavyChain
QVQLAQSGAEVKKLGASVRVSCWTSEDIFERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSS

SEQ ID NO: 3007 - protein, 124 aa, Artificial Sequence
  anti-HIV-1_HeavyChain
QAHLEQSGSGVKKPGASVRVSCWTSEDISKAELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3008 - protein, 124 aa, Artificial Sequence
  anti-HIV-1_HeavyChain
TAHLEQSGSGVRRPGASVRVSCWTSGDIFKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3009 - protein, 124 aa, Artificial Sequence
  anti-HIV-1_HeavyChain
QAHLEQSGSGVKRPGASVRVSCWTSEDIFNTELIHWVRQAPGQGLEWIGWVKTVSGAVNFGSLNFRHRVSLTRDRDLFTAHMDIRGLTQGDTATYFCARQKFARGDQGWFFDLWGRGTLIVVSS

SEQ ID NO: 3010 - protein, 124 aa, Artificial Sequence
  anti-HIV-1_HeavyChain
QAHLEQSGSGVKKPGASVRVSCWTSEDIFKTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3011 - protein, 124 aa, Artificial Sequence
  anti-HIV-1_HeavyChain
QVQLVQSGAEVKKPGASVRVSCKASGYTFTAYYIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3012 - protein, 124 aa, Artificial Sequence
  anti-HIV-1_HeavyChain
QAHLEQSGSESKKPGASVRVSCWSSEDIFKTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3013 - protein, 125 aa, Artificial Sequence
  anti-HIV-1_HeavyChain
QAHLEQSGSEVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3014 - protein, 124 aa, Artificial Sequence
  anti-HIV-1_HeavyChain
QAHLEQVWAGVKKLGASVRVSCWTSEDIFKTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3015 - protein, 124 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSNFRQRVSLTRDRDLFTAHMDIRGLTQGDTATYFCARQKFYAGGQGWYFDLWGRGTLIVVSS

SEQ ID NO: 3016 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRHRVSLTRDRDLSTAHMDIRGLTQDDTATYFCARQKFARGDQGWFFDLWGRGTLIVVSS

SEQ ID NO: 3017 - protein, 125 aa, Artificial Sequence
  anti-HIV-1_HeavyChain
QAHLEQSGSGVKKPGTSVRVSCWTSEDIFERTELIHWVRQAPGQGLEWIGWVKTVTGAVNFGSPNFRHRVSLTRDRDLFTAHMDIRGLTQGDTATYFCARQKFARGDQGWFFDLWGRGTLIVVSS

SEQ ID NO: 3018 - protein, 125 aa, Artificial Sequence
  anti-HIV-1_HeavyChain
QAHLEQSGSGVKKPGASVRVSCWTSGGIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3019 - protein, 125 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQDDTATYFCARQKFARGDQGWFFDLWGRGTLIVVSS

SEQ ID NO: 3020 - protein, 124 aa, Artificial Sequence
  anti-HIV-1_HeavyChain
QAHLEQSGSGVKKPGASVRVSCWTSEDIFKSELIHWVRQAPGQGLEWIGWVKTVTGAVNFGSSDFRQRVSLTRDRDLFTAHMDIRGLTQGDTATYFCARQKFERGGQGWIFDLWGRGTLIAVSS

SEQ ID NO: 3021 - protein, 125 aa, Artificial Sequence
  anti-HIV-1_HeavyChain
QAHLEQSGSGVKRPGASVRVSCWTSEDIFETTELIHWVRQAPGQGLEWIGWVKTVSGAVNFGSLNFRHRVSLTRDRDLFTAHMDIRGLTQGDTATYFCARQKFARGDQGWFFDLWGRGTLIVVSS

SEQ ID NO: 3022 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRQRVSLTRDRDLFTAHMDIRGLTQGDTATYFCARQKFYAGGQGWYFDLWGRGTLIVVSS

SEQ ID NO: 3023 - protein, 124 aa, Artificial Sequence
  anti-HIV-1_HeavyChain
QAHLEQSGSGVKKPGASVRVSCWTSEDIFEKSELIHWVRQAPGQGLEWIGWVKTVTGAVNLVHQISDRVSLTRDRDLFTAHMDIRGLTQGDTATYFCARQKFYAGGQGWYFDLWGRGTLIVVSS

SEQ ID NO: 3024 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRGRDLFTAHMDIRGLTQGDTATYFCARQKFYAGGQGWYFDLWGRGTLIVVSS

SEQ ID NO: 3025 - protein, 125 aa, Artificial Sequence
  anti-HIV-1_HeavyChain
QAHLEQSGAGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3026 - protein, 125 aa, Artificial Sequence
  anti-HIV-1_HeavyChain
QSHLEQSGSAMKKPGASVRVSCWTSEDIFDTTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3027 - protein, 124 aa, Artificial Sequence
  anti-HIV-1_HeavyChain
QAHLEQSGSGVKKPGASVRVSCWTSEDIFKTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3028 - protein, 125 aa, Artificial Sequence
  anti-HIV-1_HeavyChain
QVHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3029 - protein, 124 aa, Artificial Sequence
  anti-HIV-1_HeavyChain
QAHLEQSASGVKRPGASVRVSCWTSEDIFERSELIYWVRQAPGQGLEWIGWVKTVSGAVNLAPNFRQRVSLTRDRDLFTAHMDIRGLTQGDTATYFCARQKFERGGQGWIFDLWGRGTLIAVSS

SEQ ID NO: 3030 - protein, 124 aa, Artificial Sequence
  anti-HIV-1_HeavyChain
QAHLEQSGSGVKKPGASVRVSCWTSEDIFKSELIHWVRQAPGQGLEWIGWVKTVTGAVNFGSSDFRQRVSLTRDGDLFTAHMDIRGLTQGDTATYFCARQKFYAGGQGWYFDLWGRGTLIIVSS

SEQ ID NO: 3031 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTSDRDLSTAHMDIRGLTQDDTATYFCARQKFARGDQGWFFDLWGRGTLIVVSS

SEQ ID NO: 3032 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLSTAHMDIRGLTQDDTATYFCARQKFARGDQGWFFDLWGRGTLIVVSS

SEQ ID NO: 3033 - protein, 124 aa, Artificial Sequence
  anti-HIV-1_HeavyChain
QAHLEQSGSGVKKPGASVRVSCWTSEDIFKSELIHWVRQAPGQGLEWIGWVKTVTGAVNFGSSDFRQRVSLTRDRDLFTAHMDIRGLTQGDTATYFCARQKFERGGQGWYFDLWGRGTLIVVSS

SEQ ID NO: 3034 - protein, 124 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGHQISDRVSLTRDRDLFTAHMDIRGLTQGDTATYFCARQKFYAGGQGWYFDLWGRGTLIVVSS

SEQ ID NO: 3035 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQDDTATYFCARQKFARGDQGWFFDLWGRGTLIVVSS

SEQ ID NO: 3036 - protein, 124 aa, Artificial Sequence
  anti-HIV-1_HeavyChain
QAHLEQSGSGVKKLGASVRVSCWTSEDILKTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3037 - protein, 124 aa, Artificial Sequence
  anti-HIV-1_HeavyChain
VRSVVQCEAGVKKPGASVKISCATSGYAFTLYYLHWVRQAPGQGLEWIGWVKTVTGAVNFGSAYFRHRVSLTPDRDLFTAHMDIRGLTQGDTATYFCARQKFYKGGQGWYFDLWGRGTLIVVSS

SEQ ID NO: 3038 - protein, 125 aa, Artificial Sequence
  anti-HIV-1_HeavyChain
QAHLEQSGSGVKKLGASVRVSCLDSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3039 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFARGDQGWFFDLWGRGTLIVVSS

SEQ ID NO: 3040 - protein, 125 aa, Artificial Sequence
  anti-HIV-1_HeavyChain
QAHLEQSGSGVKKLGASVKSSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3041 - protein, 125 aa, Artificial Sequence
  anti-HIV-1_HeavyChain
QAHLEQSGAGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3042 - protein, 125 aa, Artificial Sequence
  anti-HIV-1_HeavyChain
QAHLEQSGSGVKKPGASVRVSCWTSEDIFERTELIHWVRQAPGQGLEWIGWMKTVTGAVNFGSPNFRHRVSLTRDRDLFTAHMDIRGLTQGDTATYFCARQKFERGGQGWYFDLWGRGTLIVVSS

SEQ ID NO: 3043 - protein, 125 aa, Artificial Sequence
  anti-HIV-1_HeavyChain
QAHLEQSGSEVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3044 - protein, 125 aa, Artificial Sequence
  anti-HIV-1_HeavyChain
QAHLEQSGAGVKKLGASVRVSCWTSGDIFERTELIHWVRQAPGQGLEWIGWVKAVSGAVNYGSLDFRQRVSLTRDRDLFTAHIDIRGLTQGDTATYFCARQKFERGGQGWIFDLWGRGTLIAVSS

SEQ ID NO: 3045 - protein, 125 aa, Artificial Sequence
  anti-HIV-1_HeavyChain
QAHLEQSGSGVKKLGASVRVSCWASEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3046 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGTVNFGSQNFRQRVSLTRDRDLFTAHMDIRGLTQGDTATYFCARQKFERGGQGWIFDLWGRGTLIAVSS

SEQ ID NO: 3047 - protein, 125 aa, Artificial Sequence
  anti-HIV-1_HeavyChain
QAHLEQSGSGVKRPGASVRVSCWTSEDIFETTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3048 - protein, 125 aa, Artificial Sequence
  anti-HIV-1_HeavyChain
QAHLEQSGSGVKKPGASVRVSCWTSEDILRKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3049 - protein, 124 aa, Artificial Sequence
  anti-HIV-1_HeavyChain
QAHLEQSGSGVKKPGASVRVSCWTSEDIFKTELIHWVRQAPGQGLEWIGWVKTVTGTVNFGSLNFRQRVSLTRDRDLFTAHMDIRGLTQGDTATYFCARQKFYAGGQGWYFDLWGRGTLIVVSS

SEQ ID NO: 3050 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3051 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3052 - protein, 125 aa, Artificial Sequence
  anti-HIV-1_HeavyChain
QVQLVQSGAEVKKPGASVRVSCWTSEDIFERSELIYWVRQAPGRGLEWIGWIKLVSGAVNFGSVDFRDRVSLTRDRDLFTAHMDIRGLTQDDTATYFCARQKFARGDQGWFFDLWGRGTLIVVSS

SEQ ID NO: 3053 - protein, 125 aa, Artificial Sequence
  anti-HIV-1_HeavyChain
QAHLEQSRSGVKKPGASVRVSCWTSEDIFERTELIHWVRQAPGQGLEWIGWVKAVSGAVNFGSPNFRHRVSLTRDRDLSTAHMDIRGLTQDDTATYFCARQKFARGDQGWFFDLWGRGTLIVVSS

SEQ ID NO: 3054 - protein, 125 aa, Artificial Sequence
  anti-HIV-1_HeavyChain
QSYLEQSGSAMKKPGASVRVSCWTSEDIFDTTELIYWVRQAPGQGLEWIGWVKIVSGTVNFASLDFRNRISLSRDRDLFTAHMDIRGLTQGDTATYFCARQKFYAGGQGWYFDLWGRGTLIVVSS

SEQ ID NO: 3055 - protein, 125 aa, Artificial Sequence
  anti-HIV-1_HeavyChain
QAHLEQSGSGVKKPGASVRVSCWTSEDIFEKTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3056 - protein, 124 aa, Artificial Sequence
  anti-HIV-1_HeavyChain
QAHLEQSGSGVKKPGASVRVSCWTSEDIFKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3057 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQDDTATYFCARQKFARGDQGWFFDLWGRGTLIVVSS

SEQ ID NO: 3058 - protein, 125 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFARGDQGWFFDLWGRGTLIVVSS

SEQ ID NO: 3059 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQGDTATYFCARQKFYAGGQGWYFDLWGRGTLIVVSS

SEQ ID NO: 3060 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQGDTATYFCARQKFERGGQGWYFDLWGRGTLIVVSS

SEQ ID NO: 3061 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRQRVSLTRDRDLFTAHMDIRGLTQGDTATYFCARQKFERGGQGWIFDLWGRGTLIAVSS

SEQ ID NO: 3062 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGTVNFGSLNFRQRVSLTRDRDLFTAHMDIRGLTQGDTATYFCARQKFERGGQGWIFDLWGRGTLIAVSS

SEQ ID NO: 3063 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3064 - protein, 125 aa, Artificial Sequence
  anti-HIV-1_HeavyChain
RHTVEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3065 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFERGGQGWYFDLWGRGTLIVVSS

SEQ ID NO: 3066 - protein, 125 aa, Artificial Sequence
  anti-HIV-1_HeavyChain
RHTWEQSGSGVKKLGASVRVSCWTSEDIFERTELIHWVRQAPGQGLEWIGWMKAVSGAVNYGSLDFRHRVSLTRDRDLSTAHIDIRGLTQDDTATYFCARQKFARGDQGWFFDLWGRGTLIVVSS

SEQ ID NO: 3067 - protein, 125 aa, Artificial Sequence
  anti-HIV-1_HeavyChain
QAHLEQSGSGVKKLGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3068 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWIFDLWGRGTLIAVSS

SEQ ID NO: 3069 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRHRVSLTRDRDLFTAHMDIRGLTQGDTATYFCARQKYYAGGQGWYFDLWGRGTLIVVSS

SEQ ID NO: 3070 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMGIRGLTQGDTATYFCARQKFYAGGQGWYFDLWGRGTLIVVSS

SEQ ID NO: 3071 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVFLTRDRDLFTAHMDIRGLTQGDTATYFCARQKFYAGGQGWYFDLWGRGTLIVVSS

SEQ ID NO: 3072 - protein, 125 aa, Artificial Sequence
  anti-HIV-1_HeavyChain
QAHLEQSGSGVKKPGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3073 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSQDFRDRFSLTRDRDLFTAHMDIRGLTQGDTATYFCARQKFYAGGQGWYFDLWGRGTLIVVSS

SEQ ID NO: 3074 - protein, 125 aa, Artificial Sequence
  anti-HIV-1_HeavyChain
QSHLEQSGSAMKKPGASVRVSCWTSEDIFDATGLIYWVRQAPGQGLEWIGWVKIVSGTVNFASLDFRQRVSLTRDRDLFTAHMDIRGLTQGDTATYFCARQKFYAGGQGWYFDLWGRGTLIVVSS

SEQ ID NO: 3075 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAYMDIRGLTQDDTATYFCARQKFARGDQGWFFDLWGRGTLIVVSS

SEQ ID NO: 3076 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTAIYLCARQKFARGDQGWFFDLWGRGTLIVVSS

SEQ ID NO: 3077 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQGDTATYFCARQKFERGGQGWIFDLWGRGTLIAVSS

SEQ ID NO: 3078 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3079 - protein, 125 aa, Artificial Sequence
  anti-HIV-1_HeavyChain
QAHPEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3080 - protein, 125 aa, Artificial Sequence
  anti-HIV-1_HeavyChain
RAHLEQSGSGVRKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3081 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWIFDLWGRGTLIAVSS

SEQ ID NO: 3082 - protein, 125 aa, Artificial Sequence
  anti-HIV-1_HeavyChain
QSHLEQSGSAMKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3083 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTHIVVSS

SEQ ID NO: 3084 - protein, 125 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3085 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASSDFRHRVSLTRDRDLSTAHMDIRGLTQDDTATYFCARQKFARGDQGWFFDLWGRGTLIVVSS

SEQ ID NO: 3086 - protein, 125 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFYAGGQGWYFDLWGRGTLIVVSS

SEQ ID NO: 3087 - protein, 125 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSPNFRQRVSLTRDRDLFTAHMDIRGLTEGDTATYFCARQKFYAGGQGWYFDLWGRGTLIVVSS

SEQ ID NO: 3088 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAANYGSLDFRHRVSLTRDRDLFTAHMDIRGLTQDDTATYFCARQKFARGDQGWFFDLWGRGTLIVVSS

SEQ ID NO: 3089 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3090 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNFGSPNFRHRVSLTRDRDLFTAHMDIRGLTQGDTATYFCARQKFERGGQGWYFDLWGRGTLIVVSS

SEQ ID NO: 3091 - protein, 125 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYLCARQKFERGGQGWIFDLWGRGTLIAVSS

SEQ ID NO: 3092 - protein, 125 aa, Artificial Sequence
  anti-HIV-1_HeavyChain
QAHLEQSGSGVKKPGASVRVSCWSSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3093 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGTVNFGSLNFRQRVSLTRDRDLFTAHMDIRGLTQGDTATYFCARQKFYAGGQGWYFDLWGRGTLIVVSS

SEQ ID NO: 3094 - protein, 125 aa, Artificial Sequence
  anti-HIV-1_HeavyChain
QAHLEQSASGVKRPGASVRVSCWTSEDIFERSELIYWVRQAPGQGLEWIGWVKTVSGAVNFGSTDFRERVSLTRDRDLFTAHMDIRGLTQGDTATYFCARQKFARGDQGWFFDLWGRGTLIVVSS

SEQ ID NO: 3095 - protein, 125 aa, Artificial Sequence
  anti-HIV-1_HeavyChain
QVHLEQSGSGVKKPGASVRVSCWTSEDIFERSELIHWVRQAPGQGLEWIGWVKTVTGAVNFGSPNFRHRVSLTRDRDLFTAHMDIRGLTQGDTATYFCARQKYYAGGQGWYFDLWGRGTLIVVSS

SEQ ID NO: 3096 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDICGLTQGDTATYFCARQKFYAGGQGWYFDLWGRGTLIVVSS

SEQ ID NO: 3097 - protein, 125 aa, Artificial Sequence
  anti-HIV-1_HeavyChain
QAHLEQSGSGVKKPEASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3098 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRQRVSLTRDRDLFTAHMDIRGLTQGDTATYFCARQKFERGGQGWIFDLWGRGTLIAVSS

SEQ ID NO: 3099 - protein, 125 aa, Artificial Sequence
  anti-HIV-1_HeavyChain
QAHLEQSASGVKRPGASVRVSCWTSEDIFERTELIYWVRQAPGQGLEWIGWVKTVSGAVNFGSQDFRDRFSLTRDRDLFTAHMDIRGLTQGDTATYFCARQKFERGGQGWYFDLWGRGTLIVVSS

SEQ ID NO: 3100 - protein, 125 aa, Artificial Sequence
  anti-HIV-1_HeavyChain
QAHLEQSGSGVKKPGASVRVSCWTSEDIFEKSELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3101 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDPFTAHMDIRGLTQGDTATYFCARQKFERGGQGWYFDLWGRGTLIVVSS

SEQ ID NO: 3102 - protein, 125 aa, Artificial Sequence
  anti-HIV-1_HeavyChain
QAHLEQSGSGVKKPGASVRVSCWTSEDIFEKSGLIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3103 - protein, 125 aa, Artificial Sequence
  anti-HIV-1_HeavyChain
QAHLEQSGSGVKKPGASVRVSCWTSEDIFEKSELIHWVRQAPGQGLEWIGWVKAVSGTVNYGSLDFRHRVSLTRDRDLFTAHMDIRGLTQDDTATYFCARQKFARGDQGWFFDLWGRGTLIVVSS

SEQ ID NO: 3104 - protein, 125 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLFTAHMDIRGLTQGDTATYFCARQKFYAGGQGWYFDLWGRGTLIVVSS

SEQ ID NO: 3105 - protein, 125 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFYAGGQGWYFDLWGRGTLIVVSS

SEQ ID NO: 3106 - protein, 125 aa, Artificial Sequence
  anti-HIV-1_HeavyChain
QAHLEQSGSGVKKPGASVRVSCWSSEDIFERTELIHWVRQAPGQGLEWIGWVKAVSGAVNYGSLDFRHRVSLTRDRDLSTAHMDIRGLTQDDTATHFCARQKFARGDQGWFFDLWGRGTLIVVSS

SEQ ID NO: 3107 - protein, 125 aa, Artificial Sequence
  anti-HIV-1_HeavyChain
QAHLEQSGSGVKKPGASVRVSCWTSEDIFEGTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3108 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRQRVSLTRDRDLFTAHMDIRGLTQGDTATYFCARQKFYAGGQGWYFDLWGRGTLIVVSS

SEQ ID NO: 3109 - protein, 125 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3110 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFARGDQGWFFDLWGRGTLIVVSS

SEQ ID NO: 3111 - protein, 125 aa, Artificial Sequence
  anti-HIV-1_HeavyChain
QAHLEQSGSGVKKPGASVRVSCWTSEGIFERTELIHWVRQAPGQGLEWIGWVKIVSGAVNFGSPNFRQRVSLTRDRDLFAAHMDIRGLTQGDTATYFCARQKFERGGQGWIFDLWGRGTLIAVSS

SEQ ID NO: 3112 - protein, 125 aa, Artificial Sequence
  anti-HIV-1_HeavyChain
QAHLEQSGSGVKKLGASVRVSCWTSEDIFERAELIHWVRQAPGQGLEWIGWVKAVSGAVNYGSLDFRHRVSLTRDRDLFTAHMDIRGLTQDDTAIYFCARQKFYAGGQGWYFDLWGRGTLIVVSS

SEQ ID NO: 3113 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSPNFRQRVSLTRDRDLFTAHMDIRGLTQGDTATYFCARQKFERGGQGWIFDLWGRGTLIAVSS

SEQ ID NO: 3114 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNYGSLNFRSRISLTRDRDLFTAHMDIRGLTEGDTATYFCARQKFYAGGQGWYFDLWGRGTLIVVSS

SEQ ID NO: 3115 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVSGAVNFGSPNFRQRVSLTRDRDLFTAHMDIRGLTQGDTATYFCARQKFERGGQGWIFDLWGRGTLIAVSS

SEQ ID NO: 3116 - protein, 125 aa, Artificial Sequence
  anti-HIV-1_HeavyChain
QAHLEQSGSGVKKLGASVRVSCWTSEDIFERTELIHWVRQAPGQGLEWIRWVKAVSGAVNYGSLDFRHRVSLTRDRDLSTAHMDIRGLTQDDTATYFCARQKFARGDQGWFFDLWGRGTLIVVSS

SEQ ID NO: 3117 - protein, 125 aa, Artificial Sequence
  anti-HIV-1_HeavyChain
QAHLEQSGSGVKKLGASVRVSCWTSEDIFERTELIHWVRQAPGQGLEWIGWVKTVTGAVNFGSSDFRQRVSLTRDRDLFTAQMDIRGLTQGDTATYFCARQKFYAGGQGWYFDLWGRGTLIVVSS

SEQ ID NO: 3118 - protein, 124 aa, Artificial Sequence
  anti-HIV-1_HeavyChain
QAHLEQSGSGVKKPGASVRVSCWTSEDIFEKSELIHWVRQAPGQGLEWIGWVKTVTGAVNFAHQISDRVSLTRDRDLFTAHMDIRGLTQGDTATYFCARQKFYAGGQGWYFDLWGRGTLIVVSS

SEQ ID NO: 3119 - protein, 125 aa, Artificial Sequence
  anti-HIV-1_HeavyChain
QAHLEQSGSGVKKPGASVRVSCWTSEDIFERTELIHWVRQAPGQGLEWIGWVKVVSGAVNFGSPNFRQRVSLTRDRDLFTAHMDIRGLTQGDTATYFCARQKFERGGQGWIFDLWGRGTLIAVSS

SEQ ID NO: 3120 - protein, 125 aa, Artificial Sequence
  anti-HIV-1_HeavyChain
QVHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3121 - protein, 125 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFERGGQGWIFDLWGRGTLIAVSS

SEQ ID NO: 3122 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFARGDQGWFFDLWGRGTLIVVSS

SEQ ID NO: 3123 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYLCARQKFERGGQGWYFDLWGRGTLIVVSS

SEQ ID NO: 3124 - protein, 124 aa, Artificial Sequence
  anti-HIV-1_HeavyChain
RHTWEQSGSGVKKPGASVRVSCWTSEDIFKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3125 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTEGDTATYFCARQKFYAGGQGWYFDLWGRGTLIVVSS

SEQ ID NO: 3126 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSAYFRHRVSLTRDRDLFTAHMDIRGLTQGDTATYFCARQKFYKGGQGWYFDLWGRGTLIVVSS

SEQ ID NO: 3127 - protein, 125 aa, Artificial Sequence
  anti-HIV-1_HeavyChain
QAHLEQSGPGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3128 - protein, 125 aa, Artificial Sequence
  anti-HIV-1_HeavyChain
RAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3129 - protein, 125 aa, Artificial Sequence
  anti-HIV-1_HeavyChain
QAHLEQSGSGVKKLGASVRVSCWTSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3130 - protein, 125 aa, Artificial Sequence
  anti-HIV-1_HeavyChain
QAHLEQSGSGVKKPGASVRVSCWSSEDIFERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSS

SEQ ID NO: 3131 - protein, 125 aa, Artificial Sequence
  anti-HIV-1_HeavyChain
QAHLEQSGSGVKKVGASVRVSCWTSEDIFERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSS

SEQ ID NO: 3132 - protein, 125 aa, Artificial Sequence
  anti-HIV-1_HeavyChain
QVQLVQSGAELKKPGSSVRVSCWTSEDIFEGSELIHWVRQAPGQGLEWIGWVKTVTGAVNFGSAYFRHRVSLTRDRDLFTAHMDIRGLTQGDTATYFCARQKFYKGGQGWYFDLWGRGTLIVVSS

SEQ ID NO: 3133 - protein, 125 aa, Artificial Sequence
  anti-HIV-1_HeavyChain
QAHLEQSGSGVKKPGVSVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3134 - protein, 125 aa, Artificial Sequence
  anti-HIV-1_HeavyChain
QAHLEQSGSGVKKLGASVRVSCWTSEDIFERTELIHWVRQAPGQGLEWIGWVKVVSGAVNYGSLDFRHRVSLTRDRDLFTAHMDIRGLTQDDTATYFCARQKFARGDQGWFFDLWGRGTLIVVSS

SEQ ID NO: 3135 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTAAYFCARQKFARGDQGWFFDLWGRGTLIVVSS

SEQ ID NO: 3136 - protein, 125 aa, Artificial Sequence
  anti-HIV-1_HeavyChain
QAHLEQSGSGVRKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3137 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGTVNFGSLNFRQRVSLTRDRDLFTAHMDIRGLTQGDTATYFCARQKFYKGGQGWYFDLWGRGTLIVVSS

SEQ ID NO: 3138 - protein, 125 aa, Artificial Sequence
  anti-HIV-1_HeavyChain
QSHLEQSGSAMKKPGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3139 - protein, 125 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRVSLTRDRDLFTAHMDIRGLTQGDTATYFCARQKFARGDQGWFFDLWGRGTLIVVSS

SEQ ID NO: 3140 - protein, 125 aa, Artificial Sequence
  anti-HIV-1_HeavyChain
QAHLEQSGSGVKRPGASVRVSCWTSEDIFETTELIHWVRQAPGQGLEWIGWVKTVSGAVNFGSLNFRHRVSLTRDRDLFTAHMDIRGLTQGDTATYFCARQKFYKGGQGWYFDLWGRGTLIVVSS

SEQ ID NO: 3141 - protein, 125 aa, Artificial Sequence
  anti-HIV-1_HeavyChain
QAHLEQSASGVRRPGASVRVSCWTSEDIFERSELIYWVRQAPGRGLEWIGWIKLVSGAVNFGSVDFRDRVSLTRDRDLFTAHMDIRGLTQGDTATYFCARQKFYAGGQGWYFDLWGRGTLIVVSS

SEQ ID NO: 3142 - protein, 125 aa, Artificial Sequence
  anti-HIV-1_HeavyChain
QAHLEQSGSGVKKPGASVRVSCWSSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3143 - protein, 125 aa, Artificial Sequence
  anti-HIV-1_HeavyChain
QAHLEQSGSGVKKLGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3144 - protein, 125 aa, Artificial Sequence
  anti-HIV-1_HeavyChain
QAHLEQSGSGVKRPGASVRVSCWTSEDIFEKSELIHWVRQAPGQGLEWIGWVKTVTGAVNFGSSDFRQRVSLTRDRDLFTAHMGIRGLTQGDTATYFCARQKFYAGGQGWYFDLWGRGTLIVVSS

SEQ ID NO: 3145 - protein, 125 aa, Artificial Sequence
  anti-HIV-1_HeavyChain
QAHLEQSGSGVKKPGASVRVSCWTSEDIFERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSS

SEQ ID NO: 3146 - protein, 125 aa, Artificial Sequence
  anti-HIV-1_HeavyChain
QSHLEQSGSAMKKLGASVRVPCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3147 - protein, 125 aa, Artificial Sequence
  anti-HIV-1_HeavyChain
QVHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3148 - protein, 125 aa, Artificial Sequence
  anti-HIV-1_HeavyChain
QAHLEQSGSGVKKPGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3149 - protein, 125 aa, Artificial Sequence
  anti-HIV-1_HeavyChain
QAHLEQSASGVRRPGASVRVSCWTSEDIFERSELIYWVRQAPGRGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3150 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRQRVSLTRDRDLFTAHMDIRGLTQGDTATYFCARQKFERGGQGWYFDLWGRGTLIVVSS

SEQ ID NO: 3151 - protein, 125 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFYAGGQGWYFDLWGRGTLIVVSS

SEQ ID NO: 3152 - protein, 125 aa, Artificial Sequence
  anti-HIV-1_HeavyChain
QVQLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3153 - protein, 125 aa, Artificial Sequence
  anti-HIV-1_HeavyChain
QAHLEQSGSGVKKPGASVRVSCWTSEDIFERTELIHWVRQAPGRGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3154 - protein, 125 aa, Artificial Sequence
  anti-HIV-1_HeavyChain
QSHLEQSGSAMKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3155 - protein, 125 aa, Artificial Sequence
  anti-HIV-1_HeavyChain
QAHLEQSASGVKRPGASVRVSCWTSEDIFERSELIYWVRQAPGQGLEWTGWVKTVSGAVNFGSTDFRERVSLTRDRDLFTAHMDIRGLTQGDTATYFCARQKFARGDQGWFFDLWGRGTLIVVSS

SEQ ID NO: 3156 - protein, 125 aa, Artificial Sequence
  anti-HIV-1_HeavyChain
QVHLEQSGSGVKKLGASVRVSCWTSEDIFERTELIHWVRQAPGRGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3157 - protein, 125 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSPNFRHRVSLTRDRDLFTAHMDIRGLTQGDTATYFCARQKYYAGGQGWYFDLWGRGTLIVVSS

SEQ ID NO: 3158 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFYAGGQGWYFDLWGRGTLIVVSS

SEQ ID NO: 3159 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGGTATYFCARQKFYAGGQGWYFDLWGRGTLIVVSS

SEQ ID NO: 3160 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDICGLTQGDTATYFCARQKFERGGQGWYFDLWGRGTLIVVSS

SEQ ID NO: 3161 - protein, 125 aa, Artificial Sequence
  anti-HIV-1_HeavyChain
QAHLEQSGSGVRKVGASVRVSCWTSEDIFERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSS

SEQ ID NO: 3162 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKYYAGGQGWYFDLWGRGTLIVVSS

SEQ ID NO: 3163 - protein, 125 aa, Artificial Sequence
  anti-HIV-1_HeavyChain
QVQLVQSGAEVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3164 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGLSDFRQRVSLTRDRGLFTAHMDIRGLTQGDTATYFCARQKFYAGGQGWYFDLWGRGTLIVVSS

SEQ ID NO: 3165 - protein, 125 aa, Artificial Sequence
  anti-HIV-1_HeavyChain
QAHLEQSGSGVKKPGTSVRVSCWTSEDIFERTELIHWVRQAPGQGLEWIGWVKTVTGAVNFGSPNFRQRVSLTRDRDLFTAHMDIRGLTQGDTATYFCARQKFERGGQGWIFDLWGRGTLIAVSS

SEQ ID NO: 3166 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFERGGQGWYFDLWGRGTLIVVSS

SEQ ID NO: 3167 - protein, 125 aa, Artificial Sequence
  anti-HIV-1_HeavyChain
QVQLVQSGAEVKKPGASVRVSCWTSEDIFEGSELIHWVRQAPGQGLEWIGWVKTVTGAVNFGSAYFRHRVSLTRDRDLFTAHMDIRGLTQGDTATYFCARQKFYKGGQGWYFDLWGRGTLIVVSS

SEQ ID NO: 3168 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASSDFRNRISLSRDRDLSTAHMDIRGLTQDDTATYFCARQKFERGGQGWIFDLWGRGTLIAVSS

SEQ ID NO: 3169 - protein, 125 aa, Artificial Sequence
  anti-HIV-1_HeavyChain
QVQLVQSGTEVKKPGASVRVSCKASGYTFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3170 - protein, 125 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFERGGQGWIFDLWGRGTLIAVSS

SEQ ID NO: 3171 - protein, 125 aa, Artificial Sequence
  anti-HIV-1_HeavyChain
QAHLEQSGSGVKKPGASVRVSCWSSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3172 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQDDTAIYFCARQKFARGDQGWFFDLWGRGTLIVVSS

SEQ ID NO: 3173 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFYAGGQGWYFDLWGRGTLIVVSS

SEQ ID NO: 3174 - protein, 125 aa, Artificial Sequence
  anti-HIV-1_HeavyChain
QAHLEQSGSGVKKPGASVRVSCWTSEDIFEKSELVHWVRQAPGQGLEWIGWVKTVTGAVNFGSSDFRQRVSLTRDRDLFTAHMDIRGLTQGDTATYFCARQKFERGGQGWIFDLWGRGTLIAVSS

SEQ ID NO: 3175 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQGDTATYFCARQKFARGDQGWFFDLWGRGTLIVVSS

SEQ ID NO: 3176 - protein, 125 aa, Artificial Sequence
  anti-HIV-1_HeavyChain
QAHREQSGSGVKKPGASVRVSCWTSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3177 - protein, 124 aa, Artificial Sequence
  anti-HIV-1_HeavyChain
QAHLEQSGSGVKKPGASVRVSCLASEDIFKTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3178 - protein, 125 aa, Artificial Sequence
  anti-HIV-1_HeavyChain
QAHLEQSGSGVKKVGASVRVSCWTSEDIFERTELIHWVRQAPGQGLEWIGWVKAVSGAVNYGSLDFRHRVSLTRDRDLFTAHMDIRGLTQDDTAIYFCARQKFERGGQGWIFDLWGRGTLIAVSS

SEQ ID NO: 3179 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFARGDQGWFFDLWGRGTLIVVSS

SEQ ID NO: 3180 - protein, 125 aa, Artificial Sequence
  anti-HIV-1_HeavyChain
QAHLEQSASGVKRPGASVRVSCWTSEDIFERSELIYWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3181 - protein, 125 aa, Artificial Sequence
  anti-HIV-1_HeavyChain
QAHLEQSGSGVKKLGASVRVSCWTSEDIFERTELIHWVRQAPGQGLEWIGWVKTVTGAVNFGSPNFRHRVSLTRDRDLFTAHMDIRGLTQGDTATYFCARQKYYAGGQGWYFDLWGRGTLIVVSS

SEQ ID NO: 3182 - protein, 125 aa, Artificial Sequence
  anti-HIV-1_HeavyChain
QVQLVQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3183 - protein, 125 aa, Artificial Sequence
  anti-HIV-1_HeavyChain
RHTWEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3184 - protein, 124 aa, Artificial Sequence
  anti-HIV-1_HeavyChain
RHTWEQSGSGVKKPGASVRVSCWTSEDIFERTELIHWVRQAPGQGLEWIGWVKTVTGAVNLAPNFRHRVSLTRDRDLFTAHMDIRGLTQGDTATYFCARQKFERGGQGWYFDLWGRGTLIVVSS

SEQ ID NO: 3185 - protein, 125 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3186 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASSDFRNRISLSRDRDLSTAHMDIRGLTQGDTATYFCARQKYYAGGQGWYFDLWGRGTLIVVSS

SEQ ID NO: 3187 - protein, 125 aa, Artificial Sequence
  anti-HIV-1_HeavyChain
QAHLEQSGSGVKKLGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3188 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYKGGQGWYFDLWGRGTLIVVSS

SEQ ID NO: 3189 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFARGDQGWFFDLWGRGTLIVVSS

SEQ ID NO: 3190 - protein, 125 aa, Artificial Sequence
  anti-HIV-1_HeavyChain
QAHLEQSGSGVKKLGASVRVSCWTSEDIFERTELIHWVRQAPGRGLEWIGWVKAVSGAVNYGSLDFRHRVSLTRDRDLFTAHMDIRGLTQGDTATYFCARQKFERGGQGWYFDLWGRGTLIVVSS

SEQ ID NO: 3191 - protein, 125 aa, Artificial Sequence
  anti-HIV-1_HeavyChain
QARPGTSGSGVKKPGASVRVSCWSSEDIFERTELIHWVRQAPGQGLEWIGWVKTVTGAVNFGSLDFRQRVSLTRDRDLFTAHMDIRGLTQGDTATYFCARQKFERGGQGWIFDLWGRGTLIAVSS

SEQ ID NO: 3192 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTEGDTATYFCARQKFERGGQGWIFDLWGRGTLIAVSS

SEQ ID NO: 3193 - protein, 125 aa, Artificial Sequence
  anti-HIV-1_HeavyChain
QAHLEQSGSGVKKPGASVRVSCWTSEDIFERTELIHWVRQAPGQGLEWIGWVKAISGAVNYGSLDFRHRVSLTRDRDLFTAHMDIRGLTQDDTATYFCARQKFARGDQGWFFDLWGRGTLIVVSS

SEQ ID NO: 3194 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNSGSPNFRHRVSLTRDRDLFTAHMDIRGLTQGDTATYFCARQKFERGGQGWYFDLWGRGTLIVVSS

SEQ ID NO: 3195 - protein, 125 aa, Artificial Sequence
  anti-HIV-1_HeavyChain
QAHLEQSGSGVKKPGASVRVSCWTSEDIFERAELIHWVRQAPGQGLEWIGWVKTVSGAVNFGSLNFRHRVSLTRDRDLFTAHMDIRGLTQGDTATYFCARQKFARGDQGWFFDLWGRGTLIVVSS

SEQ ID NO: 3196 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLVTVSS

SEQ ID NO: 3197 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLNFRHRVSLTRDRDLFTAHMDIRGLTQGDTATYFCARQKFERGGQGWYFDLWGRGTLIVVSS

SEQ ID NO: 3198 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLSTAHMDIRGLTQDDTATYFCARQKFARGDQGWFFDLWGRGTLIVVSS

SEQ ID NO: 3199 - protein, 125 aa, Artificial Sequence
  anti-HIV-1_HeavyChain
QSHLEQSGSAMKKPGASVRVSCWTSEDIFDTTELIYWVRQAPGQGLEWIGWVKTVTGAVNFGSPNFRHRVSLTRDRDLFTAHMDIRGLTQGDTATYFCARQKYYAGGQGWYFDLWGRGTLIVVSS

SEQ ID NO: 3200 - protein, 125 aa, Artificial Sequence
  anti-HIV-1_HeavyChain
QAHLEQSGSGVKKPGASVRVSCWTSEDIFERTELIHWVRQAPGQGLEWIGWVKTASGAVNFGSPNFRHRVSLTRDRDLFTAHMDIRGLTQGDTATYFCARQKFERGGQGWYFDLWGRGTLIVVSS

SEQ ID NO: 3201 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFERGGQGWYFDLWGRGTLIVVSS

SEQ ID NO: 3202 - protein, 125 aa, Artificial Sequence
  anti-HIV-1_HeavyChain
QAHLEQSASGVKRPGASVRVSCWTSEDIFERSELIYWVRQAPGQGLEWIGWVKTVSGAVNFGSTDFRERVSLTRDRDLFTAHMDIRGLTQGDTATYFCARQKFERGGQGWYFDLWGRGTLIVVSS

SEQ ID NO: 3203 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGVVNYGSLDFRHRVSLTRDRDLSTAHMDIRGLTQDDTATYFCARQKFARGDQGWFFDLWGRGTLIVVSS

SEQ ID NO: 3204 - protein, 125 aa, Artificial Sequence
  anti-HIV-1_HeavyChain
QAHLEQSGSGVKKVGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3205 - protein, 125 aa, Artificial Sequence
  anti-HIV-1_HeavyChain
QAYLEQSGSIMKKPGASVRVSCWTSEDIFDRTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3206 - protein, 125 aa, Artificial Sequence
  anti-HIV-1_HeavyChain
QAHLEQSGSGVKKPGASVRVSCWTSEDIFEKSELIHWVRLAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3207 - protein, 125 aa, Artificial Sequence
  anti-HIV-1_HeavyChain
EAHLEQSGSGVKKPGASVRVSCWTSEDIFERTELTHWVRQAPGQGLEWIGWVKTVTGAVNFGSPNFRQRVSLTRDRDLFTAHMDIRGLTQGDTATYFCARQKFERGGQGWIFDLWGRGTLIAVSS

SEQ ID NO: 3208 - protein, 125 aa, Artificial Sequence
  anti-HIV-1_HeavyChain
QAHLEQSGSGVKKPGASVRVSCWTSEDIYERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSS

SEQ ID NO: 3209 - protein, 125 aa, Artificial Sequence
  anti-HIV-1_HeavyChain
QVHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3210 - protein, 125 aa, Artificial Sequence
  anti-HIV-1_HeavyChain
QAHLEQSGSGVKKVGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3211 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGPPNFRHRVSLTRDRDLFTAHMDIRGLTQGDTATYFCARQKFERGGQGWYFDLWGRGTLIVVSS

SEQ ID NO: 3212 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFERGGQGWIFDLWGRGTLIAVSS

SEQ ID NO: 3213 - protein, 125 aa, Artificial Sequence
  anti-HIV-1_HeavyChain
QAHLEQSGSGVRKPGASVRVSCWTSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3214 - protein, 125 aa, Artificial Sequence
  anti-HIV-1_HeavyChain
QAHLEQSGSGVKKLGASVRVSCWTSEDIFERTELIHWVRQAPGRGLEWIGWVKAVSGAVNYGSPNFRHRVSLTRDRDLFTAHMDIRGLTQGDTATYFCARQKFERGGQGWYFDLWGRGTLIVVSS

SEQ ID NO: 3215 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGALIVVSS

SEQ ID NO: 3216 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSAYFRHRVSLTRDRDLFTAHMDIRGLTQGDTATYFCARQKFYKGGQGWYFDLWGRGTLIVVSS

SEQ ID NO: 3217 - protein, 125 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSLDFRHRVSLTRDRDLSTAHMDIRGLTQDDTATYFCARQKFARGDQGWFFDLWGRGTLIVVSS

SEQ ID NO: 3218 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASSDFRNRISLSRDRDLSTAHMDIRGLTQDDTATYFCARQKFYAGGQGWYFDLWGRGTLIVVSS

SEQ ID NO: 3219 - protein, 125 aa, Artificial Sequence
  anti-HIV-1_HeavyChain
QAHLEQSGSGVKKLGASVRVSCWTSEDIFERTELIHWVRQAPGQGLEWIGWVKAVTGAVNFGSSDFRQRVSLTRDRDLFTAHMDIRGLTQGDTATYFCARQKFYAGGQGWYFDLWGRGTLIVVSS

SEQ ID NO: 3220 - protein, 125 aa, Artificial Sequence
  anti-HIV-1_HeavyChain
QSHLEQSGSAMKKPGASVRVSCWTSEDIFERTELIYWVRQAPGRGLEWIGWVKTVSGAVNFGSSDFRQRVSLTRDRDLFTAHMDIRGLTQGDTATYFCARQKFYAGGQGWYFDLWGRGTLIVVSS

SEQ ID NO: 3221 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDAATYFCARQKFERGGQGWYFDLWGRGTLIVVSS

SEQ ID NO: 3222 - protein, 125 aa, Artificial Sequence
  anti-HIV-1_HeavyChain
QAHLEQSGSGVKKLGASVRVSCWTSEDIFERTELIHWVRQAPGRGLEWIGWVKAVSGAVNYGSLDFRHRVSLTRDRDLFTAHMDIRGLTQDDTATYFCARQKFYAGGQGWYFDLWGRGTLIVVSS

SEQ ID NO: 3223 - protein, 125 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFAAHMDIRGLTQGDTATYFCARQKFERGGQGWIFDLWGRGTLIAVSS

SEQ ID NO: 3224 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLAQGDTATYFCARQKFERGGQGWYFDLWGRGTLIVVSS

SEQ ID NO: 3225 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASSDFRNRISLSRDRDLSTAHMDIRGLTQDDTATYFCARQKFERGGQGWYFDLWGRGTLIVVSS

SEQ ID NO: 3226 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRVSLTRDRDLFTAHMDIRGLTQGDTATYFCARQKFYAGGQGWYFDLWGRGTLIVVSS

SEQ ID NO: 3227 - protein, 125 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRHRVSLTRDRDLFTAHMDIRGLTQGDTATYFCARQKFERGGQGWYFDLWGRGTLIVVSS

SEQ ID NO: 3228 - protein, 125 aa, Artificial Sequence
  anti-HIV-1_HeavyChain
QAHLEQSGSGVKKPGASVRVSCWTSEDIFEKSELIHWVRRAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3229 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRQRVSLTRDRDLFTAHMDIRGLTQGDTATYFCARQKFERGGQGWIFDLWGRGTLIAVSS

SEQ ID NO: 3230 - protein, 125 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFYKGGQGWYFDLWGRGTLIVVSS

SEQ ID NO: 3231 - protein, 125 aa, Artificial Sequence
  anti-HIV-1_HeavyChain
QAHLEQSGSGVKKPGTSVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3232 - protein, 125 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFYAGGQGWYFDLWGRGTLIVVSS

SEQ ID NO: 3233 - protein, 125 aa, Artificial Sequence
  anti-HIV-1_HeavyChain
QAHLEQSGSGVKKLGASVRVSCWTSEDIFERTGLIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3234 - protein, 125 aa, Artificial Sequence
  anti-HIV-1_HeavyChain
QAHLEQSGSGVKKPGTSVRVSCWTSEDVFERTELIHWVRQAPGQGLEWIGWVKTVIGAVNFGSPNFRHRVSLTRDRDLFTAHMDIRGLTQGDTATYFCARQKFERGGQGWYFDLWGRGTLIVVSS

SEQ ID NO: 3235 - protein, 124 aa, Artificial Sequence
  anti-HIV-1_HeavyChain
QAHLEQSGAGVKKPGASVRVSCWTSEDIFKTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3236 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPDFRHRVSLTRDRDLFTAHMDIRGLTQGDTATYFCARQKFARGDQGWFFDLWGRGTLIVVSS

SEQ ID NO: 3237 - protein, 125 aa, Artificial Sequence
  anti-HIV-1_HeavyChain
QAHLEQSGSGVKRPGASVRVSCWTSEDIFETTELIHWVRQAPGQGLEWIGWVKTVSGAVNFGSLNFRHRISLTRDRDLFTAHMDIRGLTQGDTATYFCARQKFARGDQGWFFDLWGRGTLIVVSS

SEQ ID NO: 3238 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTAIYFCARQKFARGDQGWFFDLWGRGTLIVVSS

SEQ ID NO: 3239 - protein, 125 aa, Artificial Sequence
  anti-HIV-1_HeavyChain
QAHLEQSGSGVKKLGASVRVSCWTSEDIFERTELIHWVRQAPGQGLEWTGWVKAVSGAVNYGSLDFRHRVSLTRDRDLSTAHMDIRGLTQDDTATYFCARQKFARGDQGWFFDLWGRGTLIVVSS

SEQ ID NO: 3240 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGPTQDDTATYFCARQKFARGDQGWFFDLWGRGTLIVVSS

SEQ ID NO: 3241 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQGDTATYFCARQKFERGGQGWYFDLWGRGTLIVVSS

SEQ ID NO: 3242 - protein, 125 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3243 - protein, 125 aa, Artificial Sequence
  anti-HIV-1_HeavyChain
RHTWNESGSGVKKPGASVRVSCWTSEDIFERTELIHWVRQAPGQGLEWIGWVKTVTGTVNFGSLNFRQRVSLTRDRDLFTAHMDIRGLTQGDTATYFCARQKFYAGGQGWYFDLWGRGTLIVVSS

SEQ ID NO: 3244 - protein, 125 aa, Artificial Sequence
  anti-HIV-1_HeavyChain
QAHLEQSGAGVKRPGASVRVSCWTSEDIFETTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3245 - protein, 125 aa, Artificial Sequence
  anti-HIV-1_HeavyChain
QAHLEQSGSGVKKPGASVRVSCWTSEDIFERTELIHWVRQAPGQGLEWIGWVKAVSGAVNFGSPNFRHRVSLTRDRDLFTAHMDIRGLTQGDTATYFCARQKFERGGQGWYFDLWGRGTLIVVSS

SEQ ID NO: 3246 - protein, 125 aa, Artificial Sequence
  anti-HIV-1_HeavyChain
QAHLGTILGLESKKPGASVRVSCWTSEDIFERTELIHWVRQAPGQGLEWIGWVKTVTGASILAPNFRHRVSLTRDRDLFTAHMDIRGLTQGDTATYFCARQKFERGGQGWYFDLWGRGTLIVVSS

SEQ ID NO: 3247 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRALFTAHMDIRGLTQGDTATYFCARQKFARGDQGWFFDLWGRGTLIVVSS

SEQ ID NO: 3248 - protein, 125 aa, Artificial Sequence
  anti-HIV-1_HeavyChain
RVHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3249 - protein, 125 aa, Artificial Sequence
  anti-HIV-1_HeavyChain
QAHLEQSGAGVKKPGASVRVSCWTSEDIFERTELIHWVRQAPGQGLEWIGWVKTVTGAVNFGSPNFRQRVSLTRDRDLSTAHMDIRGLTQDDTATYFCARQKFARGDQGWFFDLWGRGTLIVVSS

SEQ ID NO: 3250 - protein, 125 aa, Artificial Sequence
  anti-HIV-1_HeavyChain
QVQLVQSGAEVKRPGASVKVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3251 - protein, 125 aa, Artificial Sequence
  anti-HIV-1_HeavyChain
RHDLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3252 - protein, 125 aa, Artificial Sequence
  anti-HIV-1_HeavyChain
RHTWEQVWSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3253 - protein, 125 aa, Artificial Sequence
  anti-HIV-1_HeavyChain
RHTWNKSGSGVKKPGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3254 - protein, 125 aa, Artificial Sequence
  anti-HIV-1_HeavyChain
RHTWEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFERGGQGWIFDLWGRGTLIAVSS

SEQ ID NO: 3255 - protein, 125 aa, Artificial Sequence
  anti-HIV-1_HeavyChain
QAHLEQSGSGVKRPGASVRVSCWTSEDIFETTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3256 - protein, 125 aa, Artificial Sequence
  anti-HIV-1_HeavyChain
RHDLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3257 - protein, 125 aa, Artificial Sequence
  anti-HIV-1_HeavyChain
RHTWEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3258 - protein, 125 aa, Artificial Sequence
  anti-HIV-1_HeavyChain
QAHLEQSGSGVKKPGASVRVSCLASEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3259 - protein, 125 aa, Artificial Sequence
  anti-HIV-1_HeavyChain
QAHLEQSGAGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3260 - protein, 125 aa, Artificial Sequence
  anti-HIV-1_HeavyChain
RHTWEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3261 - protein, 125 aa, Artificial Sequence
  anti-HIV-1_HeavyChain
RHTWEQSGSGVKKPGASVRVSCWTSEDIFERTELIHWVRQAPGQGLEWIGWVKTVTGAVNFGSPNFRHRVSLTRDRDLFTAHMDIRGLTHGDTATYFCARQKFERGGQGWYFDLWGRGTLIVVSS

SEQ ID NO: 3262 - protein, 125 aa, Artificial Sequence
  anti-HIV-1_HeavyChain
RHTWEQSGSGVKKLGASVRVSCWTSEDIFERTELIHWVRQAPGQGLEWIGWVKAVSGAVNYGSLDFRHRVSLTRDRDLFTAHMDIRGLTQGDTATYFCARQKFYAGGQGWYFDLWGRGTLIVVSS

SEQ ID NO: 3263 - protein, 125 aa, Artificial Sequence
  anti-HIV-1_HeavyChain
QAHLEQSGAGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3264 - protein, 125 aa, Artificial Sequence
  anti-HIV-1_HeavyChain
QAHLEQSGSGVKKPGASVEVSCWTSEDIFERTELIHWVRQAPGQGLEWIGWVKTVSGAVNFGSPNFRHRVSLTRDRDLFTAHMDIRGLTQGDTATYFCARQKFARGDQGWFFDLWGRGTLIVVSS

SEQ ID NO: 3265 - protein, 124 aa, Artificial Sequence
  anti-HIV-1_HeavyChain
QAHLEQSGAGVKKLGASVRVSCWTSEDIFKTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3266 - protein, 125 aa, Artificial Sequence
  anti-HIV-1_HeavyChain
RHTWEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFYAGGQGWYFDLWGRGTLIVVSS

SEQ ID NO: 3267 - protein, 125 aa, Artificial Sequence
  anti-HIV-1_HeavyChain
RHTWERIWSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3268 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRRLTQDDTATYFCARQKFARGDQGWFFDLWGRGTLIVVSS

SEQ ID NO: 3269 - protein, 125 aa, Artificial Sequence
  anti-HIV-1_HeavyChain
RHTVEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3270 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTPDRDLFTAHMDIRGLTQGDTATYFCARQKFYAGGQGWYFDLWGRGTLIVVSS

SEQ ID NO: 3271 - protein, 125 aa, Artificial Sequence
  anti-HIV-1_HeavyChain
RHTVEQSGSGVKKVGASVRVSCWTSEDIFERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSS

SEQ ID NO: 3272 - protein, 125 aa, Artificial Sequence
  anti-HIV-1_HeavyChain
QAHLEQSGSGVKKPGASVRVSCWASEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3273 - protein, 125 aa, Artificial Sequence
  anti-HIV-1_HeavyChain
RHTWEQVWSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3274 - protein, 125 aa, Artificial Sequence
  anti-HIV-1_HeavyChain
RHTWRQSGSGVKKLGASVRVSCWTSEDIFERTELIHWVRQAPGQGLEWIGWVKAVSGVVNYGSLDFRHRVSLTRDRDLSTAHMDIRGLTQDDTATYFCARQKFARGDQGWFFDLWGRGTLIVVSS

SEQ ID NO: 3275 - protein, 125 aa, Artificial Sequence
  anti-HIV-1_HeavyChain
QAHLEQSGSGVKKPGASVRVSCWTSGDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3276 - protein, 125 aa, Artificial Sequence
  anti-HIV-1_HeavyChain
RHTVEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3277 - protein, 125 aa, Artificial Sequence
  anti-HIV-1_HeavyChain
QAHLEQSGSGVKKRWASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3278 - protein, 125 aa, Artificial Sequence
  anti-HIV-1_HeavyChain
RHTVEQSGSGVKRPGASVRVSCWTSEDIFETTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3279 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRGLFTAHMDIRGLTQDDTATYFCARQKFARGDQGWFFDLWGRGTLIVVSS

SEQ ID NO: 3280 - protein, 125 aa, Artificial Sequence
  anti-HIV-1_HeavyChain
QVHLEQSGSGVKKPGASVRVSCWTSEDIFEKSELIHWVRQAPGQGLEWIGWVKTVTGAANFGSSDFRQRVSLTPDRDLFTAHMDIRGLTQGDTATYFCARQKFYKGGQGWYFDLWGRGTLIVVSS

SEQ ID NO: 3281 - protein, 125 aa, Artificial Sequence
  anti-HIV-1_HeavyChain
QAHLEQSGAGVKKPGASVRVSCWTSEDIFDTTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3282 - protein, 125 aa, Artificial Sequence
  anti-HIV-1_HeavyChain
QAHLEQSGSGVKKLGASVRVSCWTSRDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3283 - protein, 125 aa, Artificial Sequence
  anti-HIV-1_HeavyChain
QAHLEQSGSGVKKLGASVRVSCLASEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3284 - protein, 125 aa, Artificial Sequence
  anti-HIV-1_HeavyChain
QAHLEQSGSGVKKPGASVRVSCWPSEDIFERTELIHWVRQAPGQGLEWIGWVKTVTGTVNFGSLNFRQRVSLTRDRDLFTAHMDIRGLTQGDTATYFCARQKFERGGQGWYFDLWGRGTLIVVSS

SEQ ID NO: 3285 - protein, 125 aa, Artificial Sequence
  anti-HIV-1_HeavyChain
RAHLEQSGSEWKKLGASVRVSCWTSGDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3286 - protein, 125 aa, Artificial Sequence
  anti-HIV-1_HeavyChain
RHTVEQSGSGVKKLGASVNVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3287 - protein, 125 aa, Artificial Sequence
  anti-HIV-1_HeavyChain
QAHLEQSGSGVKKPGASVRVSCWTSEDIFEKSELIHWVRQAPGQGLEWIGWVKPVTGAVNFGSSDFRQRVSLTRDRDLFTAHMDIRGLTQGDTATYFCARQKFYAGGQGWYFDLWGRGTLIVVSS

SEQ ID NO: 3288 - protein, 125 aa, Artificial Sequence
  anti-HIV-1_HeavyChain
RHTWNKSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3289 - protein, 125 aa, Artificial Sequence
  anti-HIV-1_HeavyChain
QAHSEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3290 - protein, 125 aa, Artificial Sequence
  anti-HIV-1_HeavyChain
QAHLEQSGAGVKRPGASVRVSCWTSEDIFETTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3291 - protein, 125 aa, Artificial Sequence
  anti-HIV-1_HeavyChain
GHTWEQSGAGVKKLGASVRVSCWTSEDIFERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSS

SEQ ID NO: 3292 - protein, 125 aa, Artificial Sequence
  anti-HIV-1_HeavyChain
GTPGSESGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3293 - protein, 125 aa, Artificial Sequence
  anti-HIV-1_HeavyChain
GTPGSESGSGVKMPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3294 - protein, 125 aa, Artificial Sequence
  anti-HIV-1_HeavyChain
RHTWEQSGAGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3295 - protein, 125 aa, Artificial Sequence
  anti-HIV-1_HeavyChain
GTPGNKSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3296 - protein, 125 aa, Artificial Sequence
  anti-HIV-1_HeavyChain
QAHLEQSGAGVKKPGASVRVSCWSSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3297 - protein, 125 aa, Artificial Sequence
  anti-HIV-1_HeavyChain
GTPGNKSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWIFDLWGRGTLIAVSS

SEQ ID NO: 3298 - protein, 125 aa, Artificial Sequence
  anti-HIV-1_HeavyChain
GTPGNKSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFERGGQGWIFDLWGRGTLIAVSS

SEQ ID NO: 3299 - protein, 125 aa, Artificial Sequence
  anti-HIV-1_HeavyChain
QAHLEQSASGVKRPGGWVRVSCWTSEDIFERSELIYWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3300 - protein, 125 aa, Artificial Sequence
  anti-HIV-1_HeavyChain
QAHLEQSGSGVKKPGASVRVSCWTSEDIFERTELIHWVRQAPGQGLEWIGWVKTSSGAVNFGSPNFRTRVSLTRDRDLFTAHMDIRGLTQGDTATYFCARQKFERGGQGWYFDLWGRGTLIVVSS

SEQ ID NO: 3301 - protein, 125 aa, Artificial Sequence
  anti-HIV-1_HeavyChain
QAHLEQSGAGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3302 - protein, 125 aa, Artificial Sequence
  anti-HIV-1_HeavyChain
RHTWEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3303 - protein, 125 aa, Artificial Sequence
  anti-HIV-1_HeavyChain
GTTWNKSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3304 - protein, 125 aa, Artificial Sequence
  anti-HIV-1_HeavyChain
RHTWNESGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3305 - protein, 125 aa, Artificial Sequence
  anti-HIV-1_HeavyChain
QAHLEQSGSGVKKLGASVRVSCWTSGNIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3306 - protein, 126 aa, Artificial Sequence
  anti-HIV-1_HeavyChain
RCSMEQPGWSEKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3307 - protein, 125 aa, Artificial Sequence
  anti-HIV-1_HeavyChain
RHTSEQSGSGVKKPGASVRVSCWTSEDIFERSELIHWVRQAPGQGLEWIGWVKTVTGAVNFGSPNFRHRVSLTRDRDLFTAHMDIRGLTQGDTATYFCARQKYYAGGQGWYFDLWGRGTLIVVSS

SEQ ID NO: 3308 - protein, 125 aa, Artificial Sequence
  anti-HIV-1_HeavyChain
RHTVEQSGAGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSS

SEQ ID NO: 3309 - protein, 125 aa, Artificial Sequence
  anti-HIV-1_HeavyChain
GTPWNESGSGVKKPGASVRVSCWTSEDIFEKSELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3310 - protein, 125 aa, Artificial Sequence
  anti-HIV-1_HeavyChain
RHDLEPSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIV

SEQ ID NO: 3311 - protein, 125 aa, Artificial Sequence
  anti-HIV-1_HeavyChain
RHTVEQSGSGVKKLGASVRVSCLASEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3312 - protein, 125 aa, Artificial Sequence
  anti-HIV-1_HeavyChain
QAHLEQSGSESKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3313 - protein, 125 aa, Artificial Sequence
  anti-HIV-1_HeavyChain
GTPGSESASGVRRPGASVRVSCWTSEDIFERSELIYWVRQAPGRGLEWIGWIKLVSGAVNFGSVDFRDRVSLTRDRDLFTAHMDIRGLTQGDTATYFCARQKFERGGQGWYFDLWGRGTLIVVSS

SEQ ID NO: 3314 - protein, 125 aa, Artificial Sequence
  anti-HIV-1_HeavyChain
QVHLEQSGSGVKKPGASVRVSCWTSEDIFEKSELIQWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3315 - protein, 125 aa, Artificial Sequence
  anti-HIV-1_HeavyChain
GTPGSESGSGVKKVGASVRVSCWTSEDIFERTELIHWVRQAPGQGLEWIGWVKAVSGAVNYGSLDFRHRVSLTRDRDLFTARMDIRGLTQDDTAIYFCARQKFARGDQGWFFDLWGRGTLIVVSS

SEQ ID NO: 3316 - protein, 125 aa, Artificial Sequence
  anti-HIV-1_HeavyChain
GTPGSESGSGVKRPGASVRVSCWTSEDIFETTELIHWVRQAPGQGLEWIGWVKTVSGAVNFGSLNFRHRVSLTRDRDLSTAHMDIRGLTQDDTATYFCARQKFARGDQGWFFDLWGRGTLIVVSS

SEQ ID NO: 3317 - protein, 124 aa, Artificial Sequence
  anti-HIV-1_HeavyChain
RAHLEQSGAGVKKPGGWVRVSCWTSEDIFKTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3318 - protein, 126 aa, Artificial Sequence
  anti-HIV-1_HeavyChain
QVQLMQSGAEVKRPGASVKISCTASGFTLTDHYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3319 - protein, 126 aa, Artificial Sequence
  anti-HIV-1_HeavyChain
QVQLVQSGAEVKKPGASVKVSCKASGYNFTGYYLHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3320 - protein, 125 aa, Artificial Sequence
  anti-HIV-1_HeavyChain
GTPGSKSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3321 - protein, 126 aa, Artificial Sequence
  anti-HIV-1_HeavyChain
QVQLVQSGAELKKPGASVKVSCEASGYSFTDHHIHWVRQAPGQGLEWLGWMNPNNGDTAYAQTFLGRVTMTRDTSINTAYMELSRLTSDDTAVYFCARKTAGDVSGDKRGFFFDLWGRGSRVIVSS

SEQ ID NO: 3322 - protein, 126 aa, Artificial Sequence
  anti-HIV-1_HeavyChain
QVYMSSRGGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3323 - protein, 126 aa, Artificial Sequence
  anti-HIV-1_HeavyChain
QVQLVQSGAEVKKPGASVKVSCKASGYTFTAYYMHWLRQAPGQGLEWMGWINPHSGGTNFAQKFQGRVTMTRDTSITTAYMELSRLRSDDTATYFCARQKFASRYSGDQGSYFDLWGRGTLIVVSS

SEQ ID NO: 3324 - protein, 125 aa, Artificial Sequence
  anti-HIV-1_HeavyChain
RAHLEQSGAGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3325 - protein, 126 aa, Artificial Sequence
  anti-HIV-1_HeavyChain
QVRLVQSGADVKQPGASVKVSCKASGYTFTDYYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3326 - protein, 126 aa, Artificial Sequence
  anti-HIV-1_HeavyChain
QAHLGNKSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3327 - protein, 127 aa, Artificial Sequence
  anti-HIV-1_HeavyChain
QVYMEQSGGGVKKPGASVTLSCKTADEDVFDAAYMHWVRQAPGQTFEWLGWMKPVTGAVNYARKFQGRVSFYRTRELGIAYMDLRNLRFDDTAVYFCTRKTAGDVSGDKRGFFFDLWGRGSRVIVSS

SEQ ID NO: 3328 - protein, 127 aa, Artificial Sequence
  anti-HIV-1_HeavyChain
QVYVEQPGGGVKKPGASVTLSCKTADEDVFDATYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3329 - protein, 127 aa, Artificial Sequence
  anti-HIV-1_HeavyChain
QVYMEQAGVEVEKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3330 - protein, 127 aa, Artificial Sequence
  anti-HIV-1_HeavyChain
QVYMEQAGAGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3331 - protein, 127 aa, Artificial Sequence
  anti-HIV-1_HeavyChain
QVHMEQAGAGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3332 - protein, 127 aa, Artificial Sequence
  anti-HIV-1_HeavyChain
QVYMEQAGAEVKKPGASVTLSCETADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3333 - protein, 127 aa, Artificial Sequence
  anti-HIV-1_HeavyChain
QVYMEQPGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3334 - protein, 124 aa, Artificial Sequence
  anti-HIV-1_HeavyChain
ATPWNKSGSGVKKPGASVRVSCWTSEDIFERTELSLVRQAPGQGLEWIGWMKTVTGAVNFGSPNFRHGVSLTRDRDLFTAHMDIRGLTQGDTATYFCARQKFERGGQGWYFDLWGRGTLIVVSS

SEQ ID NO: 3335 - protein, 127 aa, Artificial Sequence
  anti-HIV-1_HeavyChain
QVYMEQAGAGMKKPGASMTASCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3336 - protein, 126 aa, Artificial Sequence
  anti-HIV-1_HeavyChain
QVQLVQSGAEVKKPGASVKVSCKASGYTFTGYYMHWVRQAPGQTFEWLGWMKPVTGAVNYARQFQGRVSFYRTRELGIAYMDLRDLKFDDTAVYFCARKTKADVSGDDRGFFFDLWGRGTRVIVSS

SEQ ID NO: 3337 - protein, 127 aa, Artificial Sequence
  anti-HIV-1_HeavyChain
RVYMEQAGAGVKKPGASVTLSCKTADEDVFDAAYMHWVRQAPGQTFEWLGWMKPVTGAVSYARKFQGRVSFTMTRELGMAYMDLRNLRFDDTAVYFCARKTAGDVSGDNRGYFFDLWGRGSRVIVSS

SEQ ID NO: 3338 - protein, 127 aa, Artificial Sequence
  anti-HIV-1_HeavyChain
QVYMEQSGGGVKKPGPSVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3339 - protein, 126 aa, Artificial Sequence
  anti-HIV-1_HeavyChain
QVQLVQSGAEVKKPGASVKVSCKASGYTFTGYYIHWMRQAPGQGLEWMGWINPNSGAVSYARKFQGRVSFLHDQGIRMAYMDLRNLRFDDTAVYFCARKTAGDVSGDNRGYFFDLWGRGSRVIVSS

SEQ ID NO: 3340 - protein, 127 aa, Artificial Sequence
  anti-HIV-1_HeavyChain
QVHMEQAGVEVEKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3341 - protein, 127 aa, Artificial Sequence
  anti-HIV-1_HeavyChain
QVYMEQAGAGVKKPGASATLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3342 - protein, 125 aa, Artificial Sequence
  anti-HIV-1_HeavyChain
GHDLEQSGSGVKKPGASVRVSCWTSEDIFEKSELIHWVRQAPGQGLEWIGWVKAVSGAVNYGSLDFRHRVSLTRDRDLFTAHMDIRGLTQDDTAIYFCARQKFARGDQGWFFDLWGRGTLIVVSS

SEQ ID NO: 3343 - protein, 126 aa, Artificial Sequence
  anti-HIV-1_HeavyChain
QAHRGTIWGLEVKKPGGWVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3344 - protein, 127 aa, Artificial Sequence
  anti-HIV-1_HeavyChain
QVHMEQAGAGVEKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3345 - protein, 127 aa, Artificial Sequence
  anti-HIV-1_HeavyChain
QVYMEQSGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3346 - protein, 127 aa, Artificial Sequence
  anti-HIV-1_HeavyChain
QVYMEQSGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3347 - protein, 127 aa, Artificial Sequence
  anti-HIV-1_HeavyChain
EVYMEQSGGGVKKPGASVTLSCKTASEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3348 - protein, 127 aa, Artificial Sequence
  anti-HIV-1_HeavyChain
QVQLVQSGAEVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3349 - protein, 127 aa, Artificial Sequence
  anti-HIV-1_HeavyChain
QVFMEQSGGGMKKPGASMTVSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3350 - protein, 127 aa, Artificial Sequence
  anti-HIV-1_HeavyChain
QVYMEQAGGGMKKPGASMTVSCKTADEDIFDAAYMHWVRQAPGQTFEWLGWMKPVTGAVNYARRFQGRVSFYRTRELGIAYMDLRDLKFDDTAVYFCARKTKGDVSGDDRGFFFDLWGRGTRVIVSS

SEQ ID NO: 3351 - protein, 127 aa, Artificial Sequence
  anti-HIV-1_HeavyChain
QVYMEQAGAGVKKPGASVTLSCKAADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3352 - protein, 127 aa, Artificial Sequence
  anti-HIV-1_HeavyChain
QVFMEQAGAGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3353 - protein, 127 aa, Artificial Sequence
  anti-HIV-1_HeavyChain
QVYMEQPGGEVKKPGASVTLSCKTADEDVFDAAYMHWVRQAPGQTFEWLGWMKPVTGAVNYARKFQGRVSFYMTRELGMAYMDLRNLRFDDTAVYFCARKTAGDVSGDNRGYFFDLWGRGSRVIVSS

SEQ ID NO: 3354 - protein, 127 aa, Artificial Sequence
  anti-HIV-1_HeavyChain
QVHMEQAGAGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3355 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGPRVIVSS

SEQ ID NO: 3356 - protein, 127 aa, Artificial Sequence
  anti-HIV-1_HeavyChain
QVQLVQSGAEVKKPGASVKVSCKASGHTFTNYDINWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3357 - protein, 127 aa, Artificial Sequence
  anti-HIV-1_HeavyChain
QVYMEQAGGGMKKPGASMTVSCKTADEDIFDAAYMHWVRQAPGQTFEWLGWMKPVTGAVNYARQFQGRVSFYRTRELGIAYTDLRDLKFDDTAVYFCARKTKGDVSGDDRGFFFDLWGRGTRVIVSS

SEQ ID NO: 3358 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3359 - protein, 127 aa, Artificial Sequence
  anti-HIV-1_HeavyChain
QVYMEQAGGGVKKPGASVTLSCKTADEDVFDAAYMHWVRQAPGQTFEWPGWMKPVTGAVNYARKFQGRVSFYRTRELGIAYMDLRNLRFDDTAVYFCARKTAGDVSGDKRGFFFDLWGRGSRVIVSS

SEQ ID NO: 3360 - protein, 127 aa, Artificial Sequence
  anti-HIV-1_HeavyChain
QVYMEQAGGGVKKPGASATLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3361 - protein, 127 aa, Artificial Sequence
  anti-HIV-1_HeavyChain
QVYMEQAGGGVKKPGASVTLSCKTADEDVFDAAYMRWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3362 - protein, 127 aa, Artificial Sequence
  anti-HIV-1_HeavyChain
QVQLVQSGAEVKKPGASVKVSCRASGYTFGNHAISWVRQAPGQGLEWMGWIRPKTGARNQARQFQPRISLTRDRALSTAYLDLNSLTSADSGTYFCARQTFKPDFYFADQGWSFNLWGRGAHFIVSS

SEQ ID NO: 3363 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGPGSRVIVSS

SEQ ID NO: 3364 - protein, 127 aa, Artificial Sequence
  anti-HIV-1_HeavyChain
QVYMEQAGAGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3365 - protein, 127 aa, Artificial Sequence
  anti-HIV-1_HeavyChain
QVHMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3366 - protein, 127 aa, Artificial Sequence
  anti-HIV-1_HeavyChain
QVYMEQAGDGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3367 - protein, 127 aa, Artificial Sequence
  anti-HIV-1_HeavyChain
QVQLVQSGAEVKKPGASVTLSCKTADEDVFDAAYMHWVRQAQGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3368 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSQVIVSS

SEQ ID NO: 3369 - protein, 127 aa, Artificial Sequence
  anti-HIV-1_HeavyChain
QVQLVQSGAEVRKPGASVKVSCKASGYTFTNYYMHWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3370 - protein, 127 aa, Artificial Sequence
  anti-HIV-1_HeavyChain
QAHLEQSGSGVKKPGASVRVSCWTSEDIFERTELIHWVRQAPGQGLEWIGWVKTVTGTVNYARKFQGRVSFYRTRELGIAYMDLRNLRFDDTAVYFCARKTAGDVSGDKRGFFFDLWGRGSRVIVSS

SEQ ID NO: 3371 - protein, 127 aa, Artificial Sequence
  anti-HIV-1_HeavyChain
LIHLAQSGAEVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3372 - protein, 127 aa, Artificial Sequence
  anti-HIV-1_HeavyChain
QVQLVQSGAEVKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3373 - protein, 127 aa, Artificial Sequence
  anti-HIV-1_HeavyChain
QVYMEQGRGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3374 - protein, 127 aa, Artificial Sequence
  anti-HIV-1_HeavyChain
QVYMEQAGGGMKKPGASMTVSCKTADEDVFDAAYMHWVRQAPGQTFEWLGWMKPVTGAVNYARQFQGRVSFYRTRELGIAYMDLRDLKSDDTAVYFCARKTAGDVSGDKRGFFFDLWGRGSRVIVSS

SEQ ID NO: 3375 - protein, 127 aa, Artificial Sequence
  anti-HIV-1_HeavyChain
QVQLVQSGAEVKKPGSSIKVSCKASGDTISRYAINWVRQAPGQGLEWIGWVKTVTGAVNFGSLDFRHRISLTRDRDLFTAHMGIRGLTQGDTATYFCARQKFESRYTGGQGWYFDLWGRGTHIVVSS

SEQ ID NO: 3376 - protein, 127 aa, Artificial Sequence
  anti-HIV-1_HeavyChain
QVYMEQAGGGVKKPGASVTLSCKTADEDIFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3377 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARNFQGRVSFYRTRELGIAYMDLRNLRFDDTAVYFCARQKFESRYSGDQGSYFDLWGRGTLIIVSS

SEQ ID NO: 3378 - protein, 127 aa, Artificial Sequence
  anti-HIV-1_HeavyChain
QVYMEQAGGGVKRPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3379 - protein, 127 aa, Artificial Sequence
  anti-HIV-1_HeavyChain
QVQLVQSGDEVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3380 - protein, 127 aa, Artificial Sequence
  anti-HIV-1_HeavyChain
QVQLVQSGAGVKKPGSSVKVSCKASGGTFSSYAINWLRQVPGQRPEWMGWIRPKTGARNQARQFQPRISLTRDRALSTAYLDLNSLTSADSGTYFCARQTFKPDFYFADQGWSFNLWGRGAHFIVSS

SEQ ID NO: 3381 - protein, 127 aa, Artificial Sequence
  anti-HIV-1_HeavyChain
QVYMERAGGGVKKPGASVTLSCETADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3382 - protein, 127 aa, Artificial Sequence
  anti-HIV-1_HeavyChain
QVYMEQAGAGMKKPGASMTVSCKTADEDIFDAAYMHWVRQAPGQTFEWLGWMKPVTGAVNYARQFQGRVSFLQDQGIRIAYMDLRDLKFDDTAVYFCARKTKGDVSGDDRGFFFDLWGRGTRVIVSS

SEQ ID NO: 3383 - protein, 127 aa, Artificial Sequence
  anti-HIV-1_HeavyChain
QVYMGAGRGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3384 - protein, 127 aa, Artificial Sequence
  anti-HIV-1_HeavyChain
QVYMEQAGAGVKKPGASVTLSCKTADEDVFDAAYMHWVRQAPGQPFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3385 - protein, 127 aa, Artificial Sequence
  anti-HIV-1_HeavyChain
QVQLVQSGAEVKKPGASVKISCKASGYTFIRHGIHWLRQVPGQRPEWMGWIRPKTGARNQARQFQPRISLARDRALSTAYLDLNSLTSADSGTYFCARQTFKPDFYFADQGWSFNLWGRGAHFIVSS

SEQ ID NO: 3386 - protein, 127 aa, Artificial Sequence
  anti-HIV-1_HeavyChain
QVLLVQSGAEVKKPGSSVKVSCKASGDSLTKYAFSWVRQAPGQGPEWMGWIRPKTGARNRARQFQPRISLTRDRALSTAYLDLNSLTSADSGTYFCARQTFKPDFYFADQGWSFNLWGRGAHFIVSS

SEQ ID NO: 3387 - protein, 127 aa, Artificial Sequence
  anti-HIV-1_HeavyChain
QVYMEQAGGGVKKPGASVTLSCKTADEDVFDAAYMHWVRQARGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3388 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDNRGYFFDLWGRGSRVIVSS

SEQ ID NO: 3389 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGPGSRVIVSS

SEQ ID NO: 3390 - protein, 127 aa, Artificial Sequence
  anti-HIV-1_HeavyChain
QVYMEQAGGGMKKPGASMTVSCKTADEDIFDAAYMRWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3391 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARKFQGRVSFYMTRELGMAYLDLRNLRFDDTAVYFCARKTAGDVSGDNRGYFFDLWGRGSRVIVSS

SEQ ID NO: 3392 - protein, 127 aa, Artificial Sequence
  anti-HIV-1_HeavyChain
QVQLVQSGAEVKKPGASVKVSCKASGYTFTGYYMHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3393 - protein, 127 aa, Artificial Sequence
  anti-HIV-1_HeavyChain
QVYMEQAGGGVKKPGASVTLSCKTADEDVFDAAYMHWVRQAPGQTFEWLGWIKPVTGAVNYARKFQGRVSFYRTRELGIAYMDLRNLRFDDTAVYFCARKTAGDVSGDKRGFFFDLWGRGSRVIVSS

SEQ ID NO: 3394 - protein, 127 aa, Artificial Sequence
  anti-HIV-1_HeavyChain
QVYMEQAGGGMKKPGASVTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3395 - protein, 127 aa, Artificial Sequence
  anti-HIV-1_HeavyChain
QAHLEQSGSGVKKPGASVRVSCWSSEDISKAELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3396 - protein, 127 aa, Artificial Sequence
  anti-HIV-1_HeavyChain
QVYMEAGRGGVKKPGASATLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3397 - protein, 127 aa, Artificial Sequence
  anti-HIV-1_HeavyChain
RCIWRQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3398 - protein, 127 aa, Artificial Sequence
  anti-HIV-1_HeavyChain
QVYMEQAGGGVKKPGASVTLSCKTADEDVFDAAYMHWVRQAPGQTFEWLGWIKPVTGAVSYARKFQGRVSFYMTRELGMAYMDLRNLRFDDTAVYFCARKTAGDVSGDNRGYFFDLWGRGSRVIVSS

SEQ ID NO: 3399 - protein, 128 aa, Artificial Sequence
  anti-HIV-1_HeavyChain
QSHLEQSGSAMKKPGASVKSSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3400 - protein, 127 aa, Artificial Sequence
  anti-HIV-1_HeavyChain
RCLWRQAGGGMKKPGASMTVSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3401 - protein, 127 aa, Artificial Sequence
  anti-HIV-1_HeavyChain
RCIWERAGGGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3402 - protein, 127 aa, Artificial Sequence
  anti-HIV-1_HeavyChain
QVQLEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3403 - protein, 127 aa, Artificial Sequence
  anti-HIV-1_HeavyChain
QVYMEQAGGGMKKPGASMTVSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3404 - protein, 127 aa, Artificial Sequence
  anti-HIV-1_HeavyChain
QVYMEQAGGGVKKPGASVTLSCKTADEDVFDAAYMRWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3405 - protein, 127 aa, Artificial Sequence
  anti-HIV-1_HeavyChain
QVYMEQPGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3406 - protein, 127 aa, Artificial Sequence
  anti-HIV-1_HeavyChain
QVYMEQAGGEVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3407 - protein, 127 aa, Artificial Sequence
  anti-HIV-1_HeavyChain
QVQLVQSGAEVKKPGASVRVSCQASGYIFTGYFVNWLRQLPGQRPEWMGWIRPKSGARNQARQFQPRISLTRDRALSTAYLDSNSLTSADSGTYFCARQTFKPDFYFADQGWSFNLWGRGAHFIVSS

SEQ ID NO: 3408 - protein, 127 aa, Artificial Sequence
  anti-HIV-1_HeavyChain
GCIWTQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3409 - protein, 127 aa, Artificial Sequence
  anti-HIV-1_HeavyChain
RCIWRQAGGGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3410 - protein, 127 aa, Artificial Sequence
  anti-HIV-1_HeavyChain
QVYMEQAGGGVKKPGASVTLSCKTADEDVFDAAYMHWVRQAPGQTFEWVGWMKPVTGAVSYARKFQGRVSFYMTRELGMAYMDLRNLRFDDTAVYFCARKTAGDVSGDNRGYFFDLWGRGSRVIVSS

SEQ ID NO: 3411 - protein, 127 aa, Artificial Sequence
  anti-HIV-1_HeavyChain
QVYMEQAGGGVKEPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3412 - protein, 127 aa, Artificial Sequence
  anti-HIV-1_HeavyChain
QAHLEQSGSGVKKPGASVRVSCWSSEDIFKTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3413 - protein, 128 aa, Artificial Sequence
  anti-HIV-1_HeavyChain
QAHLEQSGSGVKKPGASVRVSCWSSEDIFERTELIHWVRQAPGQGLEWIGWMKTVTGAVNFGSLDFRHRISLTRDRDLFTAHMDIRGLAQGDTATYFCARQKFESRYTGGQGWYFDLWGRGTHIVVSS

SEQ ID NO: 3414 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3415 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3416 - protein, 128 aa, Artificial Sequence
  anti-HIV-1_HeavyChain
SHTWNNRGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3417 - protein, 127 aa, Artificial Sequence
  anti-HIV-1_HeavyChain
QSHLEQSGSAMKKPGASVRVSCWTSEDIFHNELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3418 - protein, 128 aa, Artificial Sequence
  anti-HIV-1_HeavyChain
QAHLEQSGSGVKKPGASVRVSCWTSEDIFERTELIHWVRQAPGQGLEWIGWMKTVTGAVNFGSLDFRHRISLTRDRDLFTAHMDIRGLTQGDTATYFCARQKFESRYTGGQGWYFDLWGRGTHIVVSS

SEQ ID NO: 3419 - protein, 127 aa, Artificial Sequence
  anti-HIV-1_HeavyChain
QVFMEQAGGEVKKPGASMTVSCKTADEDVFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3420 - protein, 127 aa, Artificial Sequence
  anti-HIV-1_HeavyChain
QAHLEQSGSGVKKLGASVRVSCWTSEDIFEDELIHWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3421 - protein, 127 aa, Artificial Sequence
  anti-HIV-1_HeavyChain
QSHLEQSGSAMKKPGASVRVSCWTSEDILKAELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3422 - protein, 127 aa, Artificial Sequence
  anti-HIV-1_HeavyChain
QVQLVQSGAEVKKPGASVKVSCKASGYSFTDYYIHWLRQVQGQRPEWMGWIRPRTGARNQARQFQPRISLTRDRALSTAYLDLNSLTSADSGTYFCARQTFKPDFYFADQGWSFNLWGRGAHFIVSS

SEQ ID NO: 3423 - protein, 127 aa, Artificial Sequence
  anti-HIV-1_HeavyChain
QVFMEQAGGEVKKPGASMTVSCKTADEDVFDAAYMHWVRQAPGQTFEWLGWMKPVTGAVNYARKFQGRVSFYRTRELGIAYMDLRDLKFDDTAVYFCARKTKGDVSGDDRGFFFDLWGRGTRVIVSS

SEQ ID NO: 3424 - protein, 128 aa, Artificial Sequence
  anti-HIV-1_HeavyChain
QAHLEQSGAGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3425 - protein, 128 aa, Artificial Sequence
  anti-HIV-1_HeavyChain
QAHLEQSGAGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3426 - protein, 128 aa, Artificial Sequence
  anti-HIV-1_HeavyChain
QSHLEQSGSAMKKPGASVRVSCWASEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3427 - protein, 127 aa, Artificial Sequence
  anti-HIV-1_HeavyChain
RCRLVQSGAEVKKPGASVRVSCQASGYTFSAYGVNWVRQAPGQELEWIGWVKTVTGAVNFGSPNFRHRISLTRDRDLFTAHMDIRGLTQGDTATYFCARQKFESRYTGGQGWYFDLWGRGTHIVVSS

SEQ ID NO: 3428 - protein, 128 aa, Artificial Sequence
  anti-HIV-1_HeavyChain
QAHLEQSGSGVKKPGASVRVSCWSSEDIFERTELIHWVCQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3429 - protein, 128 aa, Artificial Sequence
  anti-HIV-1_HeavyChain
QAHLEQSGSGVKKPGASVRVSCWSSEDIFERTELIHWVRQAPGQGLEWIGWVKIVTGAVNFGSLDFRHRISLTRDRDLFTAHMDIRGLTQGDTATYFCARQKFESRYTGGQGWYFDLWGRGTHIVVSS

SEQ ID NO: 3430 - protein, 128 aa, Artificial Sequence
  anti-HIV-1_HeavyChain
QVQLVQSGLEVKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSS

SEQ ID NO: 3431 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLRQDDTATYFCARQKFESRYSGDQGSYFDLWGRGTLIIVSS

SEQ ID NO: 3432 - protein, 128 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFASRYSGDQGSYFDLWGRGTLIVVSS

SEQ ID NO: 3433 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFESRYTGGQGWYFDLWGRGTHIVVSS

SEQ ID NO: 3434 - protein, 128 aa, Artificial Sequence
  anti-HIV-1_HeavyChain
RHTWEQSGSGVKKPGASVRVSCWTSEDIFEKSELIHWVRQAPGQGLEWIGWVKTVTGAVNFGSSDFRQRVSLTRDRDLSTAYMDIRGLTQDDTATYFCARQKFASRYSGDQGSYFDLWGRGTLIVVSS

SEQ ID NO: 3435 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFESRYTGGQGWYFDLWGRGTHIVVSS

SEQ ID NO: 3436 - protein, 128 aa, Artificial Sequence
  anti-HIV-1_HeavyChain
QVQLVQSGAEVKKPGASVRVSCWTSEDIFDTTELIYWVRQAPGQGLEWIGWVKIVSGTVNFASLDFRNRISLSRDRDLSTAHMDIRGLTQDDTATYFCARQKFESRYTGGQGWYFDLWGRGTHIVVSS

SEQ ID NO: 3437 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQGDTATYFCARQKFESRYTGGQGWYFDLWGRGTHIVVSS

SEQ ID NO: 3438 - protein, 128 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPDFRHRISLSRDRDLSTAHMDIRGLTQDDTATYFCARQKFASRYSGDQGSYFDLWGRGTLIIVSS

SEQ ID NO: 3439 - protein, 128 aa, Artificial Sequence
  anti-HIV-1_HeavyChain
QAHLEQSGSGVKKPGASVRVSCWTSEDIFERTELIHWVRQAPGRGLEWIGWVKTVSGTVNFGSSDFRNRVSLTRDRDLSTAHMDIRGLTQDDTATYFCARQKFESLYSDDQGSYFDLWGRGTLIIVSS

SEQ ID NO: 3440 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRNRISLTRDRDLSTAHMDIRGLTQDDTATYFCARQKFESLYSDDQGSYFDLWGRGTLIIVSS

SEQ ID NO: 3441 - protein, 128 aa, Artificial Sequence
  anti-HIV-1_HeavyChain
QSHLEQSGSAMKRPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3442 - protein, 128 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRNRISLSRDRDLSTAYMDIRGLTQDDTATYFCARQKFASRYSGDQGSYFDLWGRGTLIVVSS

SEQ ID NO: 3443 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDFFTAHMDIRGLTQGDTATYFCARQKFESRYTGGQGWYFDLWGRGTHIVVSS

SEQ ID NO: 3444 - protein, 127 aa, Artificial Sequence
  anti-HIV-1_HeavyChain
QAHLEQSGSGVKKPGASVRVSCWSSEDIFRTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3445 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFESLYSDDQGSYFDLWGRGTLIIVSS

SEQ ID NO: 3446 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSS

SEQ ID NO: 3447 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASSDFRNRISLSRDRDLSTAHMDIRGLTQDDTATYFCARQKFASRYSGDQGSYFDLWGRGTLIVVSS

SEQ ID NO: 3448 - protein, 128 aa, Artificial Sequence
  anti-HIV-1_HeavyChain
QAHLEQSGSGVKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3449 - protein, 128 aa, Artificial Sequence
  anti-HIV-1_HeavyChain
QSHLEQSGSAMKKPGASVRVSCWTSEDIFDTTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3450 - protein, 128 aa, Artificial Sequence
  anti-HIV-1_HeavyChain
QSHLEQSGSAMKKPGASVRVSCWTSEDIFGTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3451 - protein, 128 aa, Artificial Sequence
  anti-HIV-1_HeavyChain
QVQLVQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3452 - protein, 128 aa, Artificial Sequence
  anti-HIV-1_HeavyChain
QAHLEQSGSGVKKPGASVRVSCWTSEGIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3453 - protein, 128 aa, Artificial Sequence
  anti-HIV-1_HeavyChain
QAHLEQSGSGVKKPGASVRVSCWTSEDIFERTELIHWARQAPGQGLEWIGWVKTVTGAVNFGSPNFRHRASLTRDRDLFTAHMDIRGLTEGDTATYFCARQKFASRYSGDQGSYFDLWGRGTLIIVSS

SEQ ID NO: 3454 - protein, 128 aa, Artificial Sequence
  anti-HIV-1_HeavyChain
QSHLEQSGSAMKKPGASVRVSCWTSEDIFDTAELIYWVRQAPGQGLEWIGWVKIVSGTVNFASLDFRNRISLSRDRDLSTAHMDIRGLRQDDTATYFCARQKFESRYSGDQGSYFDLWGRGTLIIVSS

SEQ ID NO: 3455 - protein, 128 aa, Artificial Sequence
  anti-HIV-1_HeavyChain
QAHLEQSGSGVKKLGASVRVSCWTSEDIFERTELIHWVRQAPGQGLEWIEWVKAVSGAVNYGSLDFRHRVSLTRDRDLFTAHMDIRGLTQDDTATYFCARQKFESRYTGGQGWYFDLWGRGTHIVVSS

SEQ ID NO: 3456 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLDCVSS

SEQ ID NO: 3457 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGAVNFASLDFRNRISLSRDRDLSTAHMDIRGLTQDDTATYFCARQKFASRYSGDQGSYFDLWGRGTLIIVSS

SEQ ID NO: 3458 - protein, 128 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQGDTATYFCARQKFESRYTGGQGWYFDLWGRGTHIVVSS

SEQ ID NO: 3459 - protein, 128 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLSTAHMDIRGLTQDDTATYFCARQKFESLYSDDQGSYFDLWGRGTLIIVSS

SEQ ID NO: 3460 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGTVNFGSLNFRHRISLTRDRDLFTAHMDIRGLTQGDTATYFCARQKFESRYTGGQGWYFDLWGRGTHIVVSS

SEQ ID NO: 3461 - protein, 128 aa, Artificial Sequence
  anti-HIV-1_HeavyChain
QSHLEQSGSAMKKPGASVRVSCWTSEDIFERTELIYWVRQAPGRGLEWIGWVKIVSGTVNFASLDFRNRISLSRDRDLSTAHMDIRGLTQDDTATYFCARQKFASRYSGDQGSYFDLWGRGTLIIVSS

SEQ ID NO: 3462 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIIVSS

SEQ ID NO: 3463 - protein, 128 aa, Artificial Sequence
  anti-HIV-1_HeavyChain
QARLEQSGSGVKKLGASVRVSCWTSEDIFERTELIHWVRQAPGQGLEWIGWVKAVSGAVNYGSLDFRNRISLSRDRDLSTAYMDIRGLTQDDTATYFCARQKFASRYSGDQGSYFDLWGRGTLIVVSS

SEQ ID NO: 3464 - protein, 128 aa, Artificial Sequence
  anti-HIV-1_HeavyChain
QAHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSS

SEQ ID NO: 3465 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLSTAYMDIRGLTQDDTATYFCARQKFASRYSGDQGSYFDLWGRGTLIVVSS

SEQ ID NO: 3466 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAANFGSLDFRHRISLTRDRDLFTAHMDIRGLTQGDTATYFCARQKFESRYTGGQGWYFDLWGRGTHIVVSS

SEQ ID NO: 3467 - protein, 128 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3468 - protein, 127 aa, Artificial Sequence
  anti-HIV-1_HeavyChain
RCIWRQAGGGVKKPGASVTLSCKTADEDVFDAAYMHWVRQAPGQTFEWLGWMKPVTGAVSYARKFQGRVSFYMTRGIRMAYMDLRNLRFDDTAVYFCARKTAGDVSGDNRGYFFDLWGRGSRVIVSS

SEQ ID NO: 3469 - protein, 128 aa, Artificial Sequence
  anti-HIV-1_HeavyChain
QSHLEQSGSAMKKPGASVRVSCWTSEDIFERTELIYWVRQAPGRGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3470 - protein, 128 aa, Artificial Sequence
  anti-HIV-1_HeavyChain
QSHLEQSGSAMKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3471 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSAAHMDIRGLTQDDTATYFCARQKFASRYSGDQGSYFDLWGRGTLIIVSS

SEQ ID NO: 3472 - protein, 128 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFASRYSGDQGSYFDLWGRGTLIVVSS

SEQ ID NO: 3473 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCTRQKFESRYTGGQGWYFDLWGRGTHIVVSS

SEQ ID NO: 3474 - protein, 128 aa, Artificial Sequence
  anti-HIV-1_HeavyChain
QAHLEQSGSGVKKPGASVRVSCWSSEDIFERTELIHWVRQAPGQGPEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3475 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGPLDFRHRISLTRDRDLFTAHMDIRGLTQGDTATYFCARQKFESRYTGGQGWYFDLWGRGTHIVVSS

SEQ ID NO: 3476 - protein, 128 aa, Artificial Sequence
  anti-HIV-1_HeavyChain
QSHLEQSGPAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3477 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRGLSTAHMDIRGLTQDDTATYFCARQKFASRYSGDQGSYFDLWGRGTLIIVSS

SEQ ID NO: 3478 - protein, 128 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFASRYSGDQGSYFDLWGRGTLIIVSS

SEQ ID NO: 3479 - protein, 128 aa, Artificial Sequence
  anti-HIV-1_HeavyChain
QSHLEHSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3480 - protein, 128 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFESLYSDDQGSYFDLWGRGTLIIVSS

SEQ ID NO: 3481 - protein, 128 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRISLTRDRDLFTAHMDIRGLTQGDTATYFCARQKFESRYTGGQGWYFDLWGRGTHIVVSS

SEQ ID NO: 3482 - protein, 128 aa, Artificial Sequence
  anti-HIV-1_HeavyChain
QAHLEQSASGVRRPGASVRVSCWTSEDIFERSELIYWVRQAPGRGLEWIGWIKLVSGAVNFGSVDFRNRISLSRDRDLSTAHMDIRGLRQDDTATYFCARQKFESRYSGDQGSYFDLWGRGTLIIVSS

SEQ ID NO: 3483 - protein, 128 aa, Artificial Sequence
  anti-HIV-1_HeavyChain
QAHLEQSASGVKRPGASVRVSCWTSEDIFERTELIYWVRQAPGQGLEWIGWVKTVSGAVNFGSQDFRDRFSLTRDRDLSTAHMDIRGLTQDDTATYFCARQKFASRYSGDQGSYFDLWGRGTLIIVSS

SEQ ID NO: 3484 - protein, 128 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3485 - protein, 128 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQDDTATYFCARQKFESLYSDDQGSYFDLWGRGTLIIVSS

SEQ ID NO: 3486 - protein, 128 aa, Artificial Sequence
  anti-HIV-1_HeavyChain
QSHLKQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3487 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLSTAHMDIRGLTQDDTATYFCARQKFASRYSGDQGSYFDLWGRGTLIIVSS

SEQ ID NO: 3488 - protein, 128 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFESRYTGGQGWYFDLWGRGTHIVVSS

SEQ ID NO: 3489 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQDDTATYFCARQKFESLYSDDQGSYFDLWGRGTLIIVSS

SEQ ID NO: 3490 - protein, 128 aa, Artificial Sequence
  anti-HIV-1_HeavyChain
QSHLEQSGSAMKKPGASVRVSCWTSEDILERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3491 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRQRVSLTRDRDLFTAHMDIRGLTQGDTATYFCARQKFASRYSGDQGSYFDLWGRGTLIVVSS

SEQ ID NO: 3492 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRISLTRDRDLFTAHMDIRGLTQGDTATYFCARQKFESRYTGGQGWYFDLWGRGTHIVVSS

SEQ ID NO: 3493 - protein, 128 aa, Artificial Sequence
  anti-HIV-1_HeavyChain
QAHLEQSGSGVKKPGASVRVSCWTSDDIFERTELIHWVRQAPGQGLEWIGWVKTVTGAVNFGSPNFRQRVSLTRDRDLFTAHMDIRGLTQGDTATYFCARQKFESRYTGGQGWYFDLWGRGTHIVVSS

SEQ ID NO: 3494 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIVVSS

SEQ ID NO: 3495 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRNRISLSRDRDLSTAHMDIRGLTQDDTATYFCARQKFASRYSGDQGSYFDLWGRGTLIIVSS

SEQ ID NO: 3496 - protein, 128 aa, Artificial Sequence
  anti-HIV-1_HeavyChain
QAHLEQSASGVKRPGASVRVSCWTSEDIFERTELIYWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3497 - protein, 128 aa, Artificial Sequence
  anti-HIV-1_HeavyChain
QAHLEQSASGVRRPGASVRVSCWTSEDIFERSELIYWVRQAPGRGLEWIGWIKLVSGAVNFGSVDFRDRVSLTRDRDLFTAHMDIRGLTQDDTATYFCARQKFASRYSGDQGSYFDLWGRGTLIIVSS

SEQ ID NO: 3498 - protein, 128 aa, Artificial Sequence
  anti-HIV-1_HeavyChain
QAHLEQSGSGVKKPGASVRVSCWTSEDIFERTELIHWVRQAPGQGLEWIGWVKTVSGTVNFASLDFRNRISLSRDRDLSTAYMDIRGLTQDDTATYFCARQKFASRYSGDQGSYFDLWGRGTLIVVSS

SEQ ID NO: 3499 - protein, 128 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRISLSRDRDLSTAYMDIRGLTQDDTATYFCARQKFASRYSGDQGSYFDLWGRGTLIVVSS

SEQ ID NO: 3500 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISPTRDRDLFTAHMDIRGLTQGDTATYFCARQKFESRYTGGQGWYFDLWGRGTLIVVSS

SEQ ID NO: 3501 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLPTAYMDIRGLTQDDTATYFCARQKFASRYSGDQGSYFDLWGRGTLIVVSS

SEQ ID NO: 3502 - protein, 128 aa, Artificial Sequence
  anti-HIV-1_HeavyChain
QSHLEQSGSAMKKPGASVRVSCWTSEDIFDTTELIYWVRQAPGQGLEWIGWVKIASGTVNFASLDFRNRISLSRDRDLSTAHMDIRGLTQDDTATYFCARQKFASRYSGDQGSYFDLWGRGTLIVVSS

SEQ ID NO: 3503 - protein, 128 aa, Artificial Sequence
  anti-HIV-1_HeavyChain
QSHLEQSGSAMKKPGASVRVSCWTSEDIFDTTELIYWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3504 - protein, 128 aa, Artificial Sequence
  anti-HIV-1_HeavyChain
QVQLVQSGAEVKKPGASVRVSCWTSEDIFDTTELIYWVRQAPGQGLEWIGWVKIVSGTVNFASLDFRNRISLSRDRDLSTAHMDIRGLRQDDTATYFCARQKFESRYSGDQGSYFDLWGRGTLIIVSS

SEQ ID NO: 3505 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRHRISLTRDRDLFTAHMDIRGLTQGDTATYFCARQKFESRYTGGQGWYFDLWGRGTHIVVSS

SEQ ID NO: 3506 - protein, 128 aa, Artificial Sequence
  anti-HIV-1_HeavyChain
QAHLEQSASGVKRPGASVRVSCWTSEDIFERSELIYWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3507 - protein, 128 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFESLYSDDQGSYFDLWGRGTLIIVSS

SEQ ID NO: 3508 - protein, 128 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIVVSS

SEQ ID NO: 3509 - protein, 128 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQGDTATYFCARQKFESRYTGGQGWYFDLWGRGTHIVVSS

SEQ ID NO: 3510 - protein, 127 aa, Artificial Sequence
  anti-HIV-1_HeavyChain
QAHLEQSGSGVKKPGASVRVSCWTSEDILRKSELIHWVRQAPGQGLEWIGWVKTVTGAVNFGHQISDRVSLTRDRDLSTAHMDIRGLTQDDTATYFCARQKFESLYSDDQGSYFDLWGRGTLIIVSS

SEQ ID NO: 3511 - protein, 128 aa, Artificial Sequence
  anti-HIV-1_HeavyChain
PAHLEQSGSGVKKPGASVRVSCWASEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3512 - protein, 128 aa, Artificial Sequence
  anti-HIV-1_HeavyChain
QAHLEQSASGVKRPGASVRVSCWTSEDIFERSELIYWVRQAPGQGLEWIGWVKTVSGAVNFGSTDFRERISLSRDRDLSTAYMDIRGLTQDDAATYFCARQKFASRYSGDQGSYFDLWGRGTLIVVSS

SEQ ID NO: 3513 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDLRHRISLTRDRDLFTAHMDIRGLTQGDTATYFCARQKFESRYTGGQGWYFDLWGRGTHIVVSS

SEQ ID NO: 3514 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTLIVVSS

SEQ ID NO: 3515 - protein, 128 aa, Artificial Sequence
  anti-HIV-1_HeavyChain
SHDLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3516 - protein, 128 aa, Artificial Sequence
  anti-HIV-1_HeavyChain
QAHLEQSGSGVKKLGASVRVSCWTSEDIFERTELIHWVRQAPGQGLEWIGWVKAVTGAVNFGSLDFRHRISLTRDRDLFTAHMDIRGLTQGDTATYFCARQKFESRYTGGQGWYFDLWGRGTHIVVSS

SEQ ID NO: 3517 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFASRYSGDQGSYFDLWGRGTLIVVSS

SEQ ID NO: 3518 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASSDFRNRISLSRDRDLSTAHMGIRGLRQDDTATYFCARQKFESRYSGDQGSYFDLWGRGTLIIVSS

SEQ ID NO: 3519 - protein, 128 aa, Artificial Sequence
  anti-HIV-1_HeavyChain
EVQLVQSGADVKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3520 - protein, 128 aa, Artificial Sequence
  anti-HIV-1_HeavyChain
QAHLEQSGSGVKKPGASVRVSCWSSEDIFERTELIHWVHQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3521 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRALSTAHMDIRGLTQDDTATYFCARQKFASRYSGDQGSYFDLWGRGTLIIVSS

SEQ ID NO: 3522 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFASLDFRNRISLSRDRDLSTAYMDIRGLTQDDTATYFCARQKFASRYSGDQGSYFDLWGRGTLIVVSS

SEQ ID NO: 3523 - protein, 128 aa, Artificial Sequence
  anti-HIV-1_HeavyChain
QAHLEQSASGVRRPGASVRVSCWTSEDIFERSELIYWVRQAPGRGLEWIGWIKLVSGAVNFASLDFRNRISLSRDRDLSTAYMDIRGLTQDDTATYFCARQKFASRYSGDQGSYFDLWGRGTLIVVSS

SEQ ID NO: 3524 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQDDTATYFCARQKFASRYSGDQGSYFDLWGRGTLIIVSS

SEQ ID NO: 3525 - protein, 128 aa, Artificial Sequence
  anti-HIV-1_HeavyChain
QSHLEQSGSAMKKPGASVRVSCWTSEDIFDTTELIYWVRQAPGQGLGWIGWVKIVSGTVNFASLDFRSRISLSRDRDLSTAYMDIRGLTQDDTATYFCARQKFASRYSGDQGSYFDLWGRGTLIVVSS

SEQ ID NO: 3526 - protein, 128 aa, Artificial Sequence
  anti-HIV-1_HeavyChain
QAHLEQSGSGVKKPGASVRVSCWTSEDIFERTELIHWVRQAPGQGLEWIGWAKTVTGAVNFGSLDFRHRISLTRDRDLFTAHMDIRGLTQGDTATYFCARQKFESRYTGGQGWYFDLWGRGTHIVVSS

SEQ ID NO: 3527 - protein, 128 aa, Artificial Sequence
  anti-HIV-1_HeavyChain
QAHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3528 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFGSLDFRHRISLTRDRDLFTAHMDIRGLTQGDTATYFCARQKFESRYTGGQGWYFDLWGRGTHIVVSS

SEQ ID NO: 3529 - protein, 128 aa, Artificial Sequence
  anti-HIV-1_HeavyChain
QAHLEQSGSGVKKLGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3530 - protein, 128 aa, Artificial Sequence
  anti-HIV-1_HeavyChain
SHNLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3531 - protein, 128 aa, Artificial Sequence
  anti-HIV-1_HeavyChain
SHTWNNRGSAMKKPGASVRVSCWTSEDIFERTELIYWVRQAPGRGLEWIGWVKTVSGTVNFGSSDFRNRISLSRDRDLSTAHMDIRGLTQDDTATYFCARQKFASRYSGDQGSYFDLWGRGTLIIVSS

SEQ ID NO: 3532 - protein, 128 aa, Artificial Sequence
  anti-HIV-1_HeavyChain
SHTWNESGSAMKKPGASVRVSCWTSEDIFERTELIYWVRQAPGRGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3533 - protein, 128 aa, Artificial Sequence
  anti-HIV-1_HeavyChain
RHTWEQSGSGVKKPGASVRVSCWTSEDIFERTELIHWVRQAPGQGLEWIGWVKTVTGAVNYGSLNFRSRISLTRDRDLFTAHMDIRGLTQGDTATYFCARQKFESRYTGGQGWYFDLWGRGTHIVVSS

SEQ ID NO: 3534 - protein, 128 aa, Artificial Sequence
  anti-HIV-1_HeavyChain
QAHLEQSGSGVKKPGASVKVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3535 - protein, 128 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLSTAYMDIRGLTQDDTATYFCARQKFASRYSGDQGSYFDLWGRGTLIVVSS

SEQ ID NO: 3536 - protein, 128 aa, Artificial Sequence
  anti-HIV-1_HeavyChain
GHDLEQSGSGVKKPGASVRVSCWTSEDIFEGSELIHWVRQAPGQGLEWIGWVKTVTGAVNFGSAYFRHRISLSRDRDLSTAYMDIRGLTQDDTATYFCARQKFASRYSGDQGSYFDLWGRGTLIVVSS

SEQ ID NO: 3537 - protein, 128 aa, Artificial Sequence
  anti-HIV-1_HeavyChain
SHTWNNRGSAMKKPGASVRVSCWTSEDIFDTTELIYWVRQAPGQGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3538 - protein, 128 aa, Artificial Sequence
  anti-HIV-1_HeavyChain
RHTWEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFESRYTGGQGWYFDLWGRGTHIVVSS

SEQ ID NO: 3539 - protein, 128 aa, Artificial Sequence
  anti-HIV-1_HeavyChain
SHTWNNRGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3540 - protein, 128 aa, Artificial Sequence
  anti-HIV-1_HeavyChain
QSHLEQSGSAMKKPGASVRVSCLASEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3541 - protein, 128 aa, Artificial Sequence
  anti-HIV-1_HeavyChain
QSHLEQSGAAMKKPGASVRVSCWTSEDIFDTTELIYWVRQAPGQGLEWIGWVKIVSGTVNFASLDFRNRISLSRDRDLSTAHMDIRGLRQDDTATYFCARQKFESRYSGDQGSYFDLWGRGTLIIVSS

SEQ ID NO: 3542 - protein, 128 aa, Artificial Sequence
  anti-HIV-1_HeavyChain
RHTWEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFESRYTGGQGWYFDLWGRGTHIVVSS

SEQ ID NO: 3543 - protein, 128 aa, Artificial Sequence
  anti-HIV-1_HeavyChain
SHTWNESGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3544 - protein, 128 aa, Artificial Sequence
  anti-HIV-1_HeavyChain
RHTWNESGSGVKKPGASVRVSCWSSEDIFERTELIHWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3545 - protein, 128 aa, Artificial Sequence
  anti-HIV-1_HeavyChain
QSHLEQSGSEMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3546 - protein, 128 aa, Artificial Sequence
  anti-HIV-1_HeavyChain
RHTWEQSGSGVKKPGASVRVSCWTSEDIFERTELIHWVRQAPGQGLEWIGWVKTVTGTVNFGSLNFRQRVSLTRDRDLFTAHMDIRGLTQGDTATYFCARQKFESLYSDDQGSYFDLWGRGTLIIVSS

SEQ ID NO: 3547 - protein, 128 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSQIFRHRISLTRDRDLFTAHMDIRGLTQGDTATYFCARQKFESRYTGGQGWYFDLWGRGTHIVVSS

SEQ ID NO: 3548 - protein, 128 aa, Artificial Sequence
  anti-HIV-1_HeavyChain
SHTWNKSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3549 - protein, 128 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSQIFRHRISLTRDRDLFTAHMDIRGLTQGDTATYFCARQKFESRYTGGQGWYFDLWGRGPTLFVSS

SEQ ID NO: 3550 - protein, 128 aa, Artificial Sequence
  anti-HIV-1_HeavyChain
QAHLEQSASGVRRPGASVRVSCWTSEDIFERSELIYWVRQAPGRGLEWIGWIKTCSGAVNFGSVDFRDRVSLTRDRDLFTAHMDIRGLTQGDTATYFCARQKFESRYTGGQGWYFDLWGRGTHIVVSS

SEQ ID NO: 3551 - protein, 128 aa, Artificial Sequence
  anti-HIV-1_HeavyChain
SHTVEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3552 - protein, 128 aa, Artificial Sequence
  anti-HIV-1_HeavyChain
RHTWNKSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3553 - protein, 128 aa, Artificial Sequence
  anti-HIV-1_HeavyChain
QAHLEQSGSGVKKPGASVRVSCWTSEDIFERTELIHWVRQAPGQRLEWIGWVKTVTGAVNFGSPNFRHRVSLTRDRDLSTAYMDIRGLTQDDTATYFCARQKFASRYSGDQGSYFDLWGRGTLIVVSS

SEQ ID NO: 3554 - protein, 128 aa, Artificial Sequence
  anti-HIV-1_HeavyChain
SHDLEQSGSAMKKPGASVRVSCWTSEDIFDTTELIYWVRQAPGQGLEWIGWVKIVSGTVNFASLDFRNRISLSRDRDLSTAHMDIRGLRQDDTATYFCARQKFESRYSGDQGSYFDLWGRGTLIIVSS

SEQ ID NO: 3555 - protein, 128 aa, Artificial Sequence
  anti-HIV-1_HeavyChain
RHTWNESGSGVKKPGASVRVSCWSSEDIFERTELIHWVRQAPGQGLEWIGWVKTVTGAVNFGSLDFRHRISLTRDRDLFTAHMDIRGLTQGDTTTYFCARQKFESRYTGGQGWYFDLWGRGTHIVVSS

SEQ ID NO: 3556 - protein, 128 aa, Artificial Sequence
  anti-HIV-1_HeavyChain
RHTWEQVWSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3557 - protein, 128 aa, Artificial Sequence
  anti-HIV-1_HeavyChain
QSHLEQSGSAMKKPGASVTVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3558 - protein, 128 aa, Artificial Sequence
  anti-HIV-1_HeavyChain
RHDLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3559 - protein, 128 aa, Artificial Sequence
  anti-HIV-1_HeavyChain
VTTWNKSGSAMKKPGASVRVSCWTSEDIFDTTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3560 - protein, 128 aa, Artificial Sequence
  anti-HIV-1_HeavyChain
RHTWNNTGSGVKKPGASVRVSCLASEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3561 - protein, 128 aa, Artificial Sequence
  anti-HIV-1_HeavyChain
QSHLEQSGSAMKKPGASVRVSCLASEDIFERTELIYWVRQAPGRGPEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3562 - protein, 128 aa, Artificial Sequence
  anti-HIV-1_HeavyChain
RHTWNNTGSGVKKPGASVRVSCWTSDDIFERTELIHWVRQAPGQGLEWIGWVKTVSGTVNFASLDFRNRISLSRDRDLSTAYMDIRGLTQDDTATYFCARQKFASRYSGDQGSYFDLWGRGTLIVVSS

SEQ ID NO: 3563 - protein, 128 aa, Artificial Sequence
  anti-HIV-1_HeavyChain
GTPGNKSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3564 - protein, 128 aa, Artificial Sequence
  anti-HIV-1_HeavyChain
GTPGSESGSGVKRPGASVRVSCWTSEDIFETTELIHWVRQAPGQGLEWIGWVKTVSGAVNFGSLNFRHRVSLTRDRDLFTAHMDIRGLTQGDTATYFCARQKFESRYTGGQGWYFDLWGRGTHIVVSS

SEQ ID NO: 3565 - protein, 128 aa, Artificial Sequence
  anti-HIV-1_HeavyChain
VTPGTNLGLRMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3566 - protein, 128 aa, Artificial Sequence
  anti-HIV-1_HeavyChain
RHDLEQSGAGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3567 - protein, 128 aa, Artificial Sequence
  anti-HIV-1_HeavyChain
QVHLEQSGSGVKKPGASVRVSCWTSEDIFEKSELIHWVRQAPGQGLEWIGWVKTVTGAVNFGSSDFRQRVSLTPDRDLFTAHMDIRGLTQGDTATYFCARQKFESRYTGGQGWYFDLWGRGTHIVVSS

SEQ ID NO: 3568 - protein, 128 aa, Artificial Sequence
  anti-HIV-1_HeavyChain
GTTWEQSGSGVKKPGASVRVSCWTSEDIFEKSELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3569 - protein, 128 aa, Artificial Sequence
  anti-HIV-1_HeavyChain
SHDLEQSGSEWKKPGASVRVSCWTSEDIFDTTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3570 - protein, 128 aa, Artificial Sequence
  anti-HIV-1_HeavyChain
QSRPGNKSGSAMKKPGASVRVSCWTSEDIFERTELLWVRQAPGRGLEWIGWVKTVSGTVNFGSSDFRNRISLTRDRDLSTAHMDIRGLTQDDTATYFCARQKFESLYSDDQGSYFDLWGRGTLIIVSS

SEQ ID NO: 3571 - protein, 128 aa, Artificial Sequence
  anti-HIV-1_HeavyChain
GTTWSKSGSGVKKPGASVRVSCWTSEDIFERTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSS

SEQ ID NO: 3572 - protein, 129 aa, Artificial Sequence
  anti-HIV-1_HeavyChain
QAHLEQSGSGVKKPGASVRVSCWTSEDILRKKRVDSVGCDTAPGQGLEWIGWVKTVTGAVNFGSSDFRQRVSLTRDRDLFTAHMDIRGLTQDDTATYFCARQKFASRYSGDQGSYFDLWGRGTLIVVSS

SEQ ID NO: 3573 - protein, 129 aa, Artificial Sequence
  anti-HIV-1_HeavyChain
KAHLGNKSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3574 - protein, 128 aa, Artificial Sequence
  anti-HIV-1_HeavyChain
TTVGTILGRAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3575 - protein, 128 aa, Artificial Sequence
  anti-HIV-1_HeavyChain
QSHLEQSGSAMKKPGASVKVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3576 - protein, 129 aa, Artificial Sequence
  anti-HIV-1_HeavyChain
QSHLEQVWVCQSKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSS

SEQ ID NO: 3577 - protein, 128 aa, Artificial Sequence
  anti-HIV-1_HeavyChain
RHTVEQSGSGVKKPGASVRVSCWSSEDIFERTELIHWVRQAPGQGLEWMGWVKTVTGAVNFGSLDFRHRISLTRDRDLFTAHMDIRGLTQGDTATYFCARQKFESRYTGGQGWYFDLWGRGTHIVVSS

SEQ ID NO: 3578 - protein, 128 aa, Artificial Sequence
  anti-HIV-1_HeavyChain
QSHLEQSGSAMKKPGASVRVSCSAREDIFDTTELIYWVRQAPGQGLEWIGWVKIVCGTVNFASLDFRNRISLSRDRDLSTAHMDIRGLTQDDTATYFCARQKFASRYSGDQGSYFDLWGRGTLIIVSS

SEQ ID NO: 3579 - protein, 129 aa, Artificial Sequence
  anti-HIV-1_HeavyChain
EVQRGGRVVGRDVKKPGASVRVSCWTSEDIFHTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3580 - protein, 128 aa, Artificial Sequence
  anti-HIV-1_HeavyChain
GTTWNESGSGVKKPGASVRVPCWSSEDIFERTELIHRVRQAPGQGLEWIGWVKTVTGAVNFGSPNFRHRISLTRDRDLFTAHMDIRGLTQGDTATYFCARQKFESRYTGGQGWYFDLWGRGTHIVVSS

SEQ ID NO: 3581 - protein, 128 aa, Artificial Sequence
  anti-HIV-1_HeavyChain
RSNWVQSGADVKKPGASVKSSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3582 - protein, 128 aa, Artificial Sequence
  anti-HIV-1_HeavyChain
PVQLVQSGAEVKKPGASVKVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3583 - protein, 133 aa, Artificial Sequence
  anti-HIV-1_HeavyChain
REYLEQSGGGVKKLGASVRVSCRASEDLFGDEAIYDDELIHWLRQVPGQRPEWMGWIRPKTGARNQARQFQPRINLSRDRALNTAYLDLSSLTSADSATYFCARQTFKPDFYFADQGWSFNLWGRGARVIVSS

SEQ ID NO: 3584 - protein, 133 aa, Artificial Sequence
  anti-HIV-1_HeavyChain
QVQLVQSGTEVKKPGASLRVSCRASEDLFGDKIIYDDEVIHWLRQLPGQRPEWMGWIRPKSGARNQARQFQPRISLTRDRALSTAYLDLNSLTSADSGTYFCARQTFKPDFYFADQGWSFNLWGRGAHFIVSS

SEQ ID NO: 3585 - protein, 133 aa, Artificial Sequence
  anti-HIV-1_HeavyChain
QAHLEQSGSGVKKPGASVRVSCRASEDLFGDEIIYDDEVIHWLRQVPGQRPEWMGWIRPKTGARNQARQFQPRISLTRDRALSTAYLDLNSLTSADSGTYFCARQTFKPDFYFADQGWSFNLWGRGAHFIVSS

SEQ ID NO: 3586 - protein, 133 aa, Artificial Sequence
  anti-HIV-1_HeavyChain
GNIWSESGGGVKKPGASVRVSCRASEDLFGDEIIYDDEVIHWLRQVPGQRPEWMGWIRPKNGGRNQARQFQPRISLTRDRALNTAYLDLNSLTSADSGTYFCARQTFKPDFYFADQGWSFNLWGRGARVIVSS

SEQ ID NO: 3587 - protein, 133 aa, Artificial Sequence
  anti-HIV-1_HeavyChain
QVQLVQSGAEVKKPGASLRVPCRASEDLFGDEIIYDDEVIHWLRQVPGQRPEWMGWIRPKTGARNQARQFQPRISLTRDRALSTAYLDLNSLTSADSGTYFCARQTFKPDFYFADQGWSFNLWGRGAHFIVSS

SEQ ID NO: 3588 - protein, 130 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASRSA

SEQ ID NO: 3589 - protein, 131 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTRST

SEQ ID NO: 3590 - protein, 138 aa, Artificial Sequence
  anti-HIV-1_HeavyChain
QVQLVQSGAEVKKPGASVTVSCKASRYTFINYYIHWVRQAPGQGLEWIGWVKPVSGAVNFGSPNFRHRVSLTRDRDLFTAHMDIRGLTQGDTATYFCARQKFARGDQGWFFDLWGRGTLIVVSSASTKGPSVFPHDLR

SEQ ID NO: 3591 - protein, 138 aa, Artificial Sequence
  anti-HIV-1_HeavyChain
QVQLVQSGAEVKKPGASVKVSCKASGYTITRHYMHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3592 - protein, 136 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSPNFRHRVSLTRDRDLFTAHMDIRGLTQGDTATYFCARQKYYAGGQGWYFDLWGRGTLIVVSSASTKGPSDDLR

SEQ ID NO: 3593 - protein, 137 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVYDLR

SEQ ID NO: 3594 - protein, 139 aa, Artificial Sequence
  anti-HIV-1_HeavyChain
QVQLVQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3595 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPTIYV

SEQ ID NO: 3596 - protein, 139 aa, Artificial Sequence
  anti-HIV-1_HeavyChain
QVQLEQSGSGVKKLGASVRVSCWTSEDIFEDELIHWVRQAPGQGLEWIGWVKAVSGAVNYGSLDFRHRVSLTRDRDLFTAHMDIRGLTQDDTATYFCARQKFARGDQGWFFDLWGRGTLIVVSSGLHQGPIGLPPRLSR

SEQ ID NO: 3597 - protein, 139 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASPRAHRSSPTICV

SEQ ID NO: 3598 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 3599 - protein, 138 aa, Artificial Sequence
  anti-HIV-1_HeavyChain
QVHLVQSGAEVKRPGASVKVSCKASGYTFTDYFIHWVRQAPGQGLEWIGWVKTVSGAVNFGSLNFRHRVSLTRDRDLFTAHMDIRGLTQGDTATYFCARQKFARGDQGWFFDLWGRGTLIVVSSASTKGPSVFPHDLR

SEQ ID NO: 3600 - protein, 140 aa, Artificial Sequence
  anti-HIV-1_HeavyChain
QVQLVQSGAEVKKPGASVKVSCKASGYIFTGSYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSSASTKGPSVFPHDLR

SEQ ID NO: 3601 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3602 - protein, 139 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3603 - protein, 140 aa, Artificial Sequence
  anti-HIV-1_HeavyChain
QVQLVQSGAEVKKPGASVKVSCKASGYTFTGYYIHWVRQAPGQGLEWMGWINPNSGATNYAQKFQGRLTIARDTSISTAYMDLRNLRFDDTAVYFCARKTAGDVSGDNRGYFFDLWGRGSRVIVSSASTKGPSVFPHDLR

SEQ ID NO: 3604 - protein, 138 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFHDLR

SEQ ID NO: 3605 - protein, 138 aa, Artificial Sequence
  anti-HIV-1_HeavyChain
QATLEQSGSGVKKPGASVRVSCWSSEDIFKTELIHWVRQAPGQGLEWIGWVKAVSGAVNYGSLDFRHRVSLTRDRDLSTAHMDIRGLTQDDTATHFCARQKFARGDQGWFFDLWGRGTLIVVSSASTKGPSVFPTIYV

SEQ ID NO: 3606 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPTICV

SEQ ID NO: 3607 - protein, 138 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWIFDLWGRGTLIAVSSASPRAHRSSPRSA

SEQ ID NO: 3608 - protein, 138 aa, Artificial Sequence
  anti-HIV-1_HeavyChain
QAHLEQSGSGVKKPGASVRVSCWTSEDIFKSELIHWVRQAPGQGLEWIGWVKTVTGAVNFGSSDFRQRVSLTRDRDLFTAHMDIRGLTQGDTATYFCARQKFERGGQGWIFDLWGRGTLIAVSSASTKGPSVFPTICV

SEQ ID NO: 3609 - protein, 138 aa, Artificial Sequence
  anti-HIV-1_HeavyChain
QAHLEQSGPGVKKLGASVRVSCWTSEDIFERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSSASTKAHRSSPRST

SEQ ID NO: 3610 - protein, 140 aa, Artificial Sequence
  anti-HIV-1_HeavyChain
QVQLVQSGAEMKKPGASVKLSCMTSGYVFTDFYIHWVRQAPGQGLEWMGWINPGTGGTISAPRFLGRVTLTRDTSISAAYIEINRVTIDDTATYFCARQKFASRYSGDQGSYFDLWGRGTLIVVSSASTKGPLGLPPRSA

SEQ ID NO: 3611 - protein, 138 aa, Artificial Sequence
  anti-HIV-1_HeavyChain
QAHLEQSGSGVKKPGASVRVSCWTPEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASPRAHRSSPRSA

SEQ ID NO: 3612 - protein, 138 aa, Artificial Sequence
  anti-HIV-1_HeavyChain
QAHLEQSGSGVKKPGASVRVSCWTSEDIFERTELIHWVRQAPGQGLEWIGWVKPVTGAVNLAPNFRHRVSLTRDRDLFTAHMDIRGLTQGDTATYFCARQKFERGGQGWYFDLWGRGTLIVVSSASTKGPSVFPHDLR

SEQ ID NO: 3613 - protein, 139 aa, Artificial Sequence
  anti-HIV-1_HeavyChain
QAHLEQSGSGVKKPGASVRVSCWSSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPHDLR

SEQ ID NO: 3614 - protein, 138 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSPNFRQRVSLTRDRDLFTAHMDIRGLTQGDTATYFCARQKFYAGGQGWYFDLWGRGTLIVVSSASTKAHRSSPRST

SEQ ID NO: 3615 - protein, 138 aa, Artificial Sequence
  anti-HIV-1_HeavyChain
QAHLEQSGSGVKKPGASVRVSCWTSEDIFKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPTICV

SEQ ID NO: 3616 - protein, 138 aa, Artificial Sequence
  anti-HIV-1_HeavyChain
QAHLEQSGSGVKKLGASVRVSCWTSEDIFKTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPHDLR

SEQ ID NO: 3617 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPTIYV

SEQ ID NO: 3618 - protein, 139 aa, Artificial Sequence
  anti-HIV-1_HeavyChain
QAHLEQSGSGVKKPGTSVRVSCWTSEDIFERTELIHWVRQAPGQGLEWIGWVKTVTGAVNFGSPNFRHRVSLTRDRDLFTAHMDIRGLTQGDTATYFCARQKFARGDQGWFFDLWGRGTLIVVSSASTKGPSVFPTICV

SEQ ID NO: 3619 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPQIYV

SEQ ID NO: 3620 - protein, 139 aa, Artificial Sequence
  anti-HIV-1_HeavyChain
QAHLEQSGSGVKKPGASVRVSCWTSEDIFEKSELIHWVRQTPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPTIYV

SEQ ID NO: 3621 - protein, 139 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMGIRGLTQGDTATYFCARQKFERGGQGWIFDLWGRGTLIAVSSASTKGPSVFPTIYV

SEQ ID NO: 3622 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPHDLR

SEQ ID NO: 3623 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWIFDLWGRGTLIAVSSASTKGPSVFPRSAV

SEQ ID NO: 3624 - protein, 139 aa, Artificial Sequence
  anti-HIV-1_HeavyChain
QAHLEQSGSGVKKPGASVRVSCWTSEDIFERTELIHWVRQAPGQGLEWIGWMKIVSGAVNFGSPNFRQRVSLTRDRDLFTAHMDIRGLTQGDTATYFCARQKFERGGQGWIFDLWGRGTLIAVSSASTKGPSVFPHDLR

SEQ ID NO: 3625 - protein, 139 aa, Artificial Sequence
  anti-HIV-1_HeavyChain
QAHLEQSGSGVKKPGASVRVSCWTSEDISEGSELIHWVRQAPGQGLEWIGWVKTVTGAVNFGSAYFRHRVSLTRDRDLFTAHMDIRGLTQGDTATYFCARQKFYKGGQGWYFDLWGRGTLIVVSSASTKGPSVFPTICV

SEQ ID NO: 3626 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNYGSLDFRHRVSLTRDRDLSTAHMDIRGLTQDDTATYFCARQKFARGDQGWFFDLWGRGTLIVVSSASTKGPSVFPHDLR

SEQ ID NO: 3627 - protein, 139 aa, Artificial Sequence
  anti-HIV-1_HeavyChain
QAHLEQSGSGVKKPGASVRVSCWSSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVFPTIYV

SEQ ID NO: 3628 - protein, 139 aa, Artificial Sequence
  anti-HIV-1_HeavyChain
QAHLEQSGSGVKRPGASVRVSCWTSEDIFETTELIHWVRQAPGQGLEWIGWVKTVSGAVNFGSLNFRHRVSLTRDRDLFTAHMDIRGLTQGDTATYFCARQKFARGDQGWFFDLWGRGTLIVVSSASTKGPSVFPTICV

SEQ ID NO: 3629 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNLGSPNFRHRVSLTRDRDLFTAHMDIRGLTQGDTATYFCARQKFERGGQGWYFDLWGRGTLIVVSSASTKGPSVFPHDLR

SEQ ID NO: 3630 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFERGGQGWIFDLWGRGTLIAVSSASTKGPSVFPTICV

SEQ ID NO: 3631 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLV

SEQ ID NO: 3632 - protein, 139 aa, Artificial Sequence
  anti-HIV-1_HeavyChain
QAHLEQSGSGVKKPGASVRVSCWSSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPTIYV

SEQ ID NO: 3633 - protein, 140 aa, Artificial Sequence
  anti-HIV-1_HeavyChain
QVHLEQSGSGVKKPGAPVRVSCWSSEDIFERTELIHWVRQAPGQGLEWIGWVKTVTGAVNFGSLDFRHRISLTRDRDLFTAHMDIRGLTQGDTATYFCARQKFYAGGQGWYFDLWGRGTLIVVSSASTKAHSVLPPRSRV

SEQ ID NO: 3634 - protein, 139 aa, Artificial Sequence
  anti-HIV-1_HeavyChain
QAHLEQSGSGVKKPGALVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 3635 - protein, 138 aa, Artificial Sequence
  anti-HIV-1_HeavyChain
QVQLVQSGAEVKKPGASVKVSCQVSGYTLTELSMHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3636 - protein, 138 aa, Artificial Sequence
  anti-HIV-1_HeavyChain
QAHLEQSGSGVKKPGASVRVSCWTSEDIFKTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVFPHDLR

SEQ ID NO: 3637 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPTICV

SEQ ID NO: 3638 - protein, 139 aa, Artificial Sequence
  anti-HIV-1_HeavyChain
QAHLEQSGSGVKKPGASVRVSCWTSEDIFEKSELIHWVRQAPGQGLEWVGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 3639 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFERGGQGWYFDLWGRGTLIVVSSASTKGPSVFPTICV

SEQ ID NO: 3640 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPQICV

SEQ ID NO: 3641 - protein, 138 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGHQISDRVSLTPDRDLFTAHMDIRGLTQGDTATYFCARQKFYAGGQGWYFDLWGRGTLIVVSSASTKGPSVFPTICV

SEQ ID NO: 3642 - protein, 139 aa, Artificial Sequence
  anti-HIV-1_HeavyChain
QAHLEQSGSGVKKPGASVRVSCWTSEDIFEKSELIHWVRRAPGQGLEWIGWVKTVTGAVNFGSSDFRQRVSLTRDRDLFTAHMDIRGLTQGDTATYFCARQKFYAGGQGWYFDLWGRGTLIVVSSASTKAHRSSPTICV

SEQ ID NO: 3643 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSAPTKGPSVFPTICV

SEQ ID NO: 3644 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPQIYV

SEQ ID NO: 3645 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRGRDLFTAHMDIRGLTQGDTATYFCARQKFYAGGQGWYFDLWGRGTLIVVSSASTKGPSVFPTICV

SEQ ID NO: 3646 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLSTAHMDIRGLTQDDTATYFCARQKFARGDQGWFFDLWGRGTLIVVSSASTKGPSVFPHDHV

SEQ ID NO: 3647 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFYAGGQGWYFDLWGRGTLIVVSSASTKGPSVFPQICV

SEQ ID NO: 3648 - protein, 139 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIVVSSASTKGPSVFPTICV

SEQ ID NO: 3649 - protein, 139 aa, Artificial Sequence
  anti-HIV-1_HeavyChain
QAHLEQSGSGVKKPGASVRVSCWASEDIFERTELIHWVRQAPGQGLEWIGWVKTVTGAVNFGSPNFRHRVSLTRDRDLFTAHMDIRGLTQGDTATYFCARQKFYAGGQGWYFDLWGRGTLIVVSSASTKGPSVFPHDLL

SEQ ID NO: 3650 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFERGGQGWIFDLWGRGTLIAVSSASTKGPSVFPHDLR

SEQ ID NO: 3651 - protein, 139 aa, Artificial Sequence
  anti-HIV-1_HeavyChain
QAHLEQSGSGVKKPGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPHDLR

SEQ ID NO: 3652 - protein, 139 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSPNFRHRVSLTRDRDLFTAHMDIRGLTQGDTATYFCARQKYYAGGQGWYFDLWGRGTLIVVSSASTKGPSVFPTICR

SEQ ID NO: 3653 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFERGGQGWYFDLWGRGTLIVVSSASTKGPSVFPHDLR

SEQ ID NO: 3654 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPTIYV

SEQ ID NO: 3655 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYKGGQGWYFDLWGRGTLIVVSSASTKGPSVFPHDLR

SEQ ID NO: 3656 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGTVNFGSLNFRQRVSLTRDRDLFTAHMDIRGLTQDDTATYFCARQKFARGDQGWFFDLWGRGTLIVVSSASTKGPSVFPHDLR

SEQ ID NO: 3657 - protein, 139 aa, Artificial Sequence
  anti-HIV-1_HeavyChain
QAHLEQSGSGVKKPGASVRVSCWPSEDIFEKSELIHWVRQAPGQGLEWIGWVKTVTGAVNFGSSDFRQRVSLTRDRDLFTAHMDIRGLTQGDTATYFCARQKFERGGQGWIFDLWGRGTLIAVSSASTKGPSVFPHDLR

SEQ ID NO: 3658 - protein, 139 aa, Artificial Sequence
  anti-HIV-1_HeavyChain
QAHLEQSGSGVKRPGASVRVSCWTSEDIFETTELIHWVRQAPGQGLEWIGWVKTVSGAVNFGSLNFRHRVSLTRDRDLFTAHMDIRGLTQGDTATYFCARQKFARGDQGWFFDLWGRGTLIVVSSASTKGPSVFPHDLR

SEQ ID NO: 3659 - protein, 139 aa, Artificial Sequence
  anti-HIV-1_HeavyChain
QAHLEQSGSGVEKPGASVRVSCWTSEDIFERSELIHWVRQAPGQGLEWIGWVKTVTGAVNFGSPNFRHRVSLTRDRDLFTAHMDIRGLTQGDTATYFCARQKYYAGGQGWYFDLWGRGTLIVVSSASTKGPSVFPHDLR

SEQ ID NO: 3660 - protein, 139 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVFPHDLR

SEQ ID NO: 3661 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRNLFTAHMDIRGLTQGDTATYFCARQKFERGGQGWYFDLWGRGTLIVVSSASTKGPSVFPHDLR

SEQ ID NO: 3662 - protein, 139 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFYAGGQGWYFDLWGRGTLIVVSSASTKGPSVFPHDLR

SEQ ID NO: 3663 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNYGSLNFRSRISLTRDRDLFTAHMDIRGLTQGDTATYFCARQKFERGGQGWIFDLWGRGTLIAVSSASTKGPSVFPHDLR

SEQ ID NO: 3664 - protein, 139 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQGDTATYFCARQKFYAGGQGWYFDLWGRGTLIVVSSASTKGPSVFPHDLR

SEQ ID NO: 3665 - protein, 139 aa, Artificial Sequence
  anti-HIV-1_HeavyChain
QAHLEQSGSGVKKPGASVRVSCWTSEDIFERIELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3666 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRQRVSLTRDRDLFTAHMDIRGLTQGDTATYFCARQKFYAGGQGWYFDLWGRGTLIVVSSASTKGPSVFPHDLR

SEQ ID NO: 3667 - protein, 139 aa, Artificial Sequence
  anti-HIV-1_HeavyChain
QAHLEQSGSGVKKPGASVRVSCWSSEDIFERAELIHWVRQAPGQGLEWIGWVKTVTGAVNFGSPNFRQRVSLTRDRDLFTAHMDIRGLTQGDTATYFCARQKFERGGQGWIFDLWGRGTLIAVSSASTKGPSVFPHDLR

SEQ ID NO: 3668 - protein, 139 aa, Artificial Sequence
  anti-HIV-1_HeavyChain
QAHLEQSGSGVKKPGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPHDLR

SEQ ID NO: 3669 - protein, 139 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFERGGQGWYFDLWGRGTLIVVSSASTKGPSVFPHDLR

SEQ ID NO: 3670 - protein, 139 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFYAGGQGWYFDLWGRGTLIVVSSASTKGPSVFPHDLR

SEQ ID NO: 3671 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQDDTAIYFCARQKFARGDQGWFFDLWGRGTLIVVSSASTKGPSVFPHDLR

SEQ ID NO: 3672 - protein, 139 aa, Artificial Sequence
  anti-HIV-1_HeavyChain
QAHLEQSGSGVKGPGASVRVSCWTSEDIFETTELIHWVRQAPGQGLEWIGWVKTVSGAVNFGSLNFRHRVSLTRDRDLFTAHMDIRGLTQGDTATYFCARQKFARGDQGWFFDLWGRGTLIVVSSASTKGPSVFPHDLR

SEQ ID NO: 3673 - protein, 139 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVPLTRDRDLFTAHMDIRGLTQGDTATYFCARQKFYKGGQGWYFDLWGRGTLIVVSSASTKGPSVFPHDLR

SEQ ID NO: 3674 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3675 - protein, 139 aa, Artificial Sequence
  anti-HIV-1_HeavyChain
QAHLEQSGSGVKKVGASVRVSCWTSEDIFERTELIHWVRQAPGQGLEWIGWVKAVSGAVNYGSLDFRHRVSLTRDRDLFTAHMDIRGLTQGDTATYFCARQKFYAGGQGWYFDLWGRGTLIVVSSASTKGPSVFPHDLR

SEQ ID NO: 3676 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQDDTATYFCARQKFARGDQGWFFDLWGRGTLIVVSSASTKGPSVFPHDLR

SEQ ID NO: 3677 - protein, 139 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFARGDQGWFFDLWGRGTLIVVSSASTKGPSVFPHDLR

SEQ ID NO: 3678 - protein, 139 aa, Artificial Sequence
  anti-HIV-1_HeavyChain
QAHLEQSESGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPHDLR

SEQ ID NO: 3679 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPTTLR

SEQ ID NO: 3680 - protein, 139 aa, Artificial Sequence
  anti-HIV-1_HeavyChain
QAHLEQSGSGVKKVGASVRVSCWTSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 3681 - protein, 140 aa, Artificial Sequence
  anti-HIV-1_HeavyChain
QARPGANRGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVFPHDLR

SEQ ID NO: 3682 - protein, 139 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSPNFRHRVSLTRDRDLFTAHMDIRGLTQGDTATYFCARQKYYAGGQGWYFDLWGRGTLIVVSSASTKGPSVFPHDLR

SEQ ID NO: 3683 - protein, 139 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLFTAHMDIRGLTQGDTATYFCARQKFYKGGQGWYFDLWGRGTLIVVSSASTKGPSVFPHDLR

SEQ ID NO: 3684 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVLPPRSA

SEQ ID NO: 3685 - protein, 139 aa, Artificial Sequence
  anti-HIV-1_HeavyChain
QAHLEQSGSGMKKPGASVRVSCWSSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 3686 - protein, 139 aa, Artificial Sequence
  anti-HIV-1_HeavyChain
QAHLEQSGSGVKEPGTSVRVSCWTSEDIFERTELIHWVRQAPGQGLEWIGWVKTVTGAVNFGSPNFRHRVSLTRDRDLFTAHMDIRGLTQGDTATYFCARQKFERGGQGWIFDLWGRGTLIAVSSASTKGPSVFPQTLR

SEQ ID NO: 3687 - protein, 139 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRHRVSLTRDRDLSTAHMDIRGLTQDDTATYFCARQKFARGDQGWFFDLWGRGTLIVVSSASTKGPSVFPHDLR

SEQ ID NO: 3688 - protein, 139 aa, Artificial Sequence
  anti-HIV-1_HeavyChain
QAHLEQSGSGVKKPGASVRVSCWTSEDIFETTELIHWVRQAPGQGLEWIGWVKTVSGAVNFGSLNFRHRVSLTRDRDLFTAHMDIRGLTQGDTATYFCARQKFARGDQGWFFDLWGRGTLIVVSSASTKGPSVFPHDLR

SEQ ID NO: 3689 - protein, 139 aa, Artificial Sequence
  anti-HIV-1_HeavyChain
QAHLEQSGSGVKKVGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3690 - protein, 139 aa, Artificial Sequence
  anti-HIV-1_HeavyChain
QAHLEQSGAGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3691 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNYGSLNFRSRISLTRDRDLFTAHMDIRGLTEGDTATYFCARQKFYAGGQGWYFDLWGRGTLIVVSSASTKGPSVFPHDLR

SEQ ID NO: 3692 - protein, 139 aa, Artificial Sequence
  anti-HIV-1_HeavyChain
QAHLEQSGSGVKKPGASVRVSCLASEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3693 - protein, 139 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFERGGQGWIFDLWGRGTLIAVSSASTKGPSVFPHDLR

SEQ ID NO: 3694 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRQRVSLTRDRDLFTAHMDIRGLTQGDTATYFCARQKFERGGQGWYFDLWGRGTLIVVSSASTKGPSVFPHDLR

SEQ ID NO: 3695 - protein, 139 aa, Artificial Sequence
  anti-HIV-1_HeavyChain
QVHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3696 - protein, 139 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRQRVSLTRDRDLFTAHMDIRGLTQGDTATYLCARQKFERGGQGWIFDLWGRGTLIAVSSASTKGPSVFPHDLR

SEQ ID NO: 3697 - protein, 139 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRHRVSLTRDRDLFTAHMDIRGLTQGDTATYFCARQKFYKGGQGWYFDLWGRGTLIVVSSASTKGPSVFPHDLR

SEQ ID NO: 3698 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTPDRDLFTAHMDIRGLTQGDTATYFCARQKFYAGGQGWYFDLWGRGTLIVVSSASTKGSSVFPHDLR

SEQ ID NO: 3699 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTPDRDLFTAHMDIRGLTQGDTATYFCARQKFYAGGQGWYFDLWGRGTLIVVSSASTKGPSVFPHDLR

SEQ ID NO: 3700 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPHDLR

SEQ ID NO: 3701 - protein, 139 aa, Artificial Sequence
  anti-HIV-1_HeavyChain
QVHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPHRST

SEQ ID NO: 3702 - protein, 140 aa, Artificial Sequence
  anti-HIV-1_HeavyChain
QVYMEQAGAGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSASTKGPSVFTIYV

SEQ ID NO: 3703 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPHDPA

SEQ ID NO: 3704 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVLPPRST

SEQ ID NO: 3705 - protein, 139 aa, Artificial Sequence
  anti-HIV-1_HeavyChain
QAHLEQSGSGVKKPGASVRVSCWSSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPHDLR

SEQ ID NO: 3706 - protein, 139 aa, Artificial Sequence
  anti-HIV-1_HeavyChain
QAHLEQSGSEWKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPHDLR

SEQ ID NO: 3707 - protein, 139 aa, Artificial Sequence
  anti-HIV-1_HeavyChain
QAHLEQSGSEVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 3708 - protein, 139 aa, Artificial Sequence
  anti-HIV-1_HeavyChain
QAHLEQSGSGVKKLGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3709 - protein, 139 aa, Artificial Sequence
  anti-HIV-1_HeavyChain
QAHLEQSGSGVKKPGASVRVSCWTSEDILRKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 3710 - protein, 139 aa, Artificial Sequence
  anti-HIV-1_HeavyChain
QAHLEQSASGVKRPGASVRVSCLASEDIFERSELIYWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVFPHDLR

SEQ ID NO: 3711 - protein, 139 aa, Artificial Sequence
  anti-HIV-1_HeavyChain
QAHLEQSGSGVKRPGASVRVSCWTSEDIFETTELIHWVRQAPGQGLEWIGWVKTVTGAVNFGSAYFRHRVSLTRDRDLFTAHMDIRGLTQGDTATYFCARQKFYKGGQGWYFDLWGRGTLIVVSSASTKGPSVFPHDLR

SEQ ID NO: 3712 - protein, 139 aa, Artificial Sequence
  anti-HIV-1_HeavyChain
QAHLEQSASGVKRPGASVRVSCWTSEDIFERSELIYWVRQAPGQGLEWIGWVKTVSGAVNFGSTDFRHRVSLTRDRDLFTAHMDIRGLTQGDTATYFCARQKFERGGQGWYFDLWGRGTLIVVSSASTKGPSVFPHDLR

SEQ ID NO: 3713 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSGLPPRSA

SEQ ID NO: 3714 - protein, 139 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQGDTATYFCARQKFERGGQGWIFDLWGRGTLIAVSSASTKGPSVFPLRSA

SEQ ID NO: 3715 - protein, 141 aa, Artificial Sequence
  anti-HIV-1_HeavyChain
QVQMEQAGAGMKKPGASMTVSCKTADEDIFDAAYMHWVRQAPGQTFEWLGWMKPVTGAVNYARQFQGRASFYRTRELGIAYMDLRDLKFDDTAVYFCARKTKGDVSGDDRGFFFDLWGRGTRVIVSSASTKGPSVFPHDLR

SEQ ID NO: 3716 - protein, 139 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFYKGGQGWYFDLWGRGTLIVVSSASTKGPSVFPQICR

SEQ ID NO: 3717 - protein, 138 aa, Artificial Sequence
  anti-HIV-1_HeavyChain
QAHLEQSGAGVKKPGASVRVSCWTSEDIFEKSELIHWVRQAPGQGLEWIGWVKTVTGAVNLVHQISDRVSLTRDRDLSTAHMDIRGLTQDDTATYFCARQKFARGDQGWFFDLWGRGTLIVVSSASTKGPSVFPHDLR

SEQ ID NO: 3718 - protein, 140 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSGLPPRLCV

SEQ ID NO: 3719 - protein, 139 aa, Artificial Sequence
  anti-HIV-1_HeavyChain
QARLEQSGSGVKKPGASVRVSCWTSEDIFEGSELIHWVRQAPGQGLEWIGWVKTVTGAVNFGSAYFRHRVSLTRDRDLFTAHMDIRGLTQGDTATYFCARQKFARGDQGWFFDLWGRGTLIVVSSASTKGPSVFPHDSA

SEQ ID NO: 3720 - protein, 138 aa, Artificial Sequence
  anti-HIV-1_HeavyChain
QVQLVQSGAEVKKPGSSVKVSCKVSGGVFTSYAVTWVRQAPGQGLEWIGWVKAVSGAVNYGSLDFRHRVSLTRDRDLFTAHMDIRGLTQDDTAIYFCARQKFARGDQGWFFDLWGRGTLIVVSSASTKGPSVFPHDLR

SEQ ID NO: 3721 - protein, 139 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRQRVSLTRDRDLFTAHMDIRGLTQGDTATYFCARQKFERGGQGWIFDLWGRGTLIAVSSASTKGPSVFPHDLR

SEQ ID NO: 3722 - protein, 139 aa, Artificial Sequence
  anti-HIV-1_HeavyChain
QSHLEQSGSAMKKPGASVTVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSDDLR

SEQ ID NO: 3723 - protein, 138 aa, Artificial Sequence
  anti-HIV-1_HeavyChain
QVQLVQSGAEVKKPGASVKVSCKSSGYSFTRFDITWVRQAPGQGLEWIGWVKTVSGAVNFGSLNFRHRVSLTRDRDLFTAHMDIRGLTQGDTATYFCARQKFARGDQGWFFDLWGRGTLIVVSSASTKGPSVFPHDLR

SEQ ID NO: 3724 - protein, 140 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPIGLPPRLCV

SEQ ID NO: 3725 - protein, 139 aa, Artificial Sequence
  anti-HIV-1_HeavyChain
QAHLEQSGAGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3726 - protein, 140 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSGPSPEICV

SEQ ID NO: 3727 - protein, 139 aa, Artificial Sequence
  anti-HIV-1_HeavyChain
QAHLEQSGAGVKRPGASVRVSCWTSEDIFETTELIHWVRQAPGQGLEWIGWVKTVSGAVNFGSLNFRHRVSLTRDRDLFTAHMDIRGLTQGDTATYFCARQKFARGDQGWFFDLWGRGTLIVVSSASTKGPSVFPHDLR

SEQ ID NO: 3728 - protein, 139 aa, Artificial Sequence
  anti-HIV-1_HeavyChain
RAHLEQSGSGVKKLGASVRVSCWTSEDIFERTELIHWVRQAPGQGLEWIGWVKAVSGAANYGSPNFRQRVSLTRDRDLFTAHMDIRGLTQGDTATYFCARQKFERGGQGWIFDLWGRGTLIAVSSASTKGPSVFPHDLR

SEQ ID NO: 3729 - protein, 139 aa, Artificial Sequence
  anti-HIV-1_HeavyChain
QVHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSSASTKGPSVFPHDLR

SEQ ID NO: 3730 - protein, 139 aa, Artificial Sequence
  anti-HIV-1_HeavyChain
RAHLEQSGSGVKKPGASVRVSCWTSEDIFERTELIHWVRQAPGQGLEWIGWVKIVSGAVNFGSPNFRQRASLTRDRDLFTAHMDIRGLTQGDTATYFCARQKFERGGQGWIFDLWGRGTLIAVSSASTKGPSVFPTIYV

SEQ ID NO: 3731 - protein, 138 aa, Artificial Sequence
  anti-HIV-1_HeavyChain
QVQLVQSEAEVKKPGASVKISCATSGYAFTLYYLHWVRQAPGQGLEWIGWVKTVTGAVNFGSAYFRHRVSLTRDRDLFTAHMDIRGLTQGDTATYFCARQKFYKGGQGWYFDLWGRGTLIVVSSASTKGPSVFPHDLR

SEQ ID NO: 3732 - protein, 140 aa, Artificial Sequence
  anti-HIV-1_HeavyChain
QAHPEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSGLPPRLCV

SEQ ID NO: 3733 - protein, 139 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSSASTKGPSVFPPRST

SEQ ID NO: 3734 - protein, 139 aa, Artificial Sequence
  anti-HIV-1_HeavyChain
QAHLEQSGSGVKRPGASVRVSCWTSEDIFEKSELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3735 - protein, 139 aa, Artificial Sequence
  anti-HIV-1_HeavyChain
GAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 3736 - protein, 139 aa, Artificial Sequence
  anti-HIV-1_HeavyChain
RHDLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVFPHDLR

SEQ ID NO: 3737 - protein, 140 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVTIYV

SEQ ID NO: 3738 - protein, 138 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASPGPIGPSPRSA

SEQ ID NO: 3739 - protein, 139 aa, Artificial Sequence
  anti-HIV-1_HeavyChain
QAHLEQSASGVKRPGASVRVSCWTSEDIFERTELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPHDLR

SEQ ID NO: 3740 - protein, 139 aa, Artificial Sequence
  anti-HIV-1_HeavyChain
QVQLVQSGAEVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPTIYV

SEQ ID NO: 3741 - protein, 139 aa, Artificial Sequence
  anti-HIV-1_HeavyChain
QAHLEQSGSGVKKPGASVRVSCWTSEDIFERTELIHWVRQAPGQGLERIGWVKTVTGAVNFGSPNFRHRVSLTRDRDLFTAHMDIRGLTQGDTATYFCARQKFERGGQGWYFDLWGRGTLIVVSSASTKGPSVFPTICV

SEQ ID NO: 3742 - protein, 140 aa, Artificial Sequence
  anti-HIV-1_HeavyChain
QSHLEQSGSAMKKPGASVRVSCWTSEDIFDTTELIHWVRQAPGQGLEWIGWVKTVSGAVNFGSLNFRHRVSLTRDRDLFTAHMDIRGLTQGDTATYFCARQKFARGDQGWFFDLWGRGTLIVVSSASTNGPIGPSPTDLR

SEQ ID NO: 3743 - protein, 139 aa, Artificial Sequence
  anti-HIV-1_HeavyChain
QAHLEQSGSGVKKLGASVRVSCWTSEDIFERTELIQWVRQAPGQGLEWMGWVKAVSGAVNYGSLDFRHRVSLTRDRDLFTAHMDIRGLTQDDTATYFCARQKFARGDQGWFFDLWGRGTLIVVSSASTKGPSVFPHDLR

SEQ ID NO: 3744 - protein, 139 aa, Artificial Sequence
  anti-HIV-1_HeavyChain
QSHLEQSGSAMKKPGASVRVSCWTSEDIFDTTELIYWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPHDLR

SEQ ID NO: 3745 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPTIYV

SEQ ID NO: 3746 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDPR

SEQ ID NO: 3747 - protein, 141 aa, Artificial Sequence
  anti-HIV-1_HeavyChain
QVYMEQAGAGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSSASTKGPSVFPHDLR

SEQ ID NO: 3748 - protein, 141 aa, Artificial Sequence
  anti-HIV-1_HeavyChain
QVYMEQAGGGMKKPGASMTVSCKTADEDIFDAAYMHWVRQARGQTFEWLGWMKPVTGAVNYARQFQGRVSFYRTRELGIAYMDLRDLKFDDTAVYFCARKTKGDVSGDDRGFFFDLWGRGTRVIVSSASTKGPSVFPTIYV

SEQ ID NO: 3749 - protein, 141 aa, Artificial Sequence
  anti-HIV-1_HeavyChain
QVYMEQAGAGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSASTKGPSVFPTIYV

SEQ ID NO: 3750 - protein, 141 aa, Artificial Sequence
  anti-HIV-1_HeavyChain
QVYSGAGRGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVFPTIYV

SEQ ID NO: 3751 - protein, 139 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGRGTLIVVSSAFTKGPSVFPHDLR

SEQ ID NO: 3752 - protein, 138 aa, Artificial Sequence
  anti-HIV-1_HeavyChain
QVQLGQSGAEMKKPGSSVKVSCKASGGTFRHSPISWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPHDLR

SEQ ID NO: 3753 - protein, 139 aa, Artificial Sequence
  anti-HIV-1_HeavyChain
QSHLEQSGSAMKKPGASVRVSCWTSEDIFDTTELIYWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3754 - protein, 141 aa, Artificial Sequence
  anti-HIV-1_HeavyChain
QVYMEQAGAGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSWVIVSSASTKGPSVFPHDLR

SEQ ID NO: 3755 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVFPTICV

SEQ ID NO: 3756 - protein, 139 aa, Artificial Sequence
  anti-HIV-1_HeavyChain
QAHLEQSGSGVKKLGASVRVSCWTSEDIFERTELIHWVRQAPGRGLEWIGWVKAVSGAVNYGSLDFRHRVSLTRDRDLFTAHMDIRGLTQDDTATYFCARQKFARGDQGWFFDLWGRGTLIVVSSASTKGPSVFPHDLR

SEQ ID NO: 3757 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVFPTIYV

SEQ ID NO: 3758 - protein, 141 aa, Artificial Sequence
  anti-HIV-1_HeavyChain
QVFMEQAGAGMKKPGASMTVSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVFPHDLR

SEQ ID NO: 3759 - protein, 141 aa, Artificial Sequence
  anti-HIV-1_HeavyChain
QVYMEQAGAGVKKPGASVTLSCKTADEDVFDAAYMHWVRQAPGQTFEWLGWMKPVTGAVNYARKFQGRVSFYRTRELGIAYMDLRNLRLDDTAVYFCARKTAGDVSGDKRGFFFDLWGRGSRVIVSSASTKGPSVFPHDLR

SEQ ID NO: 3760 - protein, 140 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSSASTKGPSVFPTI

SEQ ID NO: 3761 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSASTKGPSVFPTICV

SEQ ID NO: 3762 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKYYAGGQGWYFDLWGRGTLIVVSSASTKGPSVFPHDLR

SEQ ID NO: 3763 - protein, 142 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 3764 - protein, 141 aa, Artificial Sequence
  anti-HIV-1_HeavyChain
QVYMGAGRGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVFPTIYV

SEQ ID NO: 3765 - protein, 141 aa, Artificial Sequence
  anti-HIV-1_HeavyChain
QVYMEQAGGGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSSASTKGPSVFPTICV

SEQ ID NO: 3766 - protein, 141 aa, Artificial Sequence
  anti-HIV-1_HeavyChain
QVYMEQAGGGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSSASTKGPSVFPHDLR

SEQ ID NO: 3767 - protein, 141 aa, Artificial Sequence
  anti-HIV-1_HeavyChain
QVYMEQAGAGVKKPGASVTLSCKTADEDVFDAAYMHWVRQAPGQTFEWLGWMKPVTGAVNYARKFQGKVSFYRTRELGIAYMDLRNLRFDDTAVYFCARKTAGDVSGDKRGFFFDLWGRGSRVIVSSASTKGPSVFPHDLR

SEQ ID NO: 3768 - protein, 141 aa, Artificial Sequence
  anti-HIV-1_HeavyChain
QVYMEQAGAGVKKPGASVTLSCKTADEDVFDAAYMHWVRQAPGQTFEWLGWMKPVTGAVNYARKFQSRVSFYGTRELGIAYMDLRNLRFDDTAVYFCARKTAGDVSGDKRGFFFDLWGRGSRVIVSSASTKGPSVFPHDLR

SEQ ID NO: 3769 - protein, 140 aa, Artificial Sequence
  anti-HIV-1_HeavyChain
QGHTVEQSGSGVKKLGASVRVSCWTSEDIFETTELIHWVRQAPGQGLEWIGWVKTVSGAVNFGSLNFRHRVSLTRDRDLFTAHMDIRGLTQGDTATYFCARQKFARGDQGWFFDLWGRGTLIVVSSASTKGPSVFPHDLR

SEQ ID NO: 3770 - protein, 140 aa, Artificial Sequence
  anti-HIV-1_HeavyChain
QATPWSNLGRGVKKLGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSSASTKGPSVFPHDLR

SEQ ID NO: 3771 - protein, 141 aa, Artificial Sequence
  anti-HIV-1_HeavyChain
QVFMEQAGAGMKKPGASMTVSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSASTKGPSVFPHDLR

SEQ ID NO: 3772 - protein, 141 aa, Artificial Sequence
  anti-HIV-1_HeavyChain
QVYMEQSGGGVKKPGASVTLSCKTADEDVFDAAYMHWVRQAPGQTFEWLGWMKPVTGAVSYARKFQGRVSFYRTRELGIAYMDLRNLRFDDTAVYFCARKTAGDVSGDKRGFFFDLWGRGSRVIVSSASTKGPSVFPHDLR

SEQ ID NO: 3773 - protein, 141 aa, Artificial Sequence
  anti-HIV-1_HeavyChain
QVYMERGRGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVFPHDLR

SEQ ID NO: 3774 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARRFQGRVSFYMTRELGMAYMDLRNLRFDDTAVYFCARKTAGDVSGDNRGYFFDLWGRGSRVIVSSASTKGPSVFPTICV

SEQ ID NO: 3775 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSASTKGPSVFPHDLR

SEQ ID NO: 3776 - protein, 141 aa, Artificial Sequence
  anti-HIV-1_HeavyChain
QVFMEQAGGGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSSASTKGPSVFPHDLR

SEQ ID NO: 3777 - protein, 141 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFASRYSGDQGSYFDLWGRGTLIVVSSASTKGPSVFPHDL

SEQ ID NO: 3778 - protein, 141 aa, Artificial Sequence
  anti-HIV-1_HeavyChain
QVFMEQAGAGMKKPGASMTVSCKTADEDVFDAAYMHWVRQAPGPDLEWLGWMKPVTGAVNYARKFQGRVSFYRTRELGIAYMDLRDLRFDDTAVYFCARKTAGDVSGDKRGFFFDLWGRGSRVIVSSASTKAHRSSPTICV

SEQ ID NO: 3779 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRISLTRDRDLFTAHMDIRGLTQGDTATYFCARQKFESRYTGGQGWYFDLWGRGTHIVVSSASTKGPSVFPHDLR

SEQ ID NO: 3780 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARKFQGRVSFYMTRELGMAYMDLRNLRFNDTAVYFCARKTAGDVSGDNRGYFFDLWGRGSRVIVSSASTKGPSVFPHDLR

SEQ ID NO: 3781 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDNRGYFFDLWGRGSRVIVSSASTKGPSGLPHDLR

SEQ ID NO: 3782 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDGTAVYFCARKTAGDVSGDKRGFFFDLWGRGSRVIVSSASTKGPSVFPHDLR

SEQ ID NO: 3783 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVFPHDLR

SEQ ID NO: 3784 - protein, 141 aa, Artificial Sequence
  anti-HIV-1_HeavyChain
QVQLVQSGAEVKKPGASLKVSCKASGYTFTDYYIHWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPHDLR

SEQ ID NO: 3785 - protein, 141 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTLIVVSSASTRAHRSPHDLR

SEQ ID NO: 3786 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRQRVSLTRDRDLFTAHMDIRGLTQGDTATYFCARQKFESRYTGGQGWYFDLWGRGTHIVVSSASTKGPSVFPHDLR

SEQ ID NO: 3787 - protein, 142 aa, Artificial Sequence
  anti-HIV-1_HeavyChain
QVQLVQSGAEVKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPQICV

SEQ ID NO: 3788 - protein, 142 aa, Artificial Sequence
  anti-HIV-1_HeavyChain
QSHLEQSGSAMKKPGASVRVSCWTSEDIFERTELIYWVRQAPGRGLEWIGWMKTVSGTVNFGSSDFRNRISLTRDRDLSTAHMDIRGLTQDDTATYFCARQKFESLYSDDQGSYFDLWGRGTLIIVSSASTKAHRSSPTTLR

SEQ ID NO: 3789 - protein, 141 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSVFPRSA

SEQ ID NO: 3790 - protein, 141 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGHQISDRVSLSRDRDLSTAYMDIRGLTQDDTATYFCARQKFASRYSGDQGSYFDLWGRGTLIVVSSASTKGPSVFPHDLR

SEQ ID NO: 3791 - protein, 141 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTRAHRSSPRSA

SEQ ID NO: 3792 - protein, 142 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRHRISLTRDRDLFTAHMDIRGLTQGDTATYFCARQKFESRYTGGQGWYFDLWGRGTHIVVSSASTKGPSVFPHDLR

SEQ ID NO: 3793 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFGSSDFRNRISLTRDRDLSTAHMDIRGLTQDDTATYFCARQKFESLYSDDQGSYFDLWGRGTLIIVSSASTKGPSVFPTIYV

SEQ ID NO: 3794 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPHDLR

SEQ ID NO: 3795 - protein, 141 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSVFPTIC

SEQ ID NO: 3796 - protein, 139 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLSTAHMDIRGLTQDDTATYFCARQKFARGDQGWFFDLWGRGTLIVVSSALHQGPIGLPPRST

SEQ ID NO: 3797 - protein, 141 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVLPPRSA

SEQ ID NO: 3798 - protein, 141 aa, Artificial Sequence
  anti-HIV-1_HeavyChain
QVQLVQSGAEVKKPGASVKISCKASGYTFIRHGIHWLRQVPGQRPEWMGWIRPKTGARNQARQFQPRISLARDRALSTAYLDLNSLTSADSGTYFCARQTFKPDFYFADQGWSFNLWGRGAHFIVSSALHQGPIGLPPRST

SEQ ID NO: 3799 - protein, 142 aa, Artificial Sequence
  anti-HIV-1_HeavyChain
QSHLEQSGSAMKKPGASVRVSCWTSEDIFERTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPHDLR

SEQ ID NO: 3800 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDLFTAHMDIRGLTQGDTATYLCARQKFESRYTGGQGWYFDLWGRGTHIVVSSASTKGPSVFPTICV

SEQ ID NO: 3801 - protein, 142 aa, Artificial Sequence
  anti-HIV-1_HeavyChain
QAHLEQSGSGVKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPQICV

SEQ ID NO: 3802 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPTICV

SEQ ID NO: 3803 - protein, 142 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFESLYSDDQGSYFDLWGRGTLIIVSSASTKGPSVFPTICV

SEQ ID NO: 3804 - protein, 142 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFESRYTGGQGWYFDLWGRGTHIVVSSASTKGPSVFPHDLR

SEQ ID NO: 3805 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSVFPTICV

SEQ ID NO: 3806 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGTVNFGSLNFRQRVSLTRDRDLFTAHMDIRGLTQDDTATYFCARQKFASRYSGDQGSYFDLWGRGTLIVVSSASTKGPSVFPTICV

SEQ ID NO: 3807 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGHRSSPTICV

SEQ ID NO: 3808 - protein, 141 aa, Artificial Sequence
  anti-HIV-1_HeavyChain
QVYMEQAGAGMKKPGASMTVSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSSASTKGPSVFPTIYV

SEQ ID NO: 3809 - protein, 141 aa, Artificial Sequence
  anti-HIV-1_HeavyChain
QSHLEQSGSAMKKPGASVRVSCWTSEDIFDTTELYWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPHDLR

SEQ ID NO: 3810 - protein, 141 aa, Artificial Sequence
  anti-HIV-1_HeavyChain
QSHLEQSGSAMKKPGASVRVSCWTSEDIFDTTELIYWVRQAPGQGLEWIGWVKIVSGTVNFARQFQGRVSFYRTRELGIAYMDLRDLKFDDTAVYFCARKTKGDVSGDDRGFFFDLWGRGTRVIVSSASTKGPSVFPHDPA

SEQ ID NO: 3811 - protein, 142 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFESRYTGGQGWYFDLWGRGTHIVVSSASTKGPSVFPTICV

SEQ ID NO: 3812 - protein, 142 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSPNFRQRVSLTRDRDLSTAHMDIRGLTQDDTATYFCARQKFESLYSDDQGSYFDLWGRGTLIIVSSASTKGPSVFPTICV

SEQ ID NO: 3813 - protein, 142 aa, Artificial Sequence
  anti-HIV-1_HeavyChain
QAHLEQSASGVKRPGASVRVSCWTSEDIFERTELIYWVRQAPGQGLEWIGWVKTVSGAVNFGSQDFRDRFSLTRDRDLFTAHMDIRGLTQGDTATYFCARQKFASRYSGDQGSYFDLWGRGTLIVVSSASTKGPSVFPTICV

SEQ ID NO: 3814 - protein, 142 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFESRYTGGQGWYFDLWGRGTHIVVSSASTKGPSVFPTICV

SEQ ID NO: 3815 - protein, 141 aa, Artificial Sequence
  anti-HIV-1_HeavyChain
QVHMEQAGGGMKKPGASMTVSCKTADEDIFDAAYMHWVRQAPGQTFEWLGWMKPVTGAVNYARQFQGRVSFLQDQGIRIAYMDLRDLKFDDTAVYFCARKTKGDVSGDDRGFFFDLWGRGTRVIVSSSLHQGPIGLPPRSA

SEQ ID NO: 3816 - protein, 142 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRHRISLTRDRDLFTAHMDIRGLTQGDTATYFCARQKFESRYTGGQGWYFDLWGRGTHIVVSSASTKGPSVFPTIYV

SEQ ID NO: 3817 - protein, 142 aa, Artificial Sequence
  anti-HIV-1_HeavyChain
QVYMEQAGGGVKKPGASVTLSCKTADEDVFDAAYMHWVRQAPGQTFEWLGWMKPVTGAVNYARNFQGRVSFYRTRELGIAYMDLRNLRFDDTAVYFCARKTKGDVSGDDRGFFFDLWGRGTRVIVSSGLHQRAHRSSPTICV

SEQ ID NO: 3818 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPTICV

SEQ ID NO: 3819 - protein, 141 aa, Artificial Sequence
  anti-HIV-1_HeavyChain
QVYMEQAGVGVKKPGASVTLSCKTADEDVFDAAYMHWVRQAPGPDLEWLGWMKPVTGAVNYARKFQGRVSFYRTRELGIAYMDLRNLRFDDTAVYFCARKTAGDVSGDKRGFFFDLWGRGSRVIVSSASTKGPSVFPTICV

SEQ ID NO: 3820 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSVFPHDLR

SEQ ID NO: 3821 - protein, 142 aa, Artificial Sequence
  anti-HIV-1_HeavyChain
QAHLEQSGSGVKKLGASVRVSCWTSEDIFERTELIHWVRQAPGQGLEWIGWVKAVTGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 3822 - protein, 142 aa, Artificial Sequence
  anti-HIV-1_HeavyChain
QAHLEQSGSGVKKPGASVRVSCWTSEDIFERTELIHWVRQAPGQGLERIGWVKTVTGAVNFGSLDFRHRISLTRDRDLFTAHMDIRGLTQGDTATYFCARQKFESRYTGGQGWYFDLWGRGTHIVVSSASTKGPSVFPTICV

SEQ ID NO: 3823 - protein, 141 aa, Artificial Sequence
  anti-HIV-1_HeavyChain
EVYMERGRGGVKKPGASATLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSASTKGPSVFPHDLR

SEQ ID NO: 3824 - protein, 142 aa, Artificial Sequence
  anti-HIV-1_HeavyChain
QAHLEQSGSGVKKPGASARVSCWSSEDIFERIELIHWVRQAPGQGLEWIGWVKTVAGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 3825 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLRQDDTATYFCARQKFESRYSGDQGSYFDLWGRGTLIIVSSASTKGPSVFPTIYV

SEQ ID NO: 3826 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNGISLSRDRDLSTAYMDIRGLTQDDTATYFCARQKFASRYSGDQGSYFDLWGRGTLIVVSSASTKGPSVFPHDLR

SEQ ID NO: 3827 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIVVSSASTKGPSVFPHDLR

SEQ ID NO: 3828 - protein, 142 aa, Artificial Sequence
  anti-HIV-1_HeavyChain
QAHLEQSGSGVKKPGASVRVSCWTSGDILRKSELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 3829 - protein, 142 aa, Artificial Sequence
  anti-HIV-1_HeavyChain
QVHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSACTKGPSVFPHDLR

SEQ ID NO: 3830 - protein, 142 aa, Artificial Sequence
  anti-HIV-1_HeavyChain
QAHLEQSWSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 3831 - protein, 142 aa, Artificial Sequence
  anti-HIV-1_HeavyChain
QSHLEQSGSAMKKPGASVRVSCWTSEDIFERTELIYWVRQAPGRGPEWIGWVKTVSGTVNFGSSDFRNRISLTRDRDLSTAHMDIRGLTQDDTATYFCARQKFESLYSDDQGSYFDLWGRGTLIIVSSASTKGPSVFPHDLR

SEQ ID NO: 3832 - protein, 142 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPTILR

SEQ ID NO: 3833 - protein, 142 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIAVSSASTKGPSVFPHDLR

SEQ ID NO: 3834 - protein, 142 aa, Artificial Sequence
  anti-HIV-1_HeavyChain
QSHLKQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSSASTKGPSVFPHDLR

SEQ ID NO: 3835 - protein, 142 aa, Artificial Sequence
  anti-HIV-1_HeavyChain
QAHLEQSGSGVKKLGASVRVSCWTSEDIFERTELIHWVRQAPGQGLEWIEWVKAVSGAVNYGSLDFRHRVSLTRDRDLFTAHMDIRGLTQDDTATYFCARQKFESRYTGGQGWYFDLWGRGTHIVVSSASTKGPSVFPHDLR

SEQ ID NO: 3836 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFESRYSGDQGSYFDLWGRGTLIIVSSASTKGPSVFPHDLR

SEQ ID NO: 3837 - protein, 142 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSLDFRNRISLSRDRDLSTAYMDIRGLTQDDTATYFCARQKFASRYSGDQGSYFDLWGRGTLIVVSSASTKGPSVFPHDLR

SEQ ID NO: 3838 - protein, 142 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSPNFRQRVSLSRDRDLSTAHMDIRGLTQDDTATYFCARQKFASRYSGDQGSYFDLWGRGTLIIVSSASTKGPSVFPHDLR

SEQ ID NO: 3839 - protein, 142 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSSASTKGPSVFPHDLR

SEQ ID NO: 3840 - protein, 142 aa, Artificial Sequence
  anti-HIV-1_HeavyChain
QAHLEQSGSGVKKPGASVRVSCWTSEDIFERTELIHWVRQAPGRGLEWIGWVKTVSGTVNFGSSDFRNRISLTRDRDLSTAHMDIRGLTQDDTATYFCARQKFESLYSDDQGSYFDLWGRGTLIIVSSASTKGPSVFPHDLR

SEQ ID NO: 3841 - protein, 142 aa, Artificial Sequence
  anti-HIV-1_HeavyChain
QVHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 3842 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLRQDDTATYFCARQKFESRYSGDQGSYFDLWGRGTLIIVSSASTKGPSVFPHDLR

SEQ ID NO: 3843 - protein, 141 aa, Artificial Sequence
  anti-HIV-1_HeavyChain
QVYMEQAGAGVKKPGASVTLSCKTADEDVFDAAYMHWVRQAPGQTFEWLGWMKPVTGAVSYARKFQGRVSFYMTRELGVAYMDLRNLRFDDTAVYFCARKTAGDVSGDNRGYFFDLWGRGSRVIVSSASTKGPSVFPHDLR

SEQ ID NO: 3844 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRNLSTAHMDIRGLRQDDTATYFCARQKFESRYSGDQGSYFDLWGRGTLIIVSSASTKGPSVFPHDLR

SEQ ID NO: 3845 - protein, 141 aa, Artificial Sequence
  anti-HIV-1_HeavyChain
QVQLVQSGAEVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSASTKGPSVFPTIYV

SEQ ID NO: 3846 - protein, 142 aa, Artificial Sequence
  anti-HIV-1_HeavyChain
QAHLEQSGSGVKKPGASVRVSCWTSEDIFERTELVHWVRQAPGQGLEWIGWVKTVTGAVNFGSPNFRQRVSLTRDRDLFTAHMDIRGLTQDDTATYFCARQKFASRYSGDQGSYFDLWGRGTLIVVSSASTKGPSVFPHDLR

SEQ ID NO: 3847 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIIVSSASTKGPLGLPHDLR

SEQ ID NO: 3848 - protein, 142 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFASRYSGDQGSYFDLWGRGTLIVVSSASTKGPSVFPHDLR

SEQ ID NO: 3849 - protein, 142 aa, Artificial Sequence
  anti-HIV-1_HeavyChain
QAHLEQSGSGVKKPGASVRVSCWTSEDIFERTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSVFPHDLR

SEQ ID NO: 3850 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRNRISLTRDRDLSTAHMDIRGLTQDDTATYFCARQKFESLYSDDQGSYFDLWGRGTLIIVSSASTKGPSVFPHDLR

SEQ ID NO: 3851 - protein, 142 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFESLYSDDQGSYFDLWGRGTLIIVSSASTKGPSVFPHDLR

SEQ ID NO: 3852 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSSDFRNRISLTRDRDLSTAHMDIRGLTQDDTATYFCARQKFESLYSDDQGSYFDLWGRGTLIIVSSASTKGPSVFPHDLR

SEQ ID NO: 3853 - protein, 142 aa, Artificial Sequence
  anti-HIV-1_HeavyChain
QSHLEQSGSAMKKPGASARVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTHIVVSSASTKGPSVFPHDLR

SEQ ID NO: 3854 - protein, 142 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFESRYTGGQGWYFDLWGRGTHIVVSSASTKGPSVFPHDLR

SEQ ID NO: 3855 - protein, 142 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFESRYTGGQGWYFDLWGRGTHIVVSSASTKGPSVFPHDLR

SEQ ID NO: 3856 - protein, 142 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFASRYSGDQGSYFDLWGRGTLIIVSSASTKGPSVFPHDLR

SEQ ID NO: 3857 - protein, 142 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTARMDIRGLTQDDTATYFCARQKFESLYSDDQGSYFDLWGRGTLIIVSSASTKGPSVFPTDLR

SEQ ID NO: 3858 - protein, 142 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQDDTATYFCARQKFASRYSGDQGSYFDLWGRGTLIVVSSASTKGPSVFPHDLR

SEQ ID NO: 3859 - protein, 142 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSSASTNGPIGLPHDLR

SEQ ID NO: 3860 - protein, 142 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFESRYTGGQGWYFDLWGRGTHIVVSSASTKGPSVFPHDLR

SEQ ID NO: 3861 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQDDTATYFCARQKFASRYSGDQGSYFDLWGRGTLIVVSSASTKGPSVFPHDLR

SEQ ID NO: 3862 - protein, 142 aa, Artificial Sequence
  anti-HIV-1_HeavyChain
QSHLEQSGSAMKKPGASVRVSCWTSEDIFERTGLIYWVRQAPGRGLEWIGWVKTVSGTVNFGSSDFRNRISLTRDRDLSTAHMDIRGLTQDDTATYFCARQKFESLYSDDQGSYFDLWGRGTLIIVSSASTKGPSVFPHDLR

SEQ ID NO: 3863 - protein, 142 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSQIFRHRISLTRDRDLFTAHMDIRGLTQGDTATYFCARQKFESRYTGGQGWYFDLWGRGTHIVVSSASTKGPSVFPHDLR

SEQ ID NO: 3864 - protein, 142 aa, Artificial Sequence
  anti-HIV-1_HeavyChain
QSHLEQSGSAMKKPGASVRVSCWTSEDIFDTTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 3865 - protein, 142 aa, Artificial Sequence
  anti-HIV-1_HeavyChain
QSHLEQSGSEVKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIIVSSASTKGPSVFPHDLR

SEQ ID NO: 3866 - protein, 141 aa, Artificial Sequence
  anti-HIV-1_HeavyChain
QVYMEQAGGGVKKPGASVTLSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSSASTKGPSVFPHDLR

SEQ ID NO: 3867 - protein, 142 aa, Artificial Sequence
  anti-HIV-1_HeavyChain
QSHLEQSGSEVKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSVFPHDLR

SEQ ID NO: 3868 - protein, 142 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLSRDRDLSTAYMDIRGLTQDDTATYFCARQKFASRYSGDQGSYFDLWGRGTLIVVSSASTKGPSVFPHDLR

SEQ ID NO: 3869 - protein, 142 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASAKGPSVFPHDLR

SEQ ID NO: 3870 - protein, 142 aa, Artificial Sequence
  anti-HIV-1_HeavyChain
QSHLEQSGSAMKKPGASVRVSCWTSEDIFERTELIYWVRQAPGRGLEWIGWVKTVSGTVNFGSSDFRNRISLTRDRDLSTAHMDIRGLTQDDTATYFCARQKFESLYSDDQGSYFDLWGRGTLIVVSSASTKGPSVFPPRSA

SEQ ID NO: 3871 - protein, 142 aa, Artificial Sequence
  anti-HIV-1_HeavyChain
QVHMEQAGGGVKKPGASVTLSCKTADEDVFDAAYMHWVRQAPGQTFEWLGWMKPVTGAVNYARKFQGRVSFYRTRELGIAYMDLRNLRFDDTAVYFCARKTKGDVSGDDRGFFFDLWGRGTRVIVSSASTKGPLRSFPRRSA

SEQ ID NO: 3872 - protein, 142 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPTIYV

SEQ ID NO: 3873 - protein, 142 aa, Artificial Sequence
  anti-HIV-1_HeavyChain
ESHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSVFPHDLR

SEQ ID NO: 3874 - protein, 143 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQDDTATYFCARQKFASRYSGDQGSYFDLWGRGTLIVVSSASTKGPSGLPPRSCV

SEQ ID NO: 3875 - protein, 141 aa, Artificial Sequence
  anti-HIV-1_HeavyChain
QVHLVQSGAEVKKPGASVKVSCKASGYTFTTSGIHWLRQVPGQRPEWMGWIRPKTGARNQARQFQPRISLTRDRALSTAYLDLNSLTSADSGTYFCARQTFKPDFYFADQGWSFNLWGRGAHFIVSSASTKGPSVFPHDLR

SEQ ID NO: 3876 - protein, 143 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTQGPIGLPPRLCV

SEQ ID NO: 3877 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPIGLPPRST

SEQ ID NO: 3878 - protein, 142 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPTICV

SEQ ID NO: 3879 - protein, 142 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQGDTATYFCARQKFESRYTGGQGWYFDLWGRGTHIVVSSALHQGPIGLPPRST

SEQ ID NO: 3880 - protein, 143 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRVSLSRDRDLSTAYMDIRGLTQDDTATYFCARQKFASRYSGDQGSYFDLWGRGTLIVVSSALHQGPIGPSPTILR

SEQ ID NO: 3881 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSVFPTIYV

SEQ ID NO: 3882 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFESRYTGGQGWYFDLWGRGTHIVVSSASTKGPSVFPTICV

SEQ ID NO: 3883 - protein, 142 aa, Artificial Sequence
  anti-HIV-1_HeavyChain
QVQLVQSGAEVKKPGASVRVSCWTSEDIFDTTELIYWVRQAPGQGLEWIGWVKIVSGTVNFASLDFRNRISLSRDRDLSTAHMDIRGLTQDDTATYFCARQKFESRYTGGQGWYFDLWGRGTHIVVSSASTKGPSVFPTICV

SEQ ID NO: 3884 - protein, 142 aa, Artificial Sequence
  anti-HIV-1_HeavyChain
RRHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 3885 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFESRYSGDQGSYFDLWGRGTLIIVSSASTKGPSVFPTICV

SEQ ID NO: 3886 - protein, 143 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPHPVFPHDLP

SEQ ID NO: 3887 - protein, 142 aa, Artificial Sequence
  anti-HIV-1_HeavyChain
QAHLEQSGSGVKKLGASVRVSCWTSEDIFERTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPTIYV

SEQ ID NO: 3888 - protein, 143 aa, Artificial Sequence
  anti-HIV-1_HeavyChain
QAHLEQSGSGVKKPGASVRVSCWTSEDIFERTELIHWARQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPLGLPPRLSR

SEQ ID NO: 3889 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSSASTKGPSGLPPRSA

SEQ ID NO: 3890 - protein, 142 aa, Artificial Sequence
  anti-HIV-1_HeavyChain
QVQLVQSGAEVKKPGASVRVSCWTSEDIFDTTELIYWVRQAPGQGLEWIGWVKIVSGTVNFASLDFRNRISLSRDRDLSTAHMDIRGLRQDDTATYFCARQKFESRYSGDQGSYFDLWGRGTLIIVSSASTKGPSVFPHDLR

SEQ ID NO: 3891 - protein, 142 aa, Artificial Sequence
  anti-HIV-1_HeavyChain
EAHLEQSGSGVKKPGASVRVSCWTSEDIFERTELIHWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPHDLR

SEQ ID NO: 3892 - protein, 141 aa, Artificial Sequence
  anti-HIV-1_HeavyChain
QVQLVQSGAEVKKPGASVKVSCRASGYTFGNHAISWVRQAPGQGLEWMGWIRPKTGARNQARQFQPRISLTRDRALSTAYLDLNSLTSADSGTYFCARQTFKPDFYFADQGWSFNLWGRGAHFIVSSASTKGPSVFPHDLR

SEQ ID NO: 3893 - protein, 143 aa, Artificial Sequence
  anti-HIV-1_HeavyChain
QGHNLEQSGSEVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPHDLR

SEQ ID NO: 3894 - protein, 142 aa, Artificial Sequence
  anti-HIV-1_HeavyChain
PTTWNKSGSDVKKPGASVRVSCWTSEDIFERTELIHWVRQAPGQGLEWIGWVKTVTGAVNFGSPNFRHRVSLTRDRDLSTAHMDIRGLTQDDTATYFCARQKFESLYSDDQGSYFDLWGRGTLIIVSSASTKGPSVFPHDLR

SEQ ID NO: 3895 - protein, 144 aa, Artificial Sequence
  anti-HIV-1_HeavyChain
HVTPWNEYVGRAMKKPGRSVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPHDLR

SEQ ID NO: 3896 - protein, 124 aa, Artificial Sequence
  anti-HIV-1_HeavyChain
QVQLVQSGAEVRRPGASVKVSCKASGFSFLGHYIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3897 - protein, 124 aa, Artificial Sequence
  anti-HIV-1_HeavyChain
QVQLVQSGAEVKKPGASVKVSCKASGYTFTSYGISWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3898 - protein, 124 aa, Artificial Sequence
  anti-HIV-1_HeavyChain
QVQLVQSEAEVKKPGASVKISCATSGYAFTLYYLHWVRQAPGQGLEWIGWVKTVTGAVNFGSAYFRHRVSLTRDRDLFTAHMDIRGLTQGDTATYFCARQKFYKGGQGWYFDLWGRGTLIVVSS

SEQ ID NO: 3899 - protein, 124 aa, Artificial Sequence
  anti-HIV-1_HeavyChain
QAHLEQSGSGVKKPGASVRVSCWTSEDIFKTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3900 - protein, 125 aa, Artificial Sequence
  anti-HIV-1_HeavyChain
QAHLEQSGSGVKKLGASVRVSCWTSEDIFERTELIHWVRQAPGRGLEWIGWVKAVSGAVNYGSLDFRHRVPLTRDRDLFTAHMDIRGLTQDDTATYFCARQKFARGDQGWFFDLWGRGTLIVVSS

SEQ ID NO: 3901 - protein, 125 aa, Artificial Sequence
  anti-HIV-1_HeavyChain
QAHLEQSGSGVKKPGASVRVSCWTPEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3902 - protein, 125 aa, Artificial Sequence
  anti-HIV-1_HeavyChain
QAHLEQSASGVKRPGASVRVSCWTSEDIFEGSELIHWVRQAPGQGLEWIGWVKTVTGAVNFGSAYFRHRVSLTRDRDLFTAHMDIRGLTQGDTATYFCARQKFYKGGQGWYFDLWGRGTLIVVSS

SEQ ID NO: 3903 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFYAGGQGWYFDLWGRGTLIVVSS

SEQ ID NO: 3904 - protein, 125 aa, Artificial Sequence
  anti-HIV-1_HeavyChain
QAHLEQSGSGVKKPGASVRVSCWSSEDIFERAELIHWVRQAPGQGLEWIGWVKTVTGAVNFGSPNFRQRVSLTRDRDLFTAHMDIRGLTQGDTATYFCARQKFERGGQGWIFDLWGRGTLIAVSS

SEQ ID NO: 3905 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFERGGQGWYFDLWGRGTLIVVSS

SEQ ID NO: 3906 - protein, 125 aa, Artificial Sequence
  anti-HIV-1_HeavyChain
QVHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3907 - protein, 125 aa, Artificial Sequence
  anti-HIV-1_HeavyChain
QAYLEQSGSIMKKPGASVRVSCWTSEDIFDRTELIYWVRQAPGQGLEWIGWVKIVSGAVNFGSLDFRNRVSLTRDRDLFTAHMDIRGLTQGDTATYFCARQKFERGGQGWYFDLWGRGTLIVVSS

SEQ ID NO: 3908 - protein, 125 aa, Artificial Sequence
  anti-HIV-1_HeavyChain
QAHLEQSGSGVKKPGASVRVSCWTSEDIFERTELINWVRQAPGQGLEWIGWVKAVSGAVNYGSLDFRHRVSLTRDRDLSTAHMDIRGLTQDDTATYFCARQKFARGDQGWFFDLWGRGTLIVVSS

SEQ ID NO: 3909 - protein, 125 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFERGGQGWYFDLWGRGTLIVVSS

SEQ ID NO: 3910 - protein, 125 aa, Artificial Sequence
  anti-HIV-1_HeavyChain
QAHLEQSGSGVKKPGTSVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3911 - protein, 125 aa, Artificial Sequence
  anti-HIV-1_HeavyChain
QAHLEQSGSGVKKLGASVRVSCWTSGDIFERTELIHWVRQAPGQGLEWIGWVKAVSGAVNYGSLDFRHRVSLTRDRDLFTAHMDIRGLTQDDTATYFCARQKFARGDQGWFFDLWGRGTLIVVSS

SEQ ID NO: 3912 - protein, 125 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHTDIRGLTQGDTATYFCARQKFERGGQGWYFDLWGRGTLIVVSS

SEQ ID NO: 3913 - protein, 125 aa, Artificial Sequence
  anti-HIV-1_HeavyChain
QAHLEQSGSGVKKPGASVRVSCLASEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3914 - protein, 125 aa, Artificial Sequence
  anti-HIV-1_HeavyChain
QAHLEQSGAGVKRPGASVRVSCWTSEDIFETTELIHWVRQAPGQGLEWIGWVKTVSGAVNFGSLNFRHRVSLTRDRDLFTAHMDIRGLTQGDTATYFCARQKFARGDQGWFFDLWGRGTLIVVSS

SEQ ID NO: 3915 - protein, 125 aa, Artificial Sequence
  anti-HIV-1_HeavyChain
RHTWNKSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSS

SEQ ID NO: 3916 - protein, 125 aa, Artificial Sequence
  anti-HIV-1_HeavyChain
GTPGSESGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3917 - protein, 126 aa, Artificial Sequence
  anti-HIV-1_HeavyChain
QVQLVQSGTEVQKPGASVKVSCKAFGYSFTDYYVYWVRQAPGQGLEYVAWINPSNGYTKYAQKFQDWVTLTRDSSINTAYLQLARVTSDDTAIYYCARQKFASRYSGDQGSYFDLWGRGTLIVVSS

SEQ ID NO: 3918 - protein, 126 aa, Artificial Sequence
  anti-HIV-1_HeavyChain
QVQLVQSGAAVKKPGSSVKVSCKASGYIFTGYYIHWIRQAPGQGLEWMGWINPSTGDTKFARQFQGRVSFYRTRELGIAYMDLRDLKFDDTAVYFCARKTKGDVSGDDRGFFFDLWGRGTRVIVSS

SEQ ID NO: 3919 - protein, 127 aa, Artificial Sequence
  anti-HIV-1_HeavyChain
QVYMEQAGAGMKKPGASMTVSCKTADEDIFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3920 - protein, 127 aa, Artificial Sequence
  anti-HIV-1_HeavyChain
QVFMEQAGGGMKKPGASMTVSCKTADEDVFDAAYMHWVRQAPGQTFEWLGWMKPVTGAVNYARKFQGRVSFYRTRELGIAYMDLRDLKFDDTAVYFCARKTKGDVSGDDRGFFFDLWGRGTRVIVSS

SEQ ID NO: 3921 - protein, 127 aa, Artificial Sequence
  anti-HIV-1_HeavyChain
QVFMEQAGGGMKKPGASMTVSCKTADEDVFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3922 - protein, 127 aa, Artificial Sequence
  anti-HIV-1_HeavyChain
QVHMEQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSS

SEQ ID NO: 3923 - protein, 127 aa, Artificial Sequence
  anti-HIV-1_HeavyChain
QVYMEQAGGGMKKPGASMTVSCKTADEDIFDAAYMHWVRQAPGQTFEWLGWMKPVTGAVNYARQFQGRVSFYRTRELGMAYMDLRNLRFDDTAVYFCARKTAGDVSGDNRGYFFDLWGRGSRVIVSS

SEQ ID NO: 3924 - protein, 127 aa, Artificial Sequence
  anti-HIV-1_HeavyChain
QVYMEQAGGGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSWVIVSS

SEQ ID NO: 3925 - protein, 127 aa, Artificial Sequence
  anti-HIV-1_HeavyChain
QVQLVQSGAEVKKPGASVTLSCKTADEDVFDAAYMHWVRQAPGQTFEWLGWMKPVTGAVNYARKFQGRVSFYRTRELGIAYMDLRNLRFDDTAVYFCARKTAGDVSGDKRGFFFDLWGRGSRVIVSS

SEQ ID NO: 3926 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRGLSTAYMDIRGLTQDDTATYFCARQKFASRYSGDQGSYFDLWGRGTLIVVSS

SEQ ID NO: 3927 - protein, 128 aa, Artificial Sequence
  anti-HIV-1_HeavyChain
QAHLEQSASGVRRPGASVRVSCWTSEDIFERSELIYWVRQAPGRGLEWIGWIKLVSGAVNFGSVDFRDRVSLTRDRDLFTAHMDIRGLTQGDTATYFCARQKFESRYTGGQGWYFDLWGRGTHIVVSS

SEQ ID NO: 3928 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGAVNYGSLNFRSRISLTRDRDLFTAHMDIRGLTQGDTATYFCARQKFESRYTGGQGWYFDLWGRGTHIVVSS

SEQ ID NO: 3929 - protein, 128 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFESRYTGGQGWYFDLWGRGTHIVVSS

SEQ ID NO: 3930 - protein, 128 aa, Artificial Sequence
  anti-HIV-1_HeavyChain
QVHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3931 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLGRDRDLSTAYMDIRGLTQDDTATYFCARQKFASRYSGDQGSYFDLWGRGTLIVVSS

SEQ ID NO: 3932 - protein, 128 aa, Artificial Sequence
  anti-HIV-1_HeavyChain
QAHLEQSGSGVKKPGASVRVSCWTSEDIFERTELIHWVRQAPGQGLEWIGWVKTVTGTVNFGSLNFRQRVSLTRDRDLFTAHMDIRGLTQGDTATYFCARQKFESRYTGGQGWYFDLWGRGTHIVVSS

SEQ ID NO: 3933 - protein, 128 aa, Artificial Sequence
  anti-HIV-1_HeavyChain
QSHLEQSGSAMKKPGASVRVSCWTSEGIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3934 - protein, 128 aa, Artificial Sequence
  anti-HIV-1_HeavyChain
QSRLEQSGSAMKKPGASVRVSCWTSEDIFDTTELIYWVRQAPGQGLEWIGWVKIVSGTVNFASLDFRNRISLSRDRDLSTAHMDIRGLTQDDTATYFCARQKFASRYSGDQGSYFDLWGRGTLIIVSS

SEQ ID NO: 3935 - protein, 128 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFESRYTGGQGWYFDLWGRGTHIVVSS

SEQ ID NO: 3936 - protein, 128 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASSDFRNRISLSRDRDLSTAYMDIRGLTQDDTATYFCARQKFASRYSGDQGSYFDLWGRGTLIIVSS

SEQ ID NO: 3937 - protein, 128 aa, Artificial Sequence
  anti-HIV-1_HeavyChain
QAHLEQSGSGVKKPGASVRVSCWTSEDIFERTELIHWVRQAPGQGLEWIGWVKIVSGTVNFASLDFRNRISLSRDRDLSTAYMDIRGLTQDDTATYFCARQKFASRYSGDQGSYFDLWGRGTLIVVSS

SEQ ID NO: 3938 - protein, 128 aa, Artificial Sequence
  anti-HIV-1_HeavyChain
RHTWEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3939 - protein, 128 aa, Artificial Sequence
  anti-HIV-1_HeavyChain
RHTWEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3940 - protein, 138 aa, Artificial Sequence
  anti-HIV-1_HeavyChain
QAHLEQSGSGVKKPGASVRVSCWTSEDIFERSELIHWVRQAPGQGLEWIGWVKTVTGAVNFGSPNFRHRVSLTRDRDLFTAHMDIRGLTQGDTATYFCARQKYYAGGQGWYFDLWGRGTLIVVSSASTKGPSVFHDLR

SEQ ID NO: 3941 - protein, 139 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWIFDLWGRGTLIAVSSASTKGPSVFPTICV

SEQ ID NO: 3942 - protein, 139 aa, Artificial Sequence
  anti-HIV-1_HeavyChain
QAHLEQSGSGVKKPGASVRVSCWTSEDIFEKSELIHWVRQAPGQGLEWIGWVKAVSGAVNYGSLDFRHRVSLTRDRDLFTAHMDIRGLTQDDTAIYFCARQKFARGDQGWFFDLWGRGTLIVVSSASTKGPSVFPHDLR

SEQ ID NO: 3943 - protein, 139 aa, Artificial Sequence
  anti-HIV-1_HeavyChain
QAHLEQSGSGVKKVGASVRVSCWTSEDIFERTELIHWVRQAPGQGLEWIGWVKAVSGAVNYGSLDFRHRVSLTRDRDLFTAHMDIRGLTQDDTAIYFCARQKFARGDQGWFFDLWGRGTLIVVSSASTKGPSVFPHDLR

SEQ ID NO: 3944 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQGDTATYFCARQKFYAGGQGWYFDLWGRGTLIVVSSASTKGPSVFPHDLR

SEQ ID NO: 3945 - protein, 141 aa, Artificial Sequence
  anti-HIV-1_HeavyChain
QVYMEQAGAGVKKPGASVTLSCKTADEDVFDAAYMHWVRQAPGQTFEWLGWMKPVTGAVSYARKFQGRVSFYMTRELGMAYMDLRNLRFDDTAVYFCARKTAGDVSGDNRGYFFDLWGRGSRVIVSSASTKGPSVFPHDLR

SEQ ID NO: 3946 - protein, 142 aa, Artificial Sequence
  anti-HIV-1_HeavyChain
QSHLEQSGSAMKKPGASVRVSCWTSEDIFDTTELIYWVRQAPGQGLEWIGWVKIVSGTVNFASLDFRNRISLSRDRDLSTAYMDIRGLTQDDTATYFCARQKFASRYSGDQGSYFDLWGRGTLIVVSSASTKGPSVFPTIYV

SEQ ID NO: 3947 - protein, 124 aa, Artificial Sequence
  anti-HIV-1_HeavyChain
QVQLVQSGAEVKKPGASVKVSCKASGGTLSSYAISWVRQAPGQGLEWIGWVKTVTGAVNFGSACFRHRVSLTRDRDLFTAHMDIRGLTQGDTATYFCARQKFYKGGQGWYFDLWGRGTLIVVSS

SEQ ID NO: 3948 - protein, 124 aa, Artificial Sequence
  anti-HIV-1_HeavyChain
HVRLVQSGAEVEKPGASVKVSCETSNYPFNMYGMTWVRQAPGQGLEWIGWVKIVSGAVNFGSPNFRQRVSLTRDRDLFTAHMDIRGLTQGDTATYFCARQKFERGGQGWIFDLWGRGTLIAVSS

SEQ ID NO: 3949 - protein, 125 aa, Artificial Sequence
  anti-HIV-1_HeavyChain
QAHLEQSGSGVKKLGASVRVSCWTSEDVFERTELIHWVRQAPGQGLEWIGWVKAVSGAVNYGSLDFRHRVSLTRDRDLFTAHMDIRGLTQDDTATYFCARQKFYAGGQGWYFDLWGRGTLIVVSS

SEQ ID NO: 3950 - protein, 125 aa, Artificial Sequence
  anti-HIV-1_HeavyChain
RHTWEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFERGGQGWYFDLWGRGTLIVVSS

SEQ ID NO: 3951 - protein, 125 aa, Artificial Sequence
  anti-HIV-1_HeavyChain
RHTWEQSGSGVKRPGASVRVSCWTSEDIFETTELIHWVRQAPGQGLEWIGWVKTVSGAVNFGSLNFRHRVSLTRDRDLSTAHMDIRGLTQDDTATYFCARQKFARGDQGWFFDLWGRGTLIVVSS

SEQ ID NO: 3952 - protein, 127 aa, Artificial Sequence
  anti-HIV-1_HeavyChain
QVFMEQAGAGMKKPGASMTVSCKTADEDVFDAAYMHWVRQAPGQTFEWLGWMKPVTGAVNYARQFQGRVSFYRTRELGIAYMDLRDLKFDDTAVYFCARKTKGDVSGDDRGFFFDLWGRGTRVIVSS

SEQ ID NO: 3953 - protein, 128 aa, Artificial Sequence
  anti-HIV-1_HeavyChain
QVHLEQSGSGVKKPGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3954 - protein, 139 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSASTKGPSVFPTICV

SEQ ID NO: 3955 - protein, 139 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLIVVSSASTKGPSVFPTICV

SEQ ID NO: 3956 - protein, 139 aa, Artificial Sequence
  anti-HIV-1_HeavyChain
QAHLEQSGSGVKKLGASVRVSCWTSEDVFERTELIHWVRQAPGQGLEWIGWVKAVSGAVNYGSLDFRHRVSLTRDRDLFTAHMDIRGLTQDDTATYFCARQKFYAGGQGWYFDLWGRGTLIVVSSASTKGPSVFPHDLR

SEQ ID NO: 3957 - protein, 125 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYFCARQKFERGGQGWYFDLWGRGTLIVVSS

SEQ ID NO: 3958 - protein, 128 aa, Artificial Sequence
  anti-HIV-1_HeavyChain
QAHLEQSGSGVKKLGASVRVSCWTSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSS

SEQ ID NO: 3959 - protein, 142 aa, Artificial Sequence
  anti-HIV-1_HeavyChain
QAHLEQSGSGVKKPGASVRVSCWSSEDIFERTELIHWVRQAPGQGLEWIGWVKTVTGAVNFGSLDFRHRISLTRDRDLFTAHMDIRGLTQGDTATYFCARQKFESRYTGGQGWYFDLWGRGTHIVVSSASTKGPSVFPTICV

SEQ ID NO: 3960 - protein, 125 aa, Artificial Sequence
  anti-HIV-1_HeavyChain
QAHLEQSGSGVKKPGTSVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGRGTLIVVSS

SEQ ID NO: 3961 - protein, 127 aa, Artificial Sequence
  anti-HIV-1_HeavyChain
QVQLVQSGAEVKKPGASVKVSCKASGYTYTTYGVSWLRQVPGQRPEWMGWIRPKTGARNQARQFQPRISLTRDRALSTAYLDLNSLTSADSGTYFCARQTFKPDFYFADQGWSFNLWGRGAHFIVSS

SEQ ID NO: 3962 - protein, 128 aa, Artificial Sequence
  anti-HIV-1_HeavyChain
RAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFESRYTGGQGWYFDLWGRGTHITVSS

SEQ ID NO: 3963 - protein, 125 aa, Artificial Sequence
  anti-HIV-1_HeavyChain
QAHLEQSGSGVKKPGASVRVSCWTSEDIFERTELIHWVRQAPGQGLEWIGWVKIVSGAVNFGSPNFRQRVSLTRDRDLFTAHMDIRGLTQGDTATYYCARQKFERGGQGWIFDLWGRGTLIAVSS

SEQ ID NO: 3964 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYFCARQKFARGDQGWFFDLWGHGTLIVVSS

SEQ ID NO: 3965 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFERGGQGWYFDLWGHGTLIVVSS

SEQ ID NO: 3966 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDGDLFTAHMDIRGLTQGDTATYFCARQKFYAGGQGWYFDLWGRGTLIIVSS

SEQ ID NO: 3967 - protein, 124 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGHQISDRVSLTRDRDLFTAHMDIRGLTQGDTATYFCARQKFYAGGQGWYFDLWGHGTLIVVSS

SEQ ID NO: 3968 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDTATYFCARQKFERGGQGWYFDLWGHGTLIVVSS

SEQ ID NO: 3969 - protein, 125 aa, Artificial Sequence
  anti-HIV-1_HeavyChain
QAHLEQSGAGVKKPGASVRVSCWTSEDIFERTELIHWVRQAPGQGLEWIGWVKTVSGAVNFGSPNFRHRVSLTRDRDLFTAHMDIRGLTQGDTATYYCARQKFERGGQGWYFDLWGRGTLIVVSS

SEQ ID NO: 3970 - protein, 125 aa, Artificial Sequence
  anti-HIV-1_HeavyChain
QAHLEQSGSGVKKLGASVRVSCWTSEDIFERTELIHWVRQAPGRGLEWIGWVKAVSGAVNYGSLDFRHRVSLTRDRDLFTAHMDIRGLTQDDTATYYCARQKFERGGQGWIFDLWGRGTLIAVSS

SEQ ID NO: 3971 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYYCARQKFYAGGQGWYFDLWGRGTLIVVSS

SEQ ID NO: 3972 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYFCARQKFYKGGQGWYFDLWGRGTLIVVSS

SEQ ID NO: 3973 - protein, 124 aa, Artificial Sequence
  anti-HIV-1_HeavyChain
YVELGTNTGPEVRKPGASVKISCKTSGYIFTDNYFHWLRQAPAVGLEWMGWINSHNGYTKSAKKFQGRITMTRDTAVDTAYMELIDLTSDDTATYYCARQKFYAGGQGWYFDLWGCGTLIVVSS

SEQ ID NO: 3974 - protein, 125 aa, Artificial Sequence
  anti-HIV-1_HeavyChain
QAHLEQSGSGVKKPGASVRVSCWTSEDIFEKSELIHWVRQAPGQGLEWIGWVKTVTGAVNFGSSDFRQRVSLTRDRDLFTAHMDIRGLTQGDTATYFCARQKFYAGGQGWYFDLWGRGTLICVSS

SEQ ID NO: 3975 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSSDFRQRVSLTRDRDLFTAHMDIRGLTQGDTATYYCARQKFYAGGQGWYFDLWGRGTLIVVSS

SEQ ID NO: 3976 - protein, 125 aa, Artificial Sequence
  anti-HIV-1_HeavyChain
QAHLEQSGSGVKKPGASVRVSCWTSEDIFERTELIHWVRQAPGQGLEWIGWVKPVTGAVNFGSPNFRHRVSLTRDRDLFTAHMDIRGLTQGDTATYFCARQKFERGGQGWYFDLWGRGTLIVVSS

SEQ ID NO: 3977 - protein, 125 aa, Artificial Sequence
  anti-HIV-1_HeavyChain
QVQLVQSGAEVKKPGASVRVSCWTSEDIFEKSELIHWVRQAPGQGLEWIGWVKTVTGAVNFGSSDFRQRVSLTRDRDLFTAHMDIRGLTQGDTATYYCARQKFERGGQGWYFDLWGRGTLIVVSS

SEQ ID NO: 3978 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLSTAHMDIRGLTQDDTATYSCARQKFARGDQGWFFDLWGRGTLIVVSS

SEQ ID NO: 3979 - protein, 125 aa, Artificial Sequence
  anti-HIV-1_HeavyChain
QAHLEQSGSGVKKPGTSVRVSCWTSEDIFERTELIHWVRQAPGQGLEWIGWVKTVTGAVNFGSPNFRHRVSLTRDRDLFTAHMDIRGLTQGDTATYYCARQKFERGGQGWYFDLWGRGTLIVVSS

SEQ ID NO: 3980 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGTVNFGSLNFRQRVSLTRDRDLFTAHMDIRGLTQGDTATYFCARQKFARGDQGWFFDLWGHGTLIVVSS

SEQ ID NO: 3981 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDPFTAHMDIRGLTQGDTATYFCARQKFERGGQGWYFDLWGHGTLIVVSS

SEQ ID NO: 3982 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDICGLTQGDTATYFCARQKFERGGQGWYFDLWGHGTLIVVSS

SEQ ID NO: 3983 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRQRVSLTRDRDLFTAHMDIRGLTQGDTATYYCARQKFYAGGQGWYFDLWGRGTLIVVSS

SEQ ID NO: 3984 - protein, 124 aa, Artificial Sequence
  anti-HIV-1_HeavyChain
QAHLEQSGSGVKKPGASVRVSCWTSEDIFKSELIHWVRQAPGQGLEWIGWVKTVTGAVNFGSSDFRQRVSLTRDRDLFTAHMDIRGLTQGDTATYFCARQKFYAGGQGWYFDLWGHGTLIVVSS

SEQ ID NO: 3985 - protein, 125 aa, Artificial Sequence
  anti-HIV-1_HeavyChain
QAHLEQSGSGVKKPGTSVRVSCWTSEDIFERTELIHWVRQAPGQGLEWIGWVKTVTGAVNFGSPNFRHRVSLTRDRDLFTAHMDIRGLTQGDTATYFCARQKFARGDQGWFFDLWGHGTLIVVSS

SEQ ID NO: 3986 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQDDTATYYCARQKFARGDQGWFFDLWGRGTLIVVSS

SEQ ID NO: 3987 - protein, 127 aa, Artificial Sequence
  anti-HIV-1_HeavyChain
QVQLVQSGAEVKKPGASVKVSCKASGYTFTDYYLHWVRQAPGQGLDWVGWINPNSGGTNYAQKFQGRVAMTRDTSLSSVYLDLNSLTSADSGTYFCARQTFKPDFYFADQGWSFNLWGQGSHFIVSS

SEQ ID NO: 3988 - protein, 125 aa, Artificial Sequence
  anti-HIV-1_HeavyChain
QAHLEQSGSGVKKPGASVRVSCWTSEDIFEKSELIHWVRRAPGQGLEWIGWVKTVTGAVNFGSSDFRQRVSLTRDRDLFTAHMDIRGLTQGDTATYYCARQKFYAGGQGWYFDLWGRGTLIVVSS

SEQ ID NO: 3989 - protein, 124 aa, Artificial Sequence
  anti-HIV-1_HeavyChain
QAHLEQSGSGVKKPGASVTVSCWTSEDIFEKSELIHWVRQAPGQGLEWIGWVKTVTGAVNLVYQISDRVSLTRDRGLFTAHMDIRGLTQGDTATYYCARQKFYAGGQGWYFDLWGRGTLIVVSS

SEQ ID NO: 3990 - protein, 125 aa, Artificial Sequence
  anti-HIV-1_HeavyChain
QAHLEQSGSGVKKPGASVRVSCWTSEDIFEGSELIHWVRQAPGQGLEWIGWVKTVTGAVNFGSAYFRHRVSLTRDRDLFTAHMDIRGLTQGDTATYFCARQKFYKGGQGWYFDLWGHGTLIVVSS

SEQ ID NO: 3991 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNYGSLNFRSRISLTRDRDLFTAHMDIRGLTEGDTATYFCARQKFYAGGQGWYFDLWGHGTLIVVSS

SEQ ID NO: 3992 - protein, 125 aa, Artificial Sequence
  anti-HIV-1_HeavyChain
QAHLEQSGSGVKKPGASVRVSCWTSEDIFERTELIHWVRQAPGQGLEWIGWVKTVSGAVNFGSPNFRHRVSLTRDRDLFTAHMDIRGLTQGDMATYFCARQKFERGGQGWYFDLWGHGTLIVVSS

SEQ ID NO: 3993 - protein, 125 aa, Artificial Sequence
  anti-HIV-1_HeavyChain
QAHLEQSGSGVKEPGTSVRVSCWTSEDIFERTELIHWVRQAPGQGLEWIGWVKTVTGAVNFGSPNFRHRVSLTRDRDLFTAHMDIRGLTQGDTATYFCARQKFERGGQGWIFDLWGRGTLIAVSS

SEQ ID NO: 3994 - protein, 125 aa, Artificial Sequence
  anti-HIV-1_HeavyChain
QVQLEQSGSGVKKLGASVRVSCWTSEDIFGRTELIHWVRQAPGQGLEWIGWVKAVSGAVNYGSLDFRHRVSLTRDRDLFTAHMDIRGLTQDDTATYYCARQKFARGDQGWFFDLWGRGTLIVVSS

SEQ ID NO: 3995 - protein, 124 aa, Artificial Sequence
  anti-HIV-1_HeavyChain
QAHLEQSGSGVKKPGASVRVSCWTSDDIFKTELIHWVRQAPGQGLEWIGWVKTVTGAVNFGSPNFRQRVSLTRDRDLFTAHMDIRGLTQDDTATYFCARQKFARGDQGWFFDLWGRGTLIVVSS

SEQ ID NO: 3996 - protein, 125 aa, Artificial Sequence
  anti-HIV-1_HeavyChain
QAHLEQSGSGVKKPGASVRVSCWTSEDIFERTELIHWVRQAPGQGLEWIGWVKTVTGAVNFGSPNFRHRVSLTRDRDLFTAHMDIRGLTQGDTATYYCVRQKFERGGQGWYFDLWGRGTLIVVSS

SEQ ID NO: 3997 - protein, 125 aa, Artificial Sequence
  anti-HIV-1_HeavyChain
QVQLVQSGAEVKKPGASVKVSCWTSEDIFEKSELIHWVRQAPGQGLEWIGWVKTVTGAVNFGSSDFRQRVSLTRDRDLFTAHMDIRGLTQGDTATYYCARQKFYAGGQGWYFDLWGRGTLIVVSS

SEQ ID NO: 3998 - protein, 125 aa, Artificial Sequence
  anti-HIV-1_HeavyChain
QAHLEQSGSGVKKLGASVRVSCWTSEDIFERTELIHWVRQAPGQGLEWIGWVKAVSGAVNYGSLDFRHRVSLTRDRDLFTAHMDIRGLTQGDTATYFCARQKFYKGGQGWYFDLWGRGTLIVVSS

SEQ ID NO: 3999 - protein, 124 aa, Artificial Sequence
  anti-HIV-1_HeavyChain
QAHLEQSGSGVKKPGASVRVSCWTSEDIFEKSELIHWVRQAPGQGLEWIGWVKTVTGAVNFAHQISDRVSLTRDRDLFTAHMDIRGLTQGDTATYYCARQKFYAGGQGWYFDLWGRGTLIVVSS

SEQ ID NO: 4000 - protein, 125 aa, Artificial Sequence
  anti-HIV-1_HeavyChain
QAHLEQSGSGVKKPGASVRVSCWTSEDIFGRTELIHWVRQAPGQGLEWIGWVKTVSGAVNFGSPNFRHRVSLTRDRDLFTAHMDIRGLTQGDTATYFCARQKFERGGQGWYFDLWGRGTLICVSS

SEQ ID NO: 4001 - protein, 212 aa, Artificial Sequence
  anti-HIV_5CIN_LightChain
EIVLTQSPGTQSLSPGERATLSCRASQSVGNNKLAWYQQRPGQAPRLLIYGASSRPSGVADRFSGSGSGTDFTLTISRLEPEDFAVYYCQQYGQSLSTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNR

SEQ ID NO: 4002 - protein, 224 aa, Artificial Sequence
  anti-HIV_5CIN_HeavyChain
VQLVQSGAEVKRPGSSVTVSCKASGGSFSTYALSWVRQAPGRGLEWMGGVIPLLTITNYAPRFQGRITITADRSTSTAYLELNSLRPEDTAVYYCAREGTTGSGGKPIGAFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 4003 - protein, 226 aa, Artificial Sequence
  anti-HIV_5CIL_HeavyChain
VQLVQSGAEVKRPGSSVTVSCKASGGSFSTYALSWVRQAPGRGLEWMGGVIPLLTITNYAPRFQGRITITADRSTSTAYLELNSLRPEDTAVYYCAREGTTGDGDLGKPIGAFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 4004 - protein, 226 aa, Artificial Sequence
  anti-HIV_5CIP_A-Chain
VQLVQSGAEVKRPGSSVTVSCKASGGSFSTYALSWVRQAPGRGLEWMGGVIPLLTITNYAPRFQGRITITADRSTSTAYLELNSLRPEDTAVYYCAREGTTGWGWLGKPIGAFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEP

SEQ ID NO: 4005 - protein, 227 aa, Artificial Sequence
  anti-HIV_5CIP_HeavyChain
VQLVQSGAEVKRPGSSVTVSCKASGGSFSTYALSWVRQAPGRGLEWMGGVIPLLTITNYAPRFQGRITITADRSTSTAYLELNSLRPEDTAVYYCAREGTTGWGWLGKPIGAFAHWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKKVEPK

SEQ ID NO: 4006 - protein, 210 aa, Artificial Sequence
  anti-HIV_4JKP_LightChain
EIVLTQSPATLSLSPGETAIISCRTSQYGSLAWYQQRPGQAPRLVIYSGSTRAAGIPDRFSGSRWGADYNLSISNLESGDFGVYYCQQYEFFGQGTKVQVDIKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4007 - protein, 226 aa, Artificial Sequence
  anti-HIV_3TNN_E-Chain
EVQLVESGGGLVQPGGSLRLSCAASGFTFSTYAMSWVRQAPGKGLEWVSSINNSGRNTFSADSVKGRFTISRDNSKNTLFLVMNSLRAEDTAVYYCAKDLRLGGGSDYWGQGTLVTVSSASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKTH

SEQ ID NO: 4008 - protein, 235 aa, Artificial Sequence
  anti-HIV_3BQU_B-Chain
RITLKESGPPLVKPTQTLTLTCSFSGFSLSDFGVGVGWIRQPPGKALEWLAIIYSDDDKRYSPSLNTRLTITKDTSKNQVVLVMTRVSPVDTATYFCAHRRGPTTLFGVPIARGPVNAMDVWGQGITVTISSTSTKGPSVFPLAPSSKSTAGGAAALGCLVKDYFPEPVTVSWNSGALTSGVHTFPAVLQSSGLYSLSSVVTVPSSSLGTQTYTCNVNHKPSNTKVDKRVEPKSC

SEQ ID NO: 4009 - protein, 214 aa, Artificial Sequence
  anti-HIV_3BQU_A-Chain
ALQLTQSPSSLSASVGDRITITCRASQGVTSALAWYRQKPGSPPQLLIYDASSLESGVPSRFSGSGSGTEFTLTISTLRPEDFATYYCQQLHFYPHTFGGGTRVDVRRTVAAPSVFIFPPSDEQLKSGTASVVCLLNNFYPREAKVQWKVDNALQSGNSQESVTEQDSKDSTYSLSSTLTLSKADYEKHKVYECEVTHQGLSSPVTKSFNRGEC

SEQ ID NO: 4010 - protein, 129 aa, Artificial Sequence
  anti-HIV_IgG_VR-Chain
METPAQLLFLLLLWLPDTTGEIVLTQSPGTLSLSAGERATLSCRASQSVSSRYLAWYQQKPGQAPRLLIYGASSRATGIPDRFSGSGSGTDFTLTISRVEPEDFAGYYCQQYDNSVCTFGQGTKLEIKR

SEQ ID NO: 4011 - protein, 116 aa, Artificial Sequence
  anti-HIV_IgG_HeavyChain
MKHLWFFLLLVAAPRWVLSQVQLQESGPGLVKPSETLSLTCTVSGGSISSHYWSWIRQSPGKGLQWIGYIYYSGSTNYSPSLKSRVTISVETSKNQFSLKLTSMTAADTAVYYCAR

SEQ ID NO: 4012 - protein, 238 aa, Artificial Sequence
  anti-HIV_4P9M_HeavyChain
QIHLVQSGTEVKKPGSSVTVSCKAYGVNTFGLYAVNWVRQAPGQSLEYIGQIWRWKSSASHHFRGRVLISAVDLTGSSPPISSLEIKNLTSDDTAVYFCTTTSTYDKWSGLHHDGVMAFSSWGQGTLISVSAASTKGPSVFPLAPSSKSTSGGTAALGCLVKDYFPEPVTVSWNSGALTSGVHTFPAVLQSSGLYSLSSVVTVPSSSLGTQTYICNVNHKPSNTKVDKRVEPKSCDKT

SEQ ID NO: 4013 - protein, 215 aa, Artificial Sequence
  anti-HIV_4P9M_LightChain
DIQMTQSPSTLSASIGDTVRISCRASQSITGNWVAWYQQRPGKAPRLLIYRGAALLGGVPSRFSGSAAGTDFTLTIGNLQAEDFGTFYCQQYDTYPGTFGQGTKVEVKRTVAAPSVFIFPPSDEQLKSGTASVVCLLNNFYPREAKVQWKVDNALQSGNSQESVTEQDSKDSTYSLSSTLTLSKADYEKHKVYACEVTHQGLSSPVTKSFNRGEC

SEQ ID NO: 4014 - protein, 186 aa, Artificial Sequence
  anti-HIV_4P9H_C-Chain
KKVVLGKKGDTVELTCTASQKKSIQFHWKNSNQIKILGNQGSFLTKGPSKLNDRADSRRSLWDQGNFPLIIKNLTIEDSDTYICEVEDQKEEVQLLVFGLTANSDTHLLQGQSLTLTLESPPGSSPSVQCRSPRGKNIQGGKTLSVSQLELQDSGTWTCTVLQNQKKVEFKIDIVVLAFQKAIDGR

SEQ ID NO: 4015 - protein, 154 aa, Artificial Sequence
  anti-HIV_4YBL_A-Chain
VPVWKDADTTLFCASDAKAHETECHNVWATHACVPTDPNPQEIHLENVTENFNMWKNNMVEQMQEDVISLWDQCLQPGGAPKISFDPIPIHYCTPAGYVILKCNDKNFNGTGPCKNVSSVQCTHGIKPVVSSGGGNIKDNWRSELYKYKVVQIE

SEQ ID NO: 4016 - protein, 352 aa, Artificial Sequence
  anti-HIV_4R4N_V-Chain
IWKDANTTLFCASDAKAYDTEVHNVWATHACVPTDPSPQELKMENVTEEFNMWKNNMVEQMHTDIISLWDQSLKPCVQLTGGSALTQACPKVTFEPIPIHYCAPAGYAILKCNDKEFNGTGLCKNVSTVQCTHGIRPVVSTQLLLNGSLAEGKVMIRSENITNNVKNIIVQLNESVTINCTRPNNGGSGSGGDIRQAHCNVSGSQWNKTLHQVVEQLRKYWNNNTIIFNSSSGGDLEITTHSFNCGGEFFYCNTSGLFNSTWVNGTASIENGTITLPCRIKQIINMWQRVGQAIYAPPIQGVIRCVSNITGLILTRDGGGNSNENETFRPGGGDMRDNWRSELYKYKVVKIE

SEQ ID NO: 4017 - protein, 355 aa, Artificial Sequence
  anti-HIV_4JKP_G-Chain
VWKDADTTLFCASDAKAHETECHNVWATHACVPTDPNPQEIHLENVTENFNMWKNNMVEQMQEDVISLWDQCLQPCVKLTGGSVIKQACPKISFDPIPIHYCTPAGYVILKCNDKNFNGTGPCKNVSSVQCTHGIKPVVSTQLLLNGSLAEEEIIIRSENLTNNAKTIIVHLNKSVEINCTRPSNGGSGSGGDIRKAYCEINGTKWNKVLKQVTEKLKEHFNNKTIIFQPPSGGDLEITMHHFNCRGEFFYCNTTQLFNNTCIGNETMKGCNGTITLPCKIKQIINMWQGTGQAMYAPPIDGKINCVSNITGILLTRDGGANNTSNETFRPGGGNIKDNWRSELYKYKVVQIEGS

SEQ ID NO: 4018 - protein, 241 aa, Artificial Sequence
  anti-HIV_3BQU_D-Chain
MGWSWIFLFLLSGTAGVHSGVQLQQSGPELVKPGASVKMSCKASGYSFTDYFMHWVKQSHGKSLDWIGYINCYTGATNYSQKFKGKATFTVDTSSNTAYMQFNSLTSEDSAVYYCARTSIGYGSSPPFPYWGQGTLVTVSAAKTTPPSVYPLAPGSAAQTNSMVTLGCLVKGYFPEPVTVTWNSGSLSSGVHTFPAVLQSDLYTLSSSVTVPSSPRPSETVTCNVAHPASSTKVDKKIVPR

SEQ ID NO: 4019 - protein, 233 aa, Artificial Sequence
  anti-HIV_3BQU_C-Chain
MTMFSLALLLSLLLLCVSDSGAETTVTQSPASLSMSIGEKVTIRCITSTDIDDDMNWYQQKPGEPPRLLISDGNTLRPGVPSRFSSSGYGTDFVFTIENMLSEDVADYYCLQSDNLPYTFGGGTNLEIKRADAAPTVSIFPPSSEQLTSGGASVVCFLNNFYPKDINVKWKIDGSERQNGVLNSWTDQDSKDSTYSMSSTLTLTKDEYERHNSYTCEATHKTSTSPIVKSFNR

SEQ ID NO: 4020 - protein, 111 aa, Artificial Sequence
  anti-HIV_Ig_LightChain
DVVLTQSPASLAVSLGQRATISCKASQSVDYDGDSYMNWYQQKPGQPPKLLIHAASNLVSGMPARFSGSGSGTDFTLNIHPVEEEDAATYYCQQSIEDPPTFGGGTKLEIK

SEQ ID NO: 4021 - protein, 114 aa, Artificial Sequence
  anti-HIV_Ig_HeavyChain
DVQLQQSGPGLVKPSQSLSHTCTVTGYSITSDYAWNWIRQFPGNKLEWMGYISFSGSTSYNPSLKSRISITRDTSKNLFFLQLNSVTTEDTATYYCARGLPDYWGQGTTLTVSS

SEQ ID NO: 4022 - protein, 361 aa, Artificial Sequence
  anti-HIV_4P9H_G-Chain
VWKDADTTLFCASDAKAHETECHNVWATHACVPTDPNPQEIHLEQVTENFNMWKNNMVEQMQEDVISLWDQCLQPCVKLTGGSVIKQACPKISFDPIPIHYCTPAGYVILKCNDKNFNGTGPCKNVSSVQCTHGIKPVVSTQLLLNGSLAEEEIIIRSENLTNNAKTIIVHLQKSVEINCTRPSNGGSGSGGDIRKAYCEIQGTKWNKVLKQVTEKLKEHFNNKTIIFQPPSGGDLEITMHHFNCRGEFFYCNTTQLFQNTCIGNETMKGCNGTITLPCKIKQIINMWQGTGQAMYAPPIDGKINCVSQITGILLTRDGGANNTSNETFRPGGGNIKDNWRSELYKYKVVQIEGSHHHHHH

SEQ ID NO: 4023 - protein, 49 aa, Artificial Sequence
  anti-HIV_Chain
QVQLVQSGGQMKKPGESMRISCRASGYEFIDCTLNWIRLAPGKRPEWMG

SEQ ID NO: 4024 - protein, 60 aa, Artificial Sequence
  anti-HIV_Chain
PCCFAYIARPLPRAHIKEYFYTSGKCSNPAVVFVTRKNRQVCANPEKKWVREYINSLEMS

SEQ ID NO: 4025 - protein, 83 aa, Artificial Sequence
  anti-HIV_Chain
LEWMGRIIPAIDDVTYAQTFRGRVTFSADKFTTTAYMDLTGLRSEDTATYFCARDPQVNRRGNCFDHWGQGTLVTVSSASTKG

SEQ ID NO: 4026 - protein, 90 aa, Artificial Sequence
  anti-HIV_Chain
DVVMTQSPLSLPVTLGQPASISCRSSQSLVYSHGDTYLKCFQQRPGQSPRRPIYKVSNRDSGVPDRFSGSGSGTDFTLKISRVEAEDVGV

SEQ ID NO: 4027 - protein, 98 aa, Artificial Sequence
  anti-HIV_Chain
SSFAISWVRQAPGQGLEWMGGIIPIFEATSYAQKFQDRLTITTDESTTTAYMDLSSLRSEDTAVYYCARAQGDILTEGYFDYWGQGTLVTVSSASTKG

SEQ ID NO: 4028 - protein, 99 aa, Artificial Sequence
  anti-HIV_Chain
NTFTSHYVHWVRQAPGQGLEWMGMINPGGTTRYAPKFQDRVTLTRDTSTRTVYMELRSLRSEDTAVYYCARPQYNLGREPLNVWGQGTMVTVSSASTKG

SEQ ID NO: 4029 - protein, 99 aa, Artificial Sequence
  anti-HIV_Chain
IRSFYWHWIRQSPGKGLEWLGSVFDNGLTTHNPSLKSRLTISEDPSRNQISLKLRSMTAADTAVYYCARGDYDILTSSYQFDYWGQGTLVAVSSASTKG

SEQ ID NO: 4030 - protein, 100 aa, Artificial Sequence
  anti-HIV_Chain
QSALTQPAFVSGSPGQSITLSCTLGTEDVSWYQQRPNSAPRLIIFDVKKRPSDVSDRFSGHNSDTAAFLTISELRPEDEADYFCTSWPYRFDRGTKVDVA

SEQ ID NO: 4031 - protein, 100 aa, Artificial Sequence
  anti-HIV_Chain
QSALTQPAFVSGSPGQSITLSCTLGTEDVSWYQQRPNSAPRLIIFDVKKRPSDVSDRFSGHNSDTAAFLTISELRPEDEAEYFCTSWPYRFGRGTKVDVA

SEQ ID NO: 4032 - protein, 100 aa, Artificial Sequence
  anti-HIV_Chain
QSALTHPAFVSGSPGQSITLSCTLGTEDVSWYQQRPNSAPRLIIFDVRKRPSEVSDRFSGHKSDTAAFLTISDLRPEDEAEYFCTSWPYRFDRGTRLDVA

SEQ ID NO: 4033 - protein, 100 aa, Artificial Sequence
  anti-HIV_Chain
QSVLTQPAFVSGSPGQSITISCTVGTTDVSWYQQRPNSAPRLIIFDVKKRPSGVSDRFSGSSSDNAAFLTIAGLRPEDEAEYYCTSWPYRFGRGTKVDVG

SEQ ID NO: 4034 - protein, 100 aa, Artificial Sequence
  anti-HIV_Chain
QSVLTQPAFVSASPGQSITLSCNLGTDYVSWYQQRPSSAPRLIIFDVKNRPSGVSDRFSGYNSDTAAFLTISGLQPEDEAEYYCTSWPYNFGPGTKVDVT

SEQ ID NO: 4035 - protein, 100 aa, Artificial Sequence
  anti-HIV_Chain
QSVLTQPASVSGSPGQSINISCAGRSDRVSWYQQRPNGVPKLLLFDVYRRPSGVSDRFSGSHSDDTAFLTISGLQTDDEADYYCTSHPYAFGPGTKVNVL

SEQ ID NO: 4036 - protein, 100 aa, Artificial Sequence
  anti-HIV_Chain
QSVLTQPAFVSGSPGQSITLSCTLGTEDVSWYQQRPNSAPRLIIFDVKKRPSDVSDRFSGHNSDTAAFLTISELRPEDEAEYFCTSWPYRFGRGTKVDVA

SEQ ID NO: 4037 - protein, 102 aa, Artificial Sequence
  anti-HIV_Chain
QSALTQPASVSGSPGQSITISCTADSDYVSWYQQRPNSAPKLILFDVNSRPSGVSDRYSGSRSGNTASLTISGLQREDEADYFCTPWPYDFRPGTRVFVLGQ

SEQ ID NO: 4038 - protein, 102 aa, Artificial Sequence
  anti-HIV_Chain
QSALTQPAFVSGSPGQSITLSCSLGTADVSWYQQRPNSAPRLIIFDVKKRPSDVSDRFSGHNSDTAAFVTISELRPEDEAEYFCTSWPYRFGPGTKVDVARQ

SEQ ID NO: 4039 - protein, 102 aa, Artificial Sequence
  anti-HIV_Chain
QSVLTQPASVSGSPGQTISISCSGTFGSDSVSWYQQFPNSAPTLIIFDVHRRPSGISTRFSGSTSGDTASLTISTLHREDEAFYYCTSHPYDFGGGTYVIVL

SEQ ID NO: 4040 - protein, 102 aa, Artificial Sequence
  anti-HIV_Chain
QSVLTQPASVSGSPGQTISISCSGTFGSDSVSWYQQYPNSAPTLIIFDVHRRPSGISTRFSGSTSGDTASLTISTLHREDEAYYYCTSHPYDFGGGTYVIVL

SEQ ID NO: 4041 - protein, 102 aa, Artificial Sequence
  anti-HIV_Chain
QSALTQPASVSGSPGQSINISCAGRSDRVSWYQQRPNGVPKLLMFDVYRRPSGVSDRFSGSHSGDTAFLTISGLQTEDEADYYCTSHPYAFGAGTKVNVLRQ

SEQ ID NO: 4042 - protein, 102 aa, Artificial Sequence
  anti-HIV_Chain
DIQMTQSPSSLSASVGDRVSIHCQAGQGIGSSLNWYQQKPGRAPRLLVHGASNLQRGVPSRFSGSGFHTTFTLTISSLQPDDVATYWCAALEFFGPGTKVEI

SEQ ID NO: 4043 - protein, 103 aa, Artificial Sequence
  anti-HIV_Chain
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVA

SEQ ID NO: 4044 - protein, 103 aa, Artificial Sequence
  anti-HIV_Chain
DIQMTQSPSSLSARVGDTVTITCQANGYLNWYQQRRGKAPKLLIYDGSKLERGVPARFSGRRWGQEYNLTINNLQPEDVATYFCQVYEFIVPGTRLDLKRTVA

SEQ ID NO: 4045 - protein, 103 aa, Artificial Sequence
  anti-HIV_Chain
DIQMTQSPSSLSARVGDTVTITCQANGYLNWYQQRRGKAPKLLIYDGSKLERGVPSRFSGRRWGQEYNLTINNLQPEDIATYFCQVYEFAVPGTRLDLKRTVA

SEQ ID NO: 4046 - protein, 103 aa, Artificial Sequence
  anti-HIV_Chain
DIQMTQSPSSLSASVGDTVTITCQANGYLNWYQQRRGKAPKLLIYDGSKLERGVPSRFSGRRWGQEYNLTINNLQAEDIATYFCQVYEFAVPGTRLDLKRTVA

SEQ ID NO: 4047 - protein, 103 aa, Artificial Sequence
  anti-HIV_Chain
DIQMTQSPSSLSASVGDTVTITCQANGYLNWYQQRRGKAPKLLIYDGSKLERGVPSRFSGRRWGQEYNLTINNLQPEDIATYFCQVYEFIVPGTRLDLKRTVA

SEQ ID NO: 4048 - protein, 103 aa, Artificial Sequence
  anti-HIV_Chain
DIQMTQSPSSLSARVGDTVTITCQANGYLNWYQQRRGKAPKLLIYDGSKLETGVPSRFTGRRWGQEYNLTINNLQPEDIATYFCQVYEFIVPGTRLDLKRTVA

SEQ ID NO: 4049 - protein, 104 aa, Artificial Sequence
  anti-HIV_Chain
DIQMTQSPSSLSASVGDKVTITCQTSAGYLNWYQQRRGRAPKLLMYDGSRLVTGVPSRFSGRRWGTQYNLTIGSLQPEDVATYYCQVYEFFGPGTRLDLKRTVA

SEQ ID NO: 4050 - protein, 104 aa, Artificial Sequence
  anti-HIV_Chain
DIQMTQSPSSLSASVGDKVTITCQTSAGYLNWYQQRRGRAPKLLMYDGSRLVTGVPSRFSGRRWGTQYNLTIGSLQPEDIATYYCQVYEFFGPGTRLDLKSTVA

SEQ ID NO: 4051 - protein, 104 aa, Artificial Sequence
  anti-HIV_Chain
DIQMTQSPSSLSARVGDTVTITCQANGYLNWYQQRRGKAPKLLIYDGSKLERGVPARFSGRRWGQEYNLTINNLQPEDVATYFCQVYEFIVPGTRLDLKRTVAA

SEQ ID NO: 4052 - protein, 104 aa, Artificial Sequence
  anti-HIV_Chain
CTVSGGSIISYYWNWIRQSPGKGLEWLGYIFDGGRANYNPSLRSRLTMSVDTSKNQISLKVKSVTAADSAIYYCARLDGEAFRYYFDSWGQGTLVTVSSASTKG

SEQ ID NO: 4053 - protein, 104 aa, Artificial Sequence
  anti-HIV_Chain
VSGGRFSNYGLSWVRQAPGQGLEWMGRIVPAINRAKYAQKFQGRVILTADKITDTAYMELRSLRSEDTAIFYCARDPQIEIRGNAFDIWGQGTVVTVSSASTKG

SEQ ID NO: 4054 - protein, 105 aa, Artificial Sequence
  anti-HIV_Chain
SDISVAPGETARISCGEKSLGSRAVQWYQHRAGQAPSLIIYNNQDRPSGIPERFSGSPDSPFGTTATLTITSVEAGDEADYYCHIWDSRVPTKWVFGGGTTLTVL

SEQ ID NO: 4055 - protein, 105 aa, Artificial Sequence
  anti-HIV_Chain
SSMSVSPGETAKISCGKESIGSRAVQWYQQKSGQPPSLIIYNNQDRPSGVPERFSATPDFGAGTTATLTITNVEADDEADYYCHIYDARGGTNWVFDRGATLTVL

SEQ ID NO: 4056 - protein, 105 aa, Artificial Sequence
  anti-HIV_Chain
SFVSVAPGQTARITCGEESLGSRSVIWYQQRPGQAPSLIIYNNNDRPSGIPERFSGSPGSTFGTTATLTITSVEAGDEADYYCHIWDSRRPTNWVFGEGTTLTVL

SEQ ID NO: 4057 - protein, 105 aa, Artificial Sequence
  anti-HIV_Chain
SFVSVAPGQTARITCGEESLGSRSVIWYQQRPGQAPSLIMYNNHDRPSGIPERFSGSPGSTFGTTATLTITSVEAGDEADYYCHIWDSRRPTNWVFGEGTTLTVL

SEQ ID NO: 4058 - protein, 105 aa, Artificial Sequence
  anti-HIV_Chain
DIQMTQSPSSLSASVGDKVTITCQTSAGYLNWYQQRRGRAPKLLMYDGSRLVTGVPSRFSGRRWGTQYNLTIGSLQPEDIATYYCQVYEFFGPGTRLDLKSTVAA

SEQ ID NO: 4059 - protein, 105 aa, Artificial Sequence
  anti-HIV_Chain
DIQMTQSPSSLSASVGDRVSINCQAGQGLGSSLNWYQQKPGRAPKLLVHGASNLQRGVPSRFSGSGFHTTFTLTISSLQPDDVATYFCAAFQWFGPGTKVEIKRT

SEQ ID NO: 4060 - protein, 106 aa, Artificial Sequence
  anti-HIV_Chain
CTVSGGSISSAGYYWTWIRQHPGKGLEFIGYIYYIGTTYYNPSLKSRLTISIDTSKNQFSLKLSSVTAADTAIYYCARDYTARGRHFFDYWGQGALVTVSSASTKG

SEQ ID NO: 4061 - protein, 107 aa, Artificial Sequence
  anti-HIV_Chain
SSLPLSLAPGATAKIPCGEKSRGSRAVQWYQQKPGQAPTLIIYNNQDRPAGVSERYSGNPDVAIGVTATLTISRVEAGDEAEYYCHYWDSRSPISWVFGGWTQLTVL

SEQ ID NO: 4062 - protein, 107 aa, Artificial Sequence
  anti-HIV_Chain
SSLPLSVAPGATAKIACGEKSFASRAVQWYQQKPGQAPVLIIYNNQDRPAGVSERFSGTPDVGFGSTATLTISRVEAGDEADYYCHKWDSRSPLSWVFGGGTQLTVL

SEQ ID NO: 4063 - protein, 107 aa, Artificial Sequence
  anti-HIV_Chain
DIQMTQSPSSLSASIGDRVTITCRASQDIANYLNWYQKKSGTPPKLLIFAATNLHRGVSPRFTGSGHGTHFSLTITNVQHEDFGNYFCQQSFATVGSFGQGTWVDIR

SEQ ID NO: 4064 - protein, 107 aa, Artificial Sequence
  anti-HIV_Chain
DIQMTQSPSSLSASIGDRVTITCRASQDIANYLNWYQKKSGTPPKLLIFAATNLHRGVSPRFTGSGHGTHFSLTITNVQHEDFGHYFCQQSFATVGSFGQGTWVDIR

SEQ ID NO: 4065 - protein, 107 aa, Artificial Sequence
  anti-HIV_Chain
DIQMTQSPSSLSASVGDRVTITCRASQDIANYLNWYQKKSGTPPKLLIFAATNLHRGVSPRFSGSGSGTHFSLTITNVQYEDFANYFCQHSFGTIGTFGQGTWVDIR

SEQ ID NO: 4066 - protein, 107 aa, Artificial Sequence
  anti-HIV_Chain
DIQMTQSPSSLSASIGDRVTITCRASQDIANYLNWYQKKSGTPPKLLIFGATNLHHGVSPRFSGSGHGTHFSLTITNVQHEDFANYFCQQSFQTVGSFGQGTWVDIR

SEQ ID NO: 4067 - protein, 107 aa, Artificial Sequence
  anti-HIV_Chain
EIVLTQSPATLSLSPGETAIISCRTSQSGSLAWYQQRPGQAPRLVIYSGSTRAAGIPDRFSGSRWGADYNLSISNLESGDFGVYYCQQYEFFGQGTKVQVDIKRTVA

SEQ ID NO: 4068 - protein, 107 aa, Artificial Sequence
  anti-HIV_Chain
DIQMTQSPSSLSASIGDRVNITCQASRDTGSALNWYQQKVGRPPRLLISAVSNLGAGVPSRFSGRRSGTQSTLTINTLQPEDIATYFCQHYEFFGPGTKVDIKRTVA

SEQ ID NO: 4069 - protein, 107 aa, Artificial Sequence
  anti-HIV_Chain
DIQMTQSPSSLSASVGDRVTITCQAGQGIGSSLQWYQQKPGKAPKLLVHGASNLHRGVPSRFSGSGFHTTFSLTISGLQRDDFATYFCAVLEFFGPGTKVEIKRTVA

SEQ ID NO: 4070 - protein, 108 aa, Artificial Sequence
  anti-HIV_Chain
SYVRPLSVALGETASISCGRQALGSRAVQWYQHRPGQAPILLIYNNQDRPSGIPERFSGTPDINFGTRATLTISGVEAGDEADYYCHMWDSRSGFSWSFGGATRLTVL

SEQ ID NO: 4071 - protein, 108 aa, Artificial Sequence
  anti-HIV_LightChain
DILMTQSPSLLSASVGDRVTITCKASQDVSTAVAWYQQKPGKAPKLLIYWASTRHTGVPSRFTGSGSGTDFTLTISRLQAEDFALYYCQQHYTTPWTFGGGTKVEIKR

SEQ ID NO: 4072 - protein, 108 aa, Artificial Sequence
  anti-HIV_LightChain
DIVMTQSPSLLSASVGDRVTITCKASQDVSTAVAWYQQKPGKAPKLLIYWASTRHTGVPSRFSGSGSGTDFTLTISSLQPEDFALYYCQQHYTTPWTFGGGTKVEIKR

SEQ ID NO: 4073 - protein, 108 aa, Artificial Sequence
  anti-HIV_Chain
DIQMTQSPSSLSASVGDTVTINCQTNKGYLNWYQQRRGRAPKLLMYDGSKLVTGVPSRFSGRRWGTQYNLTIGSLQPEDIATYYCQVYEFFGPGTRLDLKRTVAAPSD

SEQ ID NO: 4074 - protein, 111 aa, Artificial Sequence
  anti-HIV_Chain
LSAYVGDRVTITCRASQNINTYLNWYQQRPGKAPKLLIYAASTLQSGVPSRFSGSGSGTDFTLTISNLETEDFAVYYCQQTYSSVTFGQGTKLETRRTVAAPSVFIFPPSD

SEQ ID NO: 4075 - protein, 111 aa, Artificial Sequence
  anti-HIV_Chain
EIVLTQSPATLSLSPGERATLSCRASQGVNFVVWYQQKRGQAPRLLIYGNSDRVPGVPDRFSARGSGTEFSLVISSVEPDDFALYYCQEYSSTPYNFGPGTRVDRKRTVAA

SEQ ID NO: 4076 - protein, 112 aa, Artificial Sequence
  anti-HIV_HeavyChain
EVKLEESGGGLVQPGGSRKLSCAASGFTFSSFGMHWVRQAPEKGLEWVAYISSGSSTLHYADTVKGRFTISRDNPKNTLFLQMKLPSLCYGLLGSRNLSHRLLSQNDTPICL

SEQ ID NO: 4077 - protein, 112 aa, Artificial Sequence
  anti-HIV_Chain
EIVLTQSPATLSLSPGERATLSCRASQGVNFVVWYQQKRGQAPRLLIYGPSDRAPGVPDRFSARGSGTEFSLVISSVEPDDFALYYCQEYSSTPYNFGTGTRVDRKRTVAAP

SEQ ID NO: 4078 - protein, 112 aa, Artificial Sequence
  anti-HIV_Chain
QTLSLTCSVSGGSISSAGYYWGWIRQHPGKGLEWIGHIYYSGNTNYNPSLKSRLSMSVETSKNQFSLNLASVTAADTAVYFCARDYSAAGRHLFDSWGQGILVTVSSASTKG

SEQ ID NO: 4079 - protein, 112 aa, Artificial Sequence
  anti-HIV_LightChain
DIVMTQQTPLTLSITIGQPASISCKSSQSLLDSDGKTYLNWLLQRPGQSPKRLIYWMSKLDSGVPDRFTGSGSGTDFTLKISRVEAEDLGVYYCWQGTHFPWTFGGGTKLEL

SEQ ID NO: 4080 - protein, 113 aa, Artificial Sequence
  anti-HIV_LightChain
DIVITQSTKFMSTSVGDRVSITCKASQDVSTAVAWYQQKPGQSPKLLIYWASTRHTGVPDRFTGSGSGTDYTLTISRVQAEDLALYYCQQHYTTPWTFGGGTKLEIKRTVAAP

SEQ ID NO: 4081 - protein, 113 aa, Artificial Sequence
  anti-HIV_Chain
DIQMTQSPSSLSARVGDTVTFTCQANGYLNWYQQRRGKAPKLLIYDGSKLERGVPSRFSGRRWGQEYNLTINNLQPEDIATYFCQVYEFAVPGTRLDLKRTVAAPSVFIFPSD

SEQ ID NO: 4082 - protein, 113 aa, Artificial Sequence
  anti-HIV_Chain
QSVLTQPASVSGSPGQSITISCTGTNSDVGYSYVSWFQQHPGKVPKLLIYDVSRRSSGVSNRFSGSRSGNTASLTISGLRAEDEADYYCGSFTTSLTLVFGGGTKLAVLVSPS

SEQ ID NO: 4083 - protein, 113 aa, Artificial Sequence
  anti-HIV_Chain
SLSASVGDRVTITCRASESISFYLNWYQQKPGKAPELLIFATSTLHSGVPSRFSGSGSGTDFTLTISSLQLEDFATYYCQQSSSTPFTFGGGTKVEIKRTVAAPSVFIFPPSD

SEQ ID NO: 4084 - protein, 114 aa, Artificial Sequence
  anti-HIV_Chain
DIQMTQSPSSLSASVGDTVTITCQANGYLNWYQQRRGKAPKLLIYDGSKLERGVPSRFSGRRWGQEYNLTINNLQPEDIATYFCQVYEFIVPGTRLDLKRTVAAPSVFIFPPSD

SEQ ID NO: 4085 - protein, 114 aa, Artificial Sequence
  anti-HIV_Chain
DIQMTQSPSSLSARVGDTVTITCQANGYLNWYQQRRGKAPKLLIYDGSKLERGVPSRFSGRRWGQEYNLTINNLQPEDIATYFCQVYEFAVPGTRLDLKRTVAAPSVFIFPPSD

SEQ ID NO: 4086 - protein, 114 aa, Artificial Sequence
  anti-HIV_Chain
DIQMTQSPSSLSARVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSD

SEQ ID NO: 4087 - protein, 114 aa, Artificial Sequence
  anti-HIV_Chain
DIQMTQSPSSLSARVGDTVTFTCQANGYLNWYQQRRGKAPKLLIYDGSKLERGVPSRFSGRRWGQEYNLTINNLQPEDIATYFCQVYEFAVPGTRLDLKRTVAAPSVFIFPPSD

SEQ ID NO: 4088 - protein, 114 aa, Artificial Sequence
  anti-HIV_Chain
DIQMTQSPSSLSASVGDTVTITCQANGYLNWYQQRRGKAPKLLMYDGSTLERGVPARFSGRRWGQEYNLTINNLQPEDVATYFCQVYEFIVPGTRLDLKRTVAAPSVFIFPPSD

SEQ ID NO: 4089 - protein, 114 aa, Artificial Sequence
  anti-HIV_Chain
DIQMTQSPSSLSASVGDTVTITCQANGYLNWYQQRRGKAPKLLIYDGSKLERGVPSRFSGRRWGQEYNLTINNLQAEDIATYFCQVYEFAVPGTRLDLKRTVAAPSVFIFPPSD

SEQ ID NO: 4090 - protein, 114 aa, Artificial Sequence
  anti-HIV_Chain
DIQMTQSPSSLSASVGDTVTFTCQANGYLNWYQQRRGKAPKLLIYDGSRLERGVPSRFSGRRWGQEYNLTINNLQPEDIATYFCQVYEFAVPGTRLDLKRTVAAPSVFIFPPSD

SEQ ID NO: 4091 - protein, 114 aa, Artificial Sequence
  anti-HIV_Chain
DIQMTHSPSSLSASVGDTVTITCQANGYLNWYQQRRGKAPKLLIYDGSKLETGVPSRFTGRRWGQEYNLTINNLQPEDIATYFCQVYEFIVPGTRLDLKRTVAAPSVFIFPPSD

SEQ ID NO: 4092 - protein, 114 aa, Artificial Sequence
  anti-HIV_Chain
DIQMTQSPSSLSARVGDTVTITCQANGYLNWYQQRRGKAPKLLIYDGSKLETGVPSRFTGRRWGQEYNLTINNLQPEDIATYFCQVYEFIVPGTRLDLKRTVAAPSVFIFPPSD

SEQ ID NO: 4093 - protein, 114 aa, Artificial Sequence
  anti-HIV_Chain
DIQMTQSPSSLSARVGDTVTFTCQANGYLNWYQQRRGKAPKLLIYDGSKLERGVPSRFSGRGWGQEYNLTINNLQPEDIATYFCQVYEFAVPGTRLDLKRTVAAPSVFIFPPSD

SEQ ID NO: 4094 - protein, 114 aa, Artificial Sequence
  anti-HIV_Chain
DIQMTQSPSSLSASVGDTVTITCQANGYLNWYQQRRGKAPKLLIYDGSKLERGVPSRFSGRRWGQEYNLTINNLQPEDIATYFCQVYEFVVPGTRLDLKRTVAAPSVFIFPPSD

SEQ ID NO: 4095 - protein, 114 aa, Artificial Sequence
  anti-HIV_Chain
SQSVVTQEPSLTVSPGGTVTLTCGPSTGAVTSGFYPHWFQQKPGQAPRALIYSTSNKYSWTPARFSGSLLGGKAVLTLSDVQPDDEAEYYCLLLLYYGGPWIFGGGTKLTVLVS

SEQ ID NO: 4096 - protein, 115 aa, Artificial Sequence
  anti-HIV_Chain
DIQMTQSPSSLSASVGDKVTITCQTSAGYLNWYQQRRGRAPKLLMYDGSRLVTGVPSRFSGRRWGTQYNLTIGSLQPEDVATYYCQVYEFFGPGTRLDLKRTVAAPSVFIFPPSD

SEQ ID NO: 4097 - protein, 115 aa, Artificial Sequence
  anti-HIV_Chain
DIQMTQSPSSLSASVGDTVTITCQTTKGYLNWYQQRRGRAPKLLMFDGSKLVTGVPSRFSGRRWGTQYNLTIGSLQPEDLATYYCQVYEFFGPGTRLDLKRTVAAPSVFIFPPSD

SEQ ID NO: 4098 - protein, 115 aa, Artificial Sequence
  anti-HIV_Chain
DIQMTQSPSSLSASVGDTVTITCQTNKGYLNWYQQRRGRAPKLLMCDGSKLVTGVPSRFSGRRWGTQYNLTIGSLQPEDIATYYCQVYEFFGPGTRLDLKRTVAAPSVFIFPPSD

SEQ ID NO: 4099 - protein, 115 aa, Artificial Sequence
  anti-HIV_Chain
DIQMTQSPSSLSARVGDKVTITCQTSAGYLNWYQQRRGRAPKLLMYDGSRLVTGVPSRFSGRRWGTQYNLTIGSLQPEDIATYYCQVYEFFGPGTRLDLKRTVAAPSVFIFPPSD

SEQ ID NO: 4100 - protein, 115 aa, Artificial Sequence
  anti-HIV_Chain
DIQMTQSPSSLSASVGDTVTITCQTNKGYLNWYQQKRGRAPKLLMYDGSKLVTGVPSRLSGRRWGTQYNLTIGSLQPEDIATYYCQVYEFFGPGTRLDLKRTVAAPSVFIFPPSD

SEQ ID NO: 4101 - protein, 115 aa, Artificial Sequence
  anti-HIV_Chain
DIQMTQSPSSLSASVGDTVTITCQTNKGYLNWYQQRRGRAPKLLMYDGSKLVTGVPSRLSGRRWGTQYNLTIGSLQPEDIATYYCQVYEFFGPGTRLDLKRTVAAPSVFIFPPSD

SEQ ID NO: 4102 - protein, 115 aa, Artificial Sequence
  anti-HIV_Chain
DIQMTQSPSSLSASVGDTVTITCHTNKGYLNWYQQRRGRAPKLLMFDGSKLVTGVPSRFSGRRWGTQYNLTIGSLQPEDIATYYCQVYEVFGPGTRLDLKRTVAAPSVFIFPPSD

SEQ ID NO: 4103 - protein, 115 aa, Artificial Sequence
  anti-HIV_Chain
DIQMTQSPSSLSASVGDTVTINCQTNKGYLNWYQQRRGRAPKLLMYDGSKLVTGVPSRFSGRRWGTQYNLTIGSLQPEDIATYYCQVYEFFGPGTRLDLKRTVAAPSVFIFPPSD

SEQ ID NO: 4104 - protein, 115 aa, Artificial Sequence
  anti-HIV_Chain
DIQMTQSPSSLSARVGDKVTITYQTSAGYLNWYQQRRGRAPKLLMYDGSRLVTGAPSRFSGRRWGTQYNLTIGSLQPEDIATYYCQVYEFFGPGTRLDLKRTVAAPSVFIFPPSD

SEQ ID NO: 4105 - protein, 115 aa, Artificial Sequence
  anti-HIV_Chain
DIQMTQSPSSLSASVGDTVTITCQTNKGYLNWYQQRRGRAPKLLMYDGSKLVTGVPSRFSGRRWGTQYNLTIGSLQPEDIATYYCQVYEFFGPGTRLDLKRTVAAPSVFIFPPSD

SEQ ID NO: 4106 - protein, 115 aa, Artificial Sequence
  anti-HIV_Chain
VTLSLSPGERATLSCRASQTISNNYLAWYQQKPGQAPRLLIYGASSGATGLPDRFSGSGSGTDFTLTISRLEPEDFAVYYCHQYALSPWTFGRGTKVEIKRTVAAPSVFIFPPSD

SEQ ID NO: 4107 - protein, 115 aa, Artificial Sequence
  anti-HIV_Chain
TLSASVGDRVTITCRASQSINNYLNWYQQKPGKAPKLLIYAASSLQSGVPSRFSGSGSGTDFTLTISSLQPEDFVTYYCQQTYSNPRMFGQGTKVEIKRTVAAPSVFIFPPSDEQ

SEQ ID NO: 4108 - protein, 115 aa, Artificial Sequence
  anti-HIV_Chain
QSALTQAPSASGTPGQRVTISCSGGGSNIGGNLVSWYQHFPGAAPKLLIYRNDQRPSGVPDRFSASKSGTSASLAISGLRSDDEATYFCAAYDSTLSLRLFGGGTTLAVLSQPKA

SEQ ID NO: 4109 - protein, 115 aa, Artificial Sequence
  anti-HIV_Chain
KPSQTLSLTCTVSGGSISSAGYYWTWIRHHPGKGLEFIGYIYHIGTPYYNPSLKSRLTISIDTSKNQFSLKLSSVTAADTAIYYCARDYTARGRHFFDYWGQGALVTVSSASTKG

SEQ ID NO: 4110 - protein, 115 aa, Artificial Sequence
  anti-HIV_Chain
PSETLSLTCRVSGASISNFYWTWIRQPAGKGLEWIGRLYSSDKTNYNPSLNGRVTMSLDTSKNQFSLRLTSMTDADTAIYYCAREKGQWVTLPPYYFDSWGQGILVTVSSASTKG

SEQ ID NO: 4111 - protein, 116 aa, Artificial Sequence
  anti-HIV_Chain
GPATLSVSPGERATLSCRASQSLRNNLAWYQQKTGQSPRLLIYAVSTRATGIPPRFSGGGSGTEFTLTIDSLQSEDFAVYFCQQYDSPQWTFGQGTKVEIKRTVAAPSVFIFPPSD

SEQ ID NO: 4112 - protein, 116 aa, Artificial Sequence
  anti-HIV_Chain
APVTLSASVGDTVTITCRASQPIATFLNWYQHKPGQAPKLLIYAASTFQRGAPSRYSGSGSGTDFTLTINSLQPEDLATYYCQQTFTDPVTFGQGTRLEIKRTVAAPSVFIFPPSD

SEQ ID NO: 4113 - protein, 117 aa, Artificial Sequence
  anti-HIV_LightChain
DIQMTQSPSTLSASIGDTVRISCRASQSITGGWLAWYHQRPGKAPRLLIYRGSRLLGGVPSRFSGSAAGTDFTLTIANLQAEDFGTFYCQQYDTYPGTFGQGTKVEVKRTVAAPSVF

SEQ ID NO: 4114 - protein, 117 aa, Artificial Sequence
  anti-HIV_LightChain
DIQMTQSPSTLSASIGDTVRISCRASQSITGNWVAWYQQRPGKAPRLLIYRGAALLGGVPSRFSGSAAGTDFTLTIGNLQTEDFGTFYCQQYDTYPGTFGQGTKVEVKRTVAAPSVF

SEQ ID NO: 4115 - protein, 117 aa, Artificial Sequence
  anti-HIV_LightChain
DIQMTQSPSTLSASIGDTVRISCRASQSITGNWVAWYQQRPGKAPRLLIYRGAALLGGVPSRFRGSAAGTDFTLTIGNLQAEDFGTFYCQQYDTYPGTFGQGTKVEVKRTVAAPSVF

SEQ ID NO: 4116 - protein, 117 aa, Artificial Sequence
  anti-HIV_LightChain
DIQMTQSPSTLSASVGDTVRISCRASQSITGGWLAWYHQRPGKAPRLLIYRGSRLLGGVPSRFSGSAAGTDFTLTIANLQAEDFGTFYCQQYDTYPGTFGQGTKVEVKRTVAAPSVF

SEQ ID NO: 4117 - protein, 117 aa, Artificial Sequence
  anti-HIV_LightChain
DIQMTQSPSTLSASIGDTVRISCRASQSITGNWVAWYQQRPGKAPRLLIYRGAALLGGVPSRFSGSAAGTDFTLTIGNLQAEDFGTFYCQQYDTYPGTFGQGTKVEVKRTVAAPSVF

SEQ ID NO: 4118 - protein, 117 aa, Artificial Sequence
  anti-HIV_LightChain
DIQMTQSPSTLSASIGDTVRISCRASQSITGGWVAWYHQRPGKAPRLLIYRGSRLLGGVPSRFSGSAAGTDFTLTIGNLQAEDFGTFYCQQYDTYPGTFGQGTKVEVKRTVAAPSVF

SEQ ID NO: 4119 - protein, 117 aa, Artificial Sequence
  anti-HIV_LightChain
DIQMTQSPSTLSASVGDTVRISCRASQSITGGWLAWYHQRPGKAPRLLIYRGSRLLGGVPSRFSGSAAGTGFTLTIANLQAEDFGTFYCQQYDTYPGTFGQGTKVEVKRTVAAPSVF

SEQ ID NO: 4120 - protein, 117 aa, Artificial Sequence
  anti-HIV_LightChain
DIQMTQSPSTLSASVGGTVRISCRASQSITGGWLAWYHQRPGKAPRLLIYRGSRLLGGVPSRFSGSAAGTDFTLTIANLQAEDFGTFYCQQYDTYPGTFGQGTKVEVKRTVAAPSVF

SEQ ID NO: 4121 - protein, 117 aa, Artificial Sequence
  anti-HIV_LightChain
DIQMTQSPSTLSASIGDTVRISCRASQSITGNWVAWYHQRPGKAPRLLIYRGAALLGGVPSRFSGSAAGTDFTLTIGNLQAEDFGTFYCQQYDTYPGTFGQGTKVEVKRTVAAPSVF

SEQ ID NO: 4122 - protein, 117 aa, Artificial Sequence
  anti-HIV_LightChain
DIQMTQSPSTLSASIGDTVMISCRASQSITGGWLAWYHQRPGKAPRLLIYRGSKLLGGVPSRFSGSAAGTGFTLTIGNLQAEDFGTFYCQQYDTYPGTFGQGTKVEVKRTVAAPSVF

SEQ ID NO: 4123 - protein, 117 aa, Artificial Sequence
  anti-HIV_LightChain
DIQMTQSPSTLSASVGDTVRISCRASQSITGGWLAWYHQRPGKAPRLLIYRGSRLLGGVPSRFSGSAAGADFTLTIANLQAEDFGTFYCQQYDTYPGTFGQGTKVEVKRTVAAPSVF

SEQ ID NO: 4124 - protein, 117 aa, Artificial Sequence
  anti-HIV_LightChain
DIQMTQSPSTLSASIGDTVRISCRASQSITGGWLAWYHQRPGKAPRLLIYRGSRLVGGVPSRFSGSAAGTDFTLTIGNLQAEDFGTFYCQQYDTYPGTFGQGTKVEVKRTVAAPSVF

SEQ ID NO: 4125 - protein, 117 aa, Artificial Sequence
  anti-HIV_LightChain
DIQMTQSPSTLSASIGDTVRISCRASQSITGGWLAWYHQRPGKAPRLLIYRGSRLLGGVPSKFSGSAAGTDFTLTIANLQAEDFGTFYCQQYDTYPGTFGQGTKVEVKRTVAAPSVF

SEQ ID NO: 4126 - protein, 117 aa, Artificial Sequence
  anti-HIV_LightChain
DIQMTQSPSTLSASTGDTVRISCRASQSITGNWVAWYQQRPGKAPRLLIYRGAALLGGVPSRFRGSAAGTDFTLTIGNLQAEDFGTFYCQQYDTYPGTFGQGTKVEVKRTVAAPSVF

SEQ ID NO: 4127 - protein, 117 aa, Artificial Sequence
  anti-HIV_LightChain
DIQMTQSPSTLSASIGDTVRISCRASQSITGNWLAWYHQRPGKAPRLLIYRGSRLLGGVPSRFSGSAAGTDFTLTIANLQAEDFGTFYCQQYDTYPGTFGQGTKVEVKRTVAAPSVF

SEQ ID NO: 4128 - protein, 117 aa, Artificial Sequence
  anti-HIV_Chain
IILFLVATATGSWAQSALTQPRSVSGSLGQSVTISCTGSSSDVGRYNYVSWYQHHPGKAPKLMISDVNKRPSGVPDRFSGSKSGNTASLTISGLQAEDETDYYCCSYAGSYIWVFGG

SEQ ID NO: 4129 - protein, 117 aa, Artificial Sequence
  anti-HIV_Chain
PVTLSASVGDRVTITCRASEDISKYLNWYQHKPGKAPKLLIYTASSLETGVPSRFSGSGSGTDFSLTISSLQPDDFATYYCQQSYTSSVTFGQGTRVEVKRTVAAPSVFIFPPSDEQ

SEQ ID NO: 4130 - protein, 117 aa, Artificial Sequence
  anti-HIV_Chain
VEEPGSSVKVSCKASGGSSTAYGYSWVRQAPGQGFEWMGRIIPFYGIITYAPKFQGRVTITADRSTSTVYMELTRLTFADTALFFCARDYGDPRNGYYFDSWDQGLWLTVSSASTKG

SEQ ID NO: 4131 - protein, 117 aa, Artificial Sequence
  anti-HIV_Chain
QVRLEQSGAAVRTPGASVTLSCQASGYKFVNYIIHWVRQRPGLAFEWVGMIDPYRGRPWSAHSFEGRLSLSRDVSMEILYMTLTSLRSDDTATYFCARAEAESQSHSRPIISTSGAR

SEQ ID NO: 4132 - protein, 117 aa, Artificial Sequence
  anti-HIV_Chain
VHLEVQLQQSGPELKKPGETVKISCKASVYTFTEYPIHWVKQAPGKGFKWMGWINTYSGEPTYADDFKGRFAFSLETSASTAYLQINSLKNEDTATYFCASLGRDYWGQGQGTTLTV

SEQ ID NO: 4133 - protein, 118 aa, Artificial Sequence
  anti-HIV_Chain
LSVSLGERATINCKSSQSILYSSDKKNYLAWYQQKIGQPPKLLLYWASTRESGIPDRFSGSGSGSDFTLTISSLQPEDVAVYYCQQYYISPFTFGPGTKVDLKRTVAAPSVFIFPPSD

SEQ ID NO: 4134 - protein, 118 aa, Artificial Sequence
  anti-HIV_Chain
QSVLTQPPSASGAPGQRVTISCSGGPSNVGGNYVYWYRQFPGTAPKLLILRDDQRPSGVPDRFSASKSGNSASLAISGLRPDDEAFYFCATYDSDGSIRLFGGGTALTVLSQPKAAPS

SEQ ID NO: 4135 - protein, 118 aa, Artificial Sequence
  anti-HIV_Chain
KAPATLSLSPGERATLSCRASQSVGSDLAWYQQKPGQAPRLLIYDASNRATAIPARFSGSGSGTDFTLSISSLEPEDFAVYFCQQRYDKITFGQGTRLEIQRTVAAPSVFIFPPSDEQ

SEQ ID NO: 4136 - protein, 118 aa, Artificial Sequence
  anti-HIV_Chain
QVQLVQSGAEAKRPGDSVKVSCKASGYTFTEYYIHWVRQTPGQGFEWMGIITPGAGNTTYAQKFQGRITVTRDTSAATVYMELSNLTSEDTAVYFCSRGVSFWGQGTLVTVSSASTKG

SEQ ID NO: 4137 - protein, 118 aa, Artificial Sequence
  anti-HIV_HeavyChain
EVKLQQSGAELVRPGASVKMSCKASGYRFTSYNMHWVKQTPRQGLEWIGAIYPGNGDTSYNQKFKGKATLTVDKSSSTAYMQLSSLTSEDSAVYFCARGRLSLGFDYWGQGSTLTVSS

SEQ ID NO: 4138 - protein, 119 aa, Artificial Sequence
  anti-HIV_Chain
QVQLVQSGTAVKRPGASVRVSCQASGYTFIDHFIYWWRQAPGQGLEWLGWINPLTSQPSYPSRFQGRLTLTRDTFDEMLYMDLRGLRSDDTGIYFCARRHSDYCDFDIWGSGTQIIVSS

SEQ ID NO: 4139 - protein, 119 aa, Artificial Sequence
  anti-HIV_Chain
QVQLVQSGTAVKRPGASVRVSCQASGYTFTDYFIYWWRQAPGQGLEWLGWINPLTSQPSYPSRFQGRLTLTRDTFDEMLYMDLRGLRSDDTGIYFCARRHSDYCDFDIWGSGTQIIVSS

SEQ ID NO: 4140 - protein, 119 aa, Artificial Sequence
  anti-HIV_Chain
QSVLTQPRSVSGSPGQSVTISCTGTSSDVGGYNYVSWYQQHPGKAPKTMIFDVTKRPSGVPDRFSGSKSGNTASLTISGLQAEDEADYYCSSYAGRNTFYVFGTGTTVTVQVSPSQPPP

SEQ ID NO: 4141 - protein, 119 aa, Artificial Sequence
  anti-HIV_Chain
EIVLTQSPGTLSLSPGERATLSCRASQSVSSNYLAWYQQKPGQAPRLLIYGASSRATGIPDRFSGSGSGTDFTLSISRLEPEDFAVYYCQQYGTSSCTFGQGTKLEIKRTVAAPSVFIF

SEQ ID NO: 4142 - protein, 119 aa, Artificial Sequence
  anti-HIV_Chain
LSASVGDRVTITCRASQSIDRYLNWYQQKPGKAPKLLIYAASSLHTDVPSRFSGSGAGTYFTLTITSLQPEDFATYYCQQSHSPSFGQESYSITFGQGTRLEIKRTVAAPSVFIFPPSD

SEQ ID NO: 4143 - protein, 119 aa, Artificial Sequence
  anti-HIV_Chain
NFMLTQAPSASGAPGQRVTISCSGGPSNVGGNYVYWYRQYPGTAPKLLILRDDQRPSGVPDRFSASKSGNSASLAISELRPDDEAFYFCATYDSDGSIRLFGGGTALTVLSQPKAAPSV

SEQ ID NO: 4144 - protein, 120 aa, Artificial Sequence
  anti-HIV_Chain
DIQMTQSPSSLSASIGDRVNITCQASRDTGSALNWYQQKVGRPPRLLISAVSNLGAGVPSRFSGRRSGTQSTLTINTLQPEDIATYFCQHYEFFGPGTKVDIKRTVAAPSVFIFPPSDEQ

SEQ ID NO: 4145 - protein, 120 aa, Artificial Sequence
  anti-HIV_Chain
QSVLTQPASVSGSPGQSITISCTGTSNDVGGQNFVSWYQQHPGTAPQLLIYDVTNRPAGVSSRFSGSKSGNTASLTISGLRTEDEADYYCASFTILNGVDYVFGTGTKVTVLLSPSQPYL

SEQ ID NO: 4146 - protein, 120 aa, Artificial Sequence
  anti-HIV_Chain
NFMLTQPASVSGSPGQSITLSCTGTTSDVRDSNFVSWYQQVPGKAPKLIIYDVSARPSGVSFRFSGSKSGNTASLTISGLQAEDEALYYCSSFTPTNTLVFGGGTKLTVLGQPKAAPSVT

SEQ ID NO: 4147 - protein, 120 aa, Artificial Sequence
  anti-HIV_Chain
QSALTQPPAASGAPGQRVTISCSGGGSNVGGNLVSWYQQFPGAAPKLILHRDGQRPSGVPDRFSASKSGTSASLTISGLRSDDEATYFCAAYDSAVSLPVFGGGTKLTVLSQPKAAPLVT

SEQ ID NO: 4148 - protein, 120 aa, Artificial Sequence
  anti-HIV_Chain
QLVLTQPPSVSGTPGQNVTISCSGGGSHVGGNLVSWYQHFPGAAPKLLIHRDNQRPSGVPDRFSALKSGNSASLAISGLRSDDEAFYFCAVYDSSLSLGLFGGGTKLTVLSQPKAAPSVT

SEQ ID NO: 4149 - protein, 120 aa, Artificial Sequence
  anti-HIV_Chain
DIQMTQSPSSLSASVGDRVSIHCQAGQGIGSSLKWYQQKSGRAPRLLVHGASNLQRGVPSRFSGSGFHTTFTLTISSLQPDDVATYWCAVLEFFGPGTKVEIKRTVAAPSVFIFPPSDEQ

SEQ ID NO: 4150 - protein, 120 aa, Artificial Sequence
  anti-HIV_Chain
DIQMTQSPSSLSASVGDRVTITCQASQGIGSSLQWYQQKPGRAPKLLVHGASNLHRGVPSRFSGSGFHTSFTLTISSLQPDDVATYFCAVLEFFGPGTKVEIKRTVAAPSVFIFPPSDEQ

SEQ ID NO: 4151 - protein, 120 aa, Artificial Sequence
  anti-HIV_Chain
DIQMTQSPSSLSASVGDRVSINCQAGQGIGSSLNWYQQKRGKAPKLLVHGASTLQRGVPSRFSGSGFHTTFTLTISSLQPDDVATYFCESFQWFGPGTKVEIKRTVAAPSVFIFPPSDEQ

SEQ ID NO: 4152 - protein, 120 aa, Artificial Sequence
  anti-HIV_Chain
YIQMTQSPSSLSASIGDRVTITCQAGQGIGSSLNWYQQKPGKAPKLLVHGASNLQRGVSSRFSGSGFHTTFTLTISSLRPEDVGTYFCEVYEFIGPGTKVDIKRTVAAPSVFIFPPSDEQ

SEQ ID NO: 4153 - protein, 120 aa, Artificial Sequence
  anti-HIV_Chain
DIQMTQSPSSLPASVGDTVTITCQAGQGIGSSLQWYQQRPGRAPNLLVYDASNLQRGVPSRFTGTGFHTTFTLTIRGLRPEDFGTYFCASLEFFGPGTKVDIKRTVAAPSVFIFPPSDEQ

SEQ ID NO: 4154 - protein, 120 aa, Artificial Sequence
  anti-HIV_Chain
DIQMTQSPSSLSASVGDRVTITCQASQGIGSSLQWYQQKPGRAPNLLVHGASNLHRGVPSRFSGSGFHTTFSLTISGLQRDDFATYFCAVLEFFGPGTKVDIKRTVAAPSVFIFPPSDEQ

SEQ ID NO: 4155 - protein, 120 aa, Artificial Sequence
  anti-HIV_Chain
DIQMTQSPSSLSVSVGDRVSITCRATQGIGNSLNWYQQKPGKAPKVLIYGTTKLHGGVPSRFSGGGSGSTGTLTIDSLQPEDIATYFCQLFEFFGPGTKVEIKRTVAAPSVFIFPPSDEQ

SEQ ID NO: 4156 - protein, 120 aa, Artificial Sequence
  anti-HIV_Chain
DIQMTQSPSSLSASVGDRVTITCQAGQGIGSSLNWYQQKPGRAPKLLVYGASNLQRGVPSRFSGSGFHTTFTLTISSLQPEDFATYFCSVYEFLGPGTKVEIKRTVAAPSVFIFPPSDEQ

SEQ ID NO: 4157 - protein, 120 aa, Artificial Sequence
  anti-HIV_Chain
PMFQPGQSGGVVVQSGESLHLSCEASGFKFASQMMHWVRHVPGRGLEWVALISWDGSGKLFADSVRGRFTIHRWNDRNSLYLDVKNVRPEDAAIYYCTRNGFDVWGQGILVTVSSASTKG

SEQ ID NO: 4158 - protein, 121 aa, Artificial Sequence
  anti-HIV_HeavyChain
EVKLVESGGGLVQPGGSLRLSCAASGFTFSSFGMHWVRQAPEKGLEWVAYISSGSSTLHYADTVKGRFTISRDNSKNSLYLQMNLLRAEDTAVYYCARGSRNLSHRLLSYWGQGTLVTVSS

SEQ ID NO: 4159 - protein, 121 aa, Artificial Sequence
  anti-HIV_HeavyChain
EVQLVESGGGLVQPGGSLRLSCAASGFTFSSFGMHWVRQAPGKGLEWVSYISSGSSTLHYADTVKGRFTISRDNSKNSLYLQMNSLRAEDTAVYYCARGSRNLSHRLLSYWGQGTLVTVSS

SEQ ID NO: 4160 - protein, 121 aa, Artificial Sequence
  anti-HIV_Chain
DIQMTQSPSSLSASVGDRVTITCQASQGISNSLNWYQQKPGKAPRLLIYGTSTLQRGVPSRFSGSGSGTRFTVTINSLQPEDIATYFCQHNEFFGRGTKVDIKRTVAAPSVFIFPPSDEQL

SEQ ID NO: 4161 - protein, 121 aa, Artificial Sequence
  anti-HIV_Chain
DIQMTQSPSSVSASVGDRVTITCQASRDTDNSLTWYQQKPGRPPKLLIYHVVNLGPGVPSRFSGSASSATQSTLIISDFQPDDVATYFCQNYEFFGPGTKVEIKRTVAAPSVFIFPPSDEQ

SEQ ID NO: 4162 - protein, 121 aa, Artificial Sequence
  anti-HIV_Chain
EIVLTQSPGTLSLSPGERATLSCRASQSVSSNNLAWYQQKPGQAPRLLMSGASSRATGIPDRFSGSGSGTDFTLTISRLEPEDFAVYHCQQYGSSPPTFGQGTKVEIKRTVAAPSVFIFPP

SEQ ID NO: 4163 - protein, 121 aa, Artificial Sequence
  anti-HIV_Chain
DIQMTQSPSSLSAYVGDRVTITCRASQNINTYLNWYQQRPGKAPKLLIYAASTLQSGVPSRFSGSGSGTDFTLTISNLETEDFAVYYCQQTYRSVTFGQGTKLEIKRTVAAPSVFIFPPSD

SEQ ID NO: 4164 - protein, 121 aa, Artificial Sequence
  anti-HIV_Chain
DIQMTQSPSSLSASVGDRVTITCQAGQGIGSSLQWYQQKPGKAPKLLVHGASNLHRGVPSRFSGSGFHTTFSLTISGLQRDDFATYFCAVVEFFGPGTKVDIKRTVAAPSVFIFPPSDEQL

SEQ ID NO: 4165 - protein, 121 aa, Artificial Sequence
  anti-HIV_Chain
QVQLVESGAELRKPGESLEISCKASGYSFSSHWIGWARQMPGKGLEWMGIIYPGDSNTIYSPSFQGQVTISADKSINTAYLQWSSLKASDTAMYFCASNYHDYFYWGQGTLVTVSSASTKG

SEQ ID NO: 4166 - protein, 121 aa, Artificial Sequence
  anti-HIV_Chain
FVQLVESGGGVVQPGTSLRLSCTTSGFIFSDYGMHWVRQAAGKGLEWVAVIWHDGSNRFYADSVKGRFTISRDNSKNAVYLEMNNLRVEDTALYYCARTSMDIDYWGQGTPVTVSSASTKG

SEQ ID NO: 4167 - protein, 121 aa, Artificial Sequence
  anti-HIV_Chain
EPMFQPGQSGGVVVQSGESLHLSCEASGFKFASQMMHWVRHVPGRGLEWVALISWDGSGKLFADSVRGRFTIHRWNDRNSLYLDVKNVRPEDAAIYYCTRNGFDVWGQGILVTVSSASTKG

SEQ ID NO: 4168 - protein, 122 aa, Artificial Sequence
  anti-HIV_Chain
SQHLVQSGTQVKKPGASVRISCQASGYSFTDYVLHWWRQAPGQGLEWMGWIKPVYGARNYARRFQGRINFDRDIYREIAFMDLSGLRSDDTALYFCARDGSGDDTSWHLDPWGQGTLVIVSA

SEQ ID NO: 4169 - protein, 122 aa, Artificial Sequence
  anti-HIV_Chain
DIQMTQSPSSLSASVGDRVTITCRASQSISRYLNWYQQKPGKAPKLLIYAASSLQGGVPSRFSGSGSGTDFTLTISSLQPEDFATYYCQQSSSKPFTFGGGTKVEIKRTVAAPSVFIFPPSD

SEQ ID NO: 4170 - protein, 122 aa, Artificial Sequence
  anti-HIV_Chain
EIVLTQSPGTLSLSPGERATLSCRASQSISSNYLAWYQQKPGQAPRLLIYGASTRATGIPDRFSGSGSGTDFTLSISRLEPEDIAVYYCHQYGSSQRFGQGTKVEIKRTVAAPSVFIFPPSD

SEQ ID NO: 4171 - protein, 122 aa, Artificial Sequence
  anti-HIV_Chain
EIVMTQSPATLSVSPGDRATLSCRASQSVSTNLAWYQQKPGQAPRLLIYGASTRATGIPATFSGSGFATEFTLTISSLQSEDFAVYYCQQYNNWPPAFGQGTKVEIKRTVAAPSVFIFPPSD

SEQ ID NO: 4172 - protein, 122 aa, Artificial Sequence
  anti-HIV_Chain
DIQMTQSPASLSASVGDRVTITCRASQGISHYLAWYQQKPGKVPRLLIYAASRLQSGVTSRFSGSGSGTEFTLTISSLLPEDAAVYFCQKYDTDPMTFGQGTRLEIKRTVAAPSVFIFPPSD

SEQ ID NO: 4173 - protein, 122 aa, Artificial Sequence
  anti-HIV_Chain
QSALTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLF

SEQ ID NO: 4174 - protein, 122 aa, Artificial Sequence
  anti-HIV_Chain
DIQMTQSPSSLSASVGDRVTINCQAGQGIGSSLNWYQKKPGRAPKLLVHGASNLQRGVPSRFSGSGFHTTFTLTISSLQPDDVATYFCAVFQWFGPGTKVDIKRTVAAPSVFIFPPSDEQLK

SEQ ID NO: 4175 - protein, 122 aa, Artificial Sequence
  anti-HIV_Chain
DIQMTQSPSSLSASVGDRVTITCQASQGIGSSLQWYQQKPGRAPNLLVHGASKLHRGVPSRFSGSGFHTTFSLTISGLQRDDFATYFCAVLEFFGPGTKVEIKRTVAAPSVFIFPPSDEQLK

SEQ ID NO: 4176 - protein, 122 aa, Artificial Sequence
  anti-HIV_Chain
QVHLVQSGAEVKKPGASVKVSCKVSGYTLSELSIHWVRQGPGRGLEWMANFDPEDGETIYAPQFQGRVTLTEDTSTDTAYMQLTSLRSEDTAVYYCATDRYTDTGRWGPGTLVTVSSASTKG

SEQ ID NO: 4177 - protein, 122 aa, Artificial Sequence
  anti-HIV_Chain
QVQLVESGGGLIQPGGSLRLSCEASGFAVGDINYMSWVRQAPGKGLEWVSVLYSGGSSQYADSVKGRFTISRDNSRNTLYLQMDNLRAEDTAVYYCARGLRVYFDLWGQGILVTVSSASTKG

SEQ ID NO: 4178 - protein, 122 aa, Artificial Sequence
  anti-HIV_Chain
QVQMVASGGGLVKPGGSLRLSCEASGFTFSDYYMSWVRQAPGKGLEWISYITSGGNALYYADSVKGRFTISRDNAKNSLYLQMNSLRAEDTAVYYCARDLLHAHDFGRQGTLVTVSSASTKG

SEQ ID NO: 4179 - protein, 122 aa, Artificial Sequence
  anti-HIV_Chain
QLQLVESGGGVVQPGRSLRLSCAASGFTFSTYTMHWVRQAPGKGLEWVAVISYDGTNKYYADSVKGRFTISRDNSKNTLYLQMNSLRGEDTAVYYCARSPSYYFDYWGQGTLVTVSAASTKG

SEQ ID NO: 4180 - protein, 123 aa, Artificial Sequence
  anti-HIV_Chain
QVHLSQSGAAVTKPGASVRVSCEASGYKISDHFIHWWRQAPGQGLQWVGWINPKTGQPNNPRQFQGRVSLTRQASWDFDTYSFYMDLKAVRSDDTAIYFCARQRSDFWDFDVWGSGTQVTVSS

SEQ ID NO: 4181 - protein, 123 aa, Artificial Sequence
  anti-HIV_Chain
QVQLLQSGAVVTKPGASVRVSCEASGYKIRDYFIHWWRQAPGQGLQWVGWINPQTGQPNIPRPFQGRVTLTRHASWDFDTFSFYMDLKALRSDDTAIYFCARRRSDYCDFDVWGSGTHVTVSS

SEQ ID NO: 4182 - protein, 123 aa, Artificial Sequence
  anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKGLRSDDTAIYFCARQRSDYWDFDVWGSGTQVTVSS

SEQ ID NO: 4183 - protein, 123 aa, Artificial Sequence
  anti-HIV_Chain
QVQLLQSGAAVTKPGASVRVSCEASGYNIRDYFIHWWRQAPGQGLQWVGWINPKTGQPNNPRLFQGRVSLTRHASWDFDTFSFYMDLKAVRSDDTAVYFCARQRSDYWDFDVWGSGTQVTVSS

SEQ ID NO: 4184 - protein, 123 aa, Artificial Sequence
  anti-HIV_Chain
QVRLLQSGAAVTKPGASVRVSCEASGYEIRDYFIHWWRQAPGQGLQWVGWINPKTGQPNNPRQFQGRVSLTRQASWDFDSYSFYMDLKALRSDDTGVYFCARQRSDYWDFDVWGSGTQVTVSS

SEQ ID NO: 4185 - protein, 123 aa, Artificial Sequence
  anti-HIV_Chain
QVQLLQSGAAVTKPGASVRVSCEASGYNIRDYFIHWWRQAPGQGLQWVGWINPKTGQPNNPRQFQGRVSLTRHASWDFDTFSFYMDLKALRSDDTAVYFCARQRSDYWDFDVWGSGTQVTVSS

SEQ ID NO: 4186 - protein, 123 aa, Artificial Sequence
  anti-HIV_Chain
EVQLVESGGGLIQRGGSLRLSCVASGFPVSDNHMSWVRQAPGKGLEWVSIIYSDGGTYYADSVKGRFTISRDNSKNTVYLQMNSLRATDTAVYYCARDPGFHYGLDVWGQGTTVTVSSASTKG

SEQ ID NO: 4187 - protein, 123 aa, Artificial Sequence
  anti-HIV_Chain
QVQLQESGPGLLRPLETLSLTCSVSGGSIRGYFWSWVRQPAGRGLEWIGRIYSSGTTRFNPSLKSRVRLSIDTAKSEVSLNITSVTAADSASYFCAGTSPVHGGLDLWGLGLRVTVSSASTKG

SEQ ID NO: 4188 - protein, 123 aa, Artificial Sequence
  anti-HIV_Chain
EIVLTQSPGTLSLSPGERATLSCRASQSVSSNLAWYAQKPGQAPRLIIYGASSRASAIPDRFRGSGSGTDFTLTISRLEPEDFAVYYCQQYDDAPITFGHGTRLEIKRTVAAPSVFIFPPSDE

SEQ ID NO: 4189 - protein, 123 aa, Artificial Sequence
  anti-HIV_Chain
EIVLTQSPGTLSLSPGDRAALSCRASETLSGNSLAWYQQKRGQPPRLLIFAASSRATGIPERFSGGGSGTDFTLTITRLEPEDFAVYFCQQYVDAPITFGQGTRLEIKRTVAAPSVFIFPPSD

SEQ ID NO: 4190 - protein, 123 aa, Artificial Sequence
  anti-HIV_Chain
DIQMTQSPSSLSASVGDRVTITCRASQDITTYLAWLQQKPGKAPKSLIYSASTVQSGVPSRFSGSGSGTEFTLTISGLQPEDFATYYCQQYNYYPITFGLGTRLEIKRTVAAPSVFIFPPSDE

SEQ ID NO: 4191 - protein, 123 aa, Artificial Sequence
  anti-HIV_Chain
DIQMTQSPSSLSASIGDRVTITCRANQHIRSFLNWYQQTPGKAPKLLIYAASTLQRGVPSRFSGSGSGTDFTLTITSLEREDLATYYCQQTYTSPITFGQGTRLEIKRTVAAPSVFIFPPSDE

SEQ ID NO: 4192 - protein, 123 aa, Artificial Sequence
  anti-HIV_Chain
SEIVLTQSPATLSLSPGESATLSCRASQSLSSSLAWYQQKPGQAPRLLIYDTSDRATGIPARFSGRGSGTDFTLTISSLEPEDFAVYYCQQRSNWAITFGQGTRLEIKRTVAAPSVFIFPPSD

SEQ ID NO: 4193 - protein, 123 aa, Artificial Sequence
  anti-HIV_Chain
QVLSVSGTPGQRVIISCSGTSSNVGGNLVSWYQHLPGAAPRLLIHRDDQRPSGVPDRFSGSKSGNSASLVISGLRSDDEADYFCAAYDSTFSLPVFGGGTRLTVLSQPKAAPSVTLYAPSSEE

SEQ ID NO: 4194 - protein, 123 aa, Artificial Sequence
  anti-HIV_Chain
DIQMTQSPSSLSASVGDRVTITCQAGQGIGSSLQWYQQKPGKAPKLLVHGASNLHRGVPSRFSGSGFHTTFSLTISGLQRDDFATYFCAVLEFFGPGTKVEIKRTVAAPSVFIFPPSDEQLKS

SEQ ID NO: 4195 - protein, 123 aa, Artificial Sequence
  anti-HIV_Chain
EIVLTQSPATLSLSPGERATLSCRASQGLNFVVWYQQKRGQAPRLLIHAPSDRAPGVPDRFSARGSGTDFSLVISSVEPDDFAIYYCQEYSSTPYNFGPGTRVDRKRTVAAPSVFIFPPSDEQ

SEQ ID NO: 4196 - protein, 123 aa, Artificial Sequence
  anti-HIV_Chain
EIVLTQSPTTLSLSPGERATLSCRASQGVNLVVWYQQKRGQAPRLLIYGPSDRAPGVPDRFSARGSGTEFSLVISSVEPDDFALYYCQEYSSTPYNFGTGTRVDRKRTVAAPSVFIFPPSDEQ

SEQ ID NO: 4197 - protein, 123 aa, Artificial Sequence
  anti-HIV_Chain
EIVLTQSPATLSLSPGERATLSCRASQGVNFVVWYQQKRGQAPRLLIYGPSNRAPGVPDRFSARGSGTEFSLVISSVEPDDFALYYCQEYSSTPYNFGPGTRVDRKRTVAAPSVFIFPPSDEQ

SEQ ID NO: 4198 - protein, 123 aa, Artificial Sequence
  anti-HIV_Chain
EIVLTQSPATLSLSPGERATLSCRASQGLNFVVWYQQKRGQAPRLLIHGPSHRAPGVPDRFSARGSGTEFSLVISSVEPDDFAIYYCQEYSSTPYNFGPGTRVDRKRTVAAPSVFIFPPSDEQ

SEQ ID NO: 4199 - protein, 123 aa, Artificial Sequence
  anti-HIV_Chain
EIVLTQSPATLSLSPGERATLSCRASQGLNFVVWYQQKGGQAPRLLIHGPTDRAPGVPDRFSARGSGTEFSLVISSVEPDDFALYYCQEYSSTPYNFGPGTRVDRKRTVAAPSVFIFPPSDEQ

SEQ ID NO: 4200 - protein, 123 aa, Artificial Sequence
  anti-HIV_Chain
EIVLTQSPATLSLSPGERATLSCRASQGLNFVVWYQQKRGQAPRLLIHAPSGRAPGVPDRFSARGSGTEFSLVISSVEPDDFAIYYCQEYSSTPYNFGPGTRVDRKRTVAAPSVFIFPPSDEQ

SEQ ID NO: 4201 - protein, 123 aa, Artificial Sequence
  anti-HIV_Chain
QVQLVQSGAEVKKPGSSVKVSCKTSGGSFSNYAFSWVRQAPGEGLEWMGRIIPIFGTAKYTQKLQGRVTITADKFTSTVYMELSSLRSEDTAIYYCASLHQGPIGYTPWHPPPRAPLGQSVCG

SEQ ID NO: 4202 - protein, 123 aa, Artificial Sequence
  anti-HIV_Chain
QVQLVESGGGLVQPGGSLRISCSATGFTFSTHAMHWVRQAPGKGLEYVSAINSNGRSAFYADSVKGRVTISRDNSKNTLFLQMTSLRAEDTAVYYCVKGPLLRYLDSWGQGTLVTVSSASTKG

SEQ ID NO: 4203 - protein, 123 aa, Artificial Sequence
  anti-HIV_Chain
EVQLVESGGGLVQPGGSLRISCSATGFTFSTHAMHWVRQAPGKGLEYVSAINSNGRSAFYADSVKGRVTISRDNSKNTLFLQMTSLRAEDTAVYYCVKGPLLRYLDSWGQGTLVTVSSASTKG

SEQ ID NO: 4204 - protein, 123 aa, Artificial Sequence
  anti-HIV_Chain
EESGPGLVKPSQTLSLTCSVSGDSVSSGGYFWSWIRQHPTKGLECLGYVYYTGNTYYNPSLKSPPTIEVAMANNQVSLKLGSVTAADTAVYYCARIKRFRGGNYFDTWGHGLLVTVSSASTKG

SEQ ID NO: 4205 - protein, 123 aa, Artificial Sequence
  anti-HIV_Chain
QVQLQESGSGLVKPSGTLSLTCAVSNGPISSGNWWSWVRQTPEKGLEWIGEVYHSGSTNHNPSLKSRATILVDKSKNQFSLNLRSVTAADTAVYYCARVRGSWNFDYWGQGILVTVSSASTKG

SEQ ID NO: 4206 - protein, 123 aa, Artificial Sequence
  anti-HIV_HeavyChain
EVQLQQSGTVLARPGASVKMSCKASGYTFTSYWMHWVKQRPGQGLEWIGAIYPGNSDTSYNQKFKGKAKLTAVTSASTAYMELSSLTNEDSAVYYCTRWPHYYGGSRYYFDYWGQGTTLTVSS

SEQ ID NO: 4207 - protein, 124 aa, Artificial Sequence
  anti-HIV_Chain
VVQLVESGGGLVQPGGSLRLSCAASGFAFRSYWMSWVRQAPGRGLEWVANIKQDGSEKYYADSVKGRFTISRDNTKNSLYLQMNSLRAEDTAVFYCASRGDRYGPIDYWGQGTLVTVSSASTKG

SEQ ID NO: 4208 - protein, 124 aa, Artificial Sequence
  anti-HIV_Chain
QVQLVQSGAEIKKPGESLKISCKASGYTFNDYWIGWVRQMPGKGLEWMGIFYPDDSDSNYSPSFQGRVTISADKSITTAYLQWSTLKASDSAMYFCARLLGDSGAFDIWGQGTMVIVSSASTKG

SEQ ID NO: 4209 - protein, 124 aa, Artificial Sequence
  anti-HIV_Chain
QVQLVQSGGGLVKPGGSLRLSCAASGFTFSSYSMNWVRQAPGKGLEWVSSISSSSSYIYYADSVKGRFTISRDNAKNSLYLQMNSLRAEDTAVYYCAREGSYYYGMDVWGQGTTVTVSSASTKG

SEQ ID NO: 4210 - protein, 124 aa, Artificial Sequence
  anti-HIV_Chain
EIVLTQSPATLSVSPGERATLSCRAGQSVSSDLAWYQHKPGQAPRLLIYDASKRATGIPARFSGSGSGTDFTLTISSLEPEDFAVYYCQHRTNWPPSITFGQGTRLEIKRTVAAPSVFIFPPSD

SEQ ID NO: 4211 - protein, 124 aa, Artificial Sequence
  anti-HIV_Chain
EIVLTQSPGTLSLSPGERATLSCRASQSVSSRYLAWYQQKPGQAPRLIIYDASSRASGIPDRFSGSGSETDFTLTITRLEPEDFAVYYCQLYGTSPKFTFGQGTKLEIKRTVAAPSVFIFPPSD

SEQ ID NO: 4212 - protein, 124 aa, Artificial Sequence
  anti-HIV_Chain
EIVLTQSPGTLSLSPGERATLSCRASQSVSNNYLAWYQQKPGQAPRLLIYGASSRATGIPDRFSGSGSGTDFTLTISRLEPEDFAVYYCQQYATSSLYTFGQGTKLEIKRTVAAPSVFIFPPSD

SEQ ID NO: 4213 - protein, 124 aa, Artificial Sequence
  anti-HIV_Chain
PATLAVSPGERATISCKSSQNLLYSANNQHSLAWYQQRPGQPPKLLLYWASTRLSGVPDRFSGSGSGTDFTLTISNLQAEDVAVYYCQQYYSPPPTFGQGTKVEIRRTVAAPSVFIFPPSDEQL

SEQ ID NO: 4214 - protein, 124 aa, Artificial Sequence
  anti-HIV_Chain
QPVLTQPPSASGAPGQRVTISCSGGPSNVGGNYVYWYRQFPGTAPNLLILRDDQRPSGVPDRFSASKSGNSASLAITGLRPDDEAFYFCATYDSDGSIRLFGGGTALTVLSQPKAAPSVTLFPP

SEQ ID NO: 4215 - protein, 124 aa, Artificial Sequence
  anti-HIV_Chain
NFMLTQPPSASGAPGQRVTISCSGGPSNVGGNYVYWYRQFPGTAPNLLILRDDQRPSGVPDRFSASKSGNSASLAISGLRPDDEAFYFCATYDSDGSIRLFGGGTTLTVLSQPKAAPSVTLFPP

SEQ ID NO: 4216 - protein, 124 aa, Artificial Sequence
  anti-HIV_Chain
DIQMTQSPPSLSASVGDRVTITCQASQDINNFLNWYQQKPGKAPRLLIYDASNLESGVSSRFSGSRSGTDFTLTISSLLPEDIATYSCQQYSNLPYTFSQGTKLEIKRTVAAPSVFIFPPSDEQ

SEQ ID NO: 4217 - protein, 124 aa, Artificial Sequence
  anti-HIV_Chain
QVQLVQSGTAVKRPGASVRVSCQASGYTFIDHFIYWWRQAPGQGLEWLGWINPLTSQPSYPSRFQGRLTLTRDTFDEMLYMDLRGLRSDDTGIYFCARRHSDYCDFDIWGSGTQIIVSSASTKG

SEQ ID NO: 4218 - protein, 124 aa, Artificial Sequence
  anti-HIV_Chain
QVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQVIVSSASTKG

SEQ ID NO: 4219 - protein, 124 aa, Artificial Sequence
  anti-HIV_Chain
QVQLVQSGAALKKPGASLRISCQTYGYKFTDHLIYWWRQAPGQGLEWMGWIKPETGQPSYSYRFQGRVSLTRDTFEEIVFMDLRGLRSDDTAIYFCARRHSDYCDFDVWGSGSQVIVSSASTKG

SEQ ID NO: 4220 - protein, 124 aa, Artificial Sequence
  anti-HIV_Chain
QVQLVQSGAALKKPGASLRISCQTYGYKFTDHLIYWWRQAPGQGLEWIGWIKPETGQPSYSYRFQGRVSLTRDTFEEIAFMDLRGLRSDDTAIYFCARRHTDYCVFDVWGSGSQIIVSSASTKG

SEQ ID NO: 4221 - protein, 124 aa, Artificial Sequence
  anti-HIV_Chain
QVQLVQSGTAVKRPGASVRVSCQASGYTFTDYFIYWWRQAPGQGLEWLGWINPLTSQPSYPSRFQGRLTLTRDTFDEMLYMDLRGLRSDDTGIYFCARRHSDYCDFDIWGSGTQIIVSSASTKG

SEQ ID NO: 4222 - protein, 124 aa, Artificial Sequence
  anti-HIV_Chain
QVQLVQSGAALKKPGASVRISCQAYGYKFTDHLIYWWRQAPGQGLEWIGWIKPETGQPSYAYKFQGRVTLTRDTFEEIHFMDLRGVRNDDTATYFCARRHSDYCDFDVWGSGSQVIVSSASTKG

SEQ ID NO: 4223 - protein, 124 aa, Artificial Sequence
  anti-HIV_Chain
QVQLVQSGAALKKPGASVRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVLVSSASTKG

SEQ ID NO: 4224 - protein, 124 aa, Artificial Sequence
  anti-HIV_Chain
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVLVSSASTKG

SEQ ID NO: 4225 - protein, 124 aa, Artificial Sequence
  anti-HIV_Chain
QVQLVQSGAALKKPGASVRISCQTYGYKFTDHLIHWWRQAPGQGLEWIGWIKPDTGQPSYSSRFQGRVSLTRDTFEEIVFMDLRGLRSDDTAIYFCARRHSDYCDFDVWGSGSQVLVSSASTKG

SEQ ID NO: 4226 - protein, 124 aa, Artificial Sequence
  anti-HIV_Chain
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVIVSSASTKG

SEQ ID NO: 4227 - protein, 124 aa, Artificial Sequence
  anti-HIV_Chain
QVQLVQSGAALKKPGASLRISCQTYGYKFTDHLIYWWRQAPGQGLEWIGWIKPETGQPSYSYRFQGRVSLTRDTFEEIVFMDLRGLRSDDTAIYFCARRHSDYCDFDVWGGGSQVIVSSASTKG

SEQ ID NO: 4228 - protein, 124 aa, Artificial Sequence
  anti-HIV_Chain
QVQLVQSGAALKKPGASLRISCLTYGYKFTDHLIYWWRQAPGQGLEWIGWIKPETGQPSYSYRFQGRVSLTRDTFEEIVFMDLRGLRSDDTAIYFCARRHSDYCDFDVWGSGSQVIVSSASTKG

SEQ ID NO: 4229 - protein, 124 aa, Artificial Sequence
  anti-HIV_Chain
QVQLVQSGATLKKPGASVRISCQAYGYKFTDHLIHWWRQAPGQGLEWIGWIKPETGQPSYAYKFQGRVSLTRDTFEEILFMDLRGLRSDDTAIYFCARRHSDYCDLDVWGGGTQLLVSSASTKG

SEQ ID NO: 4230 - protein, 124 aa, Artificial Sequence
  anti-HIV_Chain
QVQLVQSGAALKKPGASVRISCQAYGYKFTDHLIYWWRQAPGQGLEWIGWIKPETGQPSYSYKFQGRVTLTRDTFEEIHFMDLRGLRYDDTATYFCARRHSDYCDFDVWGSGSQVSVSSASTKG

SEQ ID NO: 4231 - protein, 124 aa, Artificial Sequence
  anti-HIV_Chain
QVQLVQSGAALKKPGASLRISCQAYGYKFTDHLIYWWRQAPGQGLEWIGWIKPETGQPSYSYKFQGRVSLTRDTFQEILFMNLRGLRSDDTAIYFCARRHSDYCDFDVWGSGSQILVSSASTKG

SEQ ID NO: 4232 - protein, 124 aa, Artificial Sequence
  anti-HIV_Chain
QVQLVQSGTAVKKPGASVRVSCQASGYTFTDYFIYWWRQAPGQGLEWLGWINPRTSQPSYPYRFQGRVTLTRDIFEEMLYMDLRGLRSDDTGIYFCARRHSDYCDFDIWGSGTQIIVSSASTKG

SEQ ID NO: 4233 - protein, 124 aa, Artificial Sequence
  anti-HIV_Chain
QVQLVQSGAALKKPGASLRISCQAYGYKFTDYLIHWWRQAPGQGLEWIGWIKPETGQPSYSYKFQGRVSLTRDTFEEILFMDLRGLRSDDTAIYFCARRHSDYCDFDVWGGGSQVLVSSASTKG

SEQ ID NO: 4234 - protein, 124 aa, Artificial Sequence
  anti-HIV_Chain
EVQLLESGGALVQPGGSLRLSCAASGFTFSTSSMSWVRQAPGKGLEWVSAIGSGRGSTFYADSVKGRFTISRDNSKNTLSLQMNSLTAEDTATYYCTKTGGLLRFPEVWGKGTTVTVSSASTKG

SEQ ID NO: 4235 - protein, 124 aa, Artificial Sequence
  anti-HIV_Chain
EVQLVESGGGLVKPGGSLRLSCADSGFTFRSYSMHWVRQAPGKGLAWVSSISSTSNYIYYADSVKGRFTISRDNAKNSLYLQMNSLRAEDTAVYYCARTFITASWFDSWGQGTLVTVSSASTKG

SEQ ID NO: 4236 - protein, 124 aa, Artificial Sequence
  anti-HIV_Chain
QVQLVQSGAEVKKPGASVKVSCKASGYTFTNYGVSWVRQAPGQGLEWMGWISPYSGNTNYAQRLQDRVTMTTDTSTNTAYMELRSLRSDDTAVYYCAARSYYYYSMDVWGQGTTVTVSSASTKG

SEQ ID NO: 4237 - protein, 124 aa, Artificial Sequence
  anti-HIV_Chain
QVQLVQSGAELKKPGSSVKVSCKASGGTFSNYAINWVRQAPGQGFEWMGGIIPLFATPTYAQKFQGRVRITADDSTSTAYMELSSLRSDDTAVYFCARPNVVRSALDYWGQGTLVTVSSASTKG

SEQ ID NO: 4238 - protein, 124 aa, Artificial Sequence
  anti-HIV_Chain
QVQLVESGGGVVQPGKSLRLSCAASGFTFSTHAMHWVRQAPGKGLDWVAVISHDGDNQYYADAVKGRFTISRDDSRDTVFLQMNSLRTEDTGVYYCAADSSGSNWFDYWGQGILVTVSSASTKG

SEQ ID NO: 4239 - protein, 125 aa, Artificial Sequence
  anti-HIV_Chain
QVRLSQSGGQMKKPGESMRLSCRASGYEFLNCPINWIRLAPGRRPEWMGWLKPRGGAVNYARKFQGRVTMTRDVYSDTAFLELRSLTSDDTAVYFCTRGKYCTARDYYNWDFEHWGRGAPVTVSS

SEQ ID NO: 4240 - protein, 125 aa, Artificial Sequence
  anti-HIV_Chain
EVQLVQSGSDVRKPGATVTVSCKADEDEDDFTAYNYFMHWVRQAPGHGLEWIGWINPRTGQPNHAKQFQGRVTLTRERSTSTVFMKLTNLRLDDTAVYFCARPLRGGDTWHYHSWGRGTSLTVSS

SEQ ID NO: 4241 - protein, 125 aa, Artificial Sequence
  anti-HIV_Chain
QVQLVQSGGGLVQPGESLRLSCTASGFTFSSYNMNWVRQAPGKGLEWISYISDKSKNKYYADSVRGRFTISRDNAQNSLFLQMSSLRDEDTAVYYCTREGPQRSFYFDYWGQGIQVTVSSASTKG

SEQ ID NO: 4242 - protein, 125 aa, Artificial Sequence
  anti-HIV_Chain
EVQLVESGAEVKKPGSSVKVSCKASGGTFSSYSISWVRQAPGQGLEWMGGIIPIFATTHYGQKFQGRIKITADKSTSTAYMELSRLRSEDTAVYYCARDREFYFYGMDVWGQGTTVTVSSASTKG

SEQ ID NO: 4243 - protein, 125 aa, Artificial Sequence
  anti-HIV_Chain
QLQLQESGPGLVKPWETLVLTCSVSGGSISSGDYYWGWIRQSPGKGPEWIGNIFYSSGNTYYNTSLKSRVTISVDVSKNRFSLKLTSMTAADTAVYYCGRLSNKGWFDPWGQGTLVSVSSASTKG

SEQ ID NO: 4244 - protein, 125 aa, Artificial Sequence
  anti-HIV_Chain
EIVLTQSPATLSLSPGERATLSCRASQSVSSYLAWYQQKPGQAPRLLIYDASNRATGIPARFSGSGSDTDFTLTISSLEPEDFAVYYCQQRGIWPLQITFGQGTRLEIKRTVAAPSVFIFPPSDE

SEQ ID NO: 4245 - protein, 125 aa, Artificial Sequence
  anti-HIV_Chain
SEIVLTQSPGTLSLSPGERATLSCRASQSVSSSYLAWYQQKPVQAPRLLIYGASSRATGIPDRFSGSGSGTDFTLTISRLEPEDFAVYYCQQYGTLHPRTFGQGTKVEIKRTVAAPSVFIFPPSD

SEQ ID NO: 4246 - protein, 125 aa, Artificial Sequence
  anti-HIV_Chain
SQAVVTQPPSVSGAPGQRVTISCSGGPSNVGGNLVYWYKQFPGTAPKLLIRRDDQRPSGVPDRFSGSKSGNSASLAISGLRPDDEAFYFCATYDSHGSIRLFGGGTLLTVLSQPKAAPSVTLFPP

SEQ ID NO: 4247 - protein, 125 aa, Artificial Sequence
  anti-HIV_Chain
DIQMTQSPSTLAASIGGTVRVSCRASQSITGNWVAWYQQRPGKAPRLLIYRGAALLGGVPSRFSGSAAGTDFTLTIGNLQAEDFGTFYCQQYDTYPGTFGQGTKVEVKRTVAAPSVFIFPPSDEQ

SEQ ID NO: 4248 - protein, 125 aa, Artificial Sequence
  anti-HIV_Chain
EIVMTQSPDTLSVSPGERATLSCRASQSVNSNLAWYQQKPGQAPRLLIYGASTRATAVPARFSGSGSGTEFTLTISSLQSEDSAVYYCQQYYQWLSYTFGQGTKLEIKRTVAAPSVFIFPPSDEQ

SEQ ID NO: 4249 - protein, 125 aa, Artificial Sequence
  anti-HIV_Chain
RQVQLVQSGAALKKPGASLRISCQAYGYKFTDHLIYWWRQAPGQGLEWIGWIKPETGQPSYSYKFQGRVSLTRDTFQEILFMDLRGLRSDDTAIYFCARRHSDYCDFDVWGSGSQILVSSASTKG

SEQ ID NO: 4250 - protein, 125 aa, Artificial Sequence
  anti-HIV_Chain
QVQLVQSGAALKKPGASVRISCQAYGYKFTDYLIHWWRQAPGQGLEWIGWIKPETGQPSYSYKFQGRVTLTRDTFEEILFMDLRGLRSDDTAIYFCARRHSDYCDFDVWGSGSQVIVSSASTKGA

SEQ ID NO: 4251 - protein, 125 aa, Artificial Sequence
  anti-HIV_Chain
EVQLVESGGGLVKPGGSLRLSCAASGFSFSEHYMSWIRLAPGKGLEWLSYISSSTRTTYSADSVRGRFTISRDTAKQLLFLHMSSLRAEDTAVYYCVRLYGGINGWFDQWGQGTLVSVSSASTKG

SEQ ID NO: 4252 - protein, 125 aa, Artificial Sequence
  anti-HIV_Chain
QVQLVQSGPGLVKPSETLSLTCSVSNGSISSGGYYWSWLRQFPGKGLEWIGSIHYTGRTFYNPSLMGRTALSMDTSNNQFSLKVSSVTAADTALYYCARELQWMFVVDPWGQGTLVTVSSASTKG

SEQ ID NO: 4253 - protein, 125 aa, Artificial Sequence
  anti-HIV_Chain
QVQLQESGPGLVKPSETLSLTCSVSNGSISSGGYYWSWLRQFPGKGLEWIGSIHYTGRTMYNPSLMGRPALSMDTSNNQFSLKLRSVTAADTALYFCARDLQWIFVVDPWGQGTLVTVSSASTKG

SEQ ID NO: 4254 - protein, 125 aa, Artificial Sequence
  anti-HIV_Chain
EVQLLESGGGLVQPGGSLRLSCAVSGFTFGGHAVSWVRQAPGKGLEWLSQISGTGSRTDYADAVKGRFTVSRDNSKKTVYLQMNSLRVEDTALFYCATRSPGGGYAFDIWGQGAMVTVSSASTKG

SEQ ID NO: 4255 - protein, 125 aa, Artificial Sequence
  anti-HIV_Chain
QVQLVQSGAEVKKPGSSVKVSCKVSFFSNYGISWVRQRPGQGLEWMGRIIPAIDDMTYAQTFRGRVTFSADKFTTTAYMELTGLTFEDTATYFCARDPQVNRRGNCFDHWGQGTLVTVSSASTKG

SEQ ID NO: 4256 - protein, 125 aa, Artificial Sequence
  anti-HIV_Chain
QVQLQESGPGLVKPSETLSLTCTVSGGSISYYYWSWIRQPPGKGLEWIGDIYYSGTTDYNPSLKSRVTISVDTSKNQFSLKLSSVTAADTAVYYCARRRGQRLLAYFDYWGQGSLVTVSSASTKG

SEQ ID NO: 4257 - protein, 125 aa, Artificial Sequence
  anti-HIV_Chain
QVQLQESGPGPVKPSETLSLTCTVSGGSMISYYWSWIRQPPGKGLEWIGYIFTNGRTTYSPSLRSRVTISLDTSTNHFSLRLKSVTAADTAIYYCARLDGEAFRYYLDLWGQGNLVTVSSASTKG

SEQ ID NO: 4258 - protein, 125 aa, Artificial Sequence
  anti-HIV_Chain
QVQLVQSGAEVKKPGASVKVSCKPSSNTFTSHYIHWVRQAPGQGLEWMGMINPGGSTRYAPKFQGRVTLTRDTSTRTVYMELSSLRSEDTAVYYCARPQYNLGRDPLDVWGLGTMVTVSSASTKG

SEQ ID NO: 4259 - protein, 125 aa, Artificial Sequence
  anti-HIV_Chain
QVQLQQWGAGLLKPSETLSLTCAVYGGSFSGYYWSWIRQPPGKGLEWIGEINHSGSTNYNPSLKSRVTISVDTSKNQFSLKLSSVTAADTAVYYCARLPIGSGWYGRDYWGQGTLVTVSSASTKG

SEQ ID NO: 4260 - protein, 125 aa, Artificial Sequence
  anti-HIV_Chain
QVQLVQSGAEVKKPGASVKVSCKASGNTFTSYGITWVRQAPGQGLEWMGWISAYNGNTNYAQKLQDRLTMTTDTSTSTAYMELRSLRSDDTAVYYCAFSRHYGSGNYDYWGQGTLVTVSSASTKG

SEQ ID NO: 4261 - protein, 125 aa, Artificial Sequence
  anti-HIV_Chain
QFRLVQSGPEVKNPGSSVTVSCKASGGTFSGLGINWVRQAPGQGLEWLGDIKTMYGTTNYAPKFQGRVTITADESTSTSYMELSGLRSEDTAVFYCVRELFGHHPAFGVWGQGTSVIVSSASTKG

SEQ ID NO: 4262 - protein, 125 aa, Artificial Sequence
  anti-HIV_Chain
RVQLVQSGAEVKKPGSSVTVSCKASGGSFSSYAISWVRQAPGQGLEWVGGVKVMFGTVHYSQKVQGRVTITADDSTGTSYLELSGLRSADTAVYYCARNAGAYFYPFDIWGQGTLIIVSSASTKG

SEQ ID NO: 4263 - protein, 125 aa, Artificial Sequence
  anti-HIV_Chain
QVQLQESGPGLVKPSETLSLTCTVSGGSISSRSYYWGWIRQPPGKGLEWVGSIYYTGSTYYSPSLKSRVTISVDTSQNQFSLKLNSVTAADTAVYYCARQKGSGTSLLYWGQGTLVTVSSASTKG

SEQ ID NO: 4264 - protein, 125 aa, Artificial Sequence
  anti-HIV_Chain
QVQLVQSGTEVKKPGSSVKVSCKASGGTFSDSDIAWVRQAPGQGLEWMGGITPMFDMAKSAQKFRGRLIITADKSTGTAYMELSSLRYEDAAVYFCARSSGNFEFAFEIWGQGTKIIVSLASTKG

SEQ ID NO: 4265 - protein, 125 aa, Artificial Sequence
  anti-HIV_Chain
VVQLVQSGTEVKKPGSSVKVSCKASGGTFSGSDISWVRQAPGQGLEWMGGIIPMFDIEDHAQKFRGRLTITADKSTGAAYMELSSLRSEDAAVYYCARSSGNYDFAFDIWGQGTRLIVSSASTKG

SEQ ID NO: 4266 - protein, 125 aa, Artificial Sequence
  anti-HIV_Chain
VVQLVESGTEVKKPGSSVKVSCKASGGTFSGSDISWVRQAPGQGLEWMGGIIPMFDIENHAEKFRGRLTITAVKSTGAAYMELSSLRSEDAAVYYCARSSGNYDFAYDIWGQGTRVIVSSASTKG

SEQ ID NO: 4267 - protein, 126 aa, Artificial Sequence
  anti-HIV_Chain
QVQLVQSGSAMKKPGASVRVSCWTSEDIFDTTELIHWVRQAPGQGLEWIGWVKAVSGAVNYGSLDFRHRVSLTRDRDLSTAHMDIRGLTQDDTATYFCARQKFARGDQGWFFDLWGRGTLIVVSSA

SEQ ID NO: 4268 - protein, 126 aa, Artificial Sequence
  anti-HIV_Chain
QVQLQESGPGLVKPSETLSLTCTVSGGSISNHYWSWIRQPPGKGLEWIGYIYHSGNINYKSSLKSRATISIDTSNNQFSLKLSSVIAADTAVYYCARNFGPGSPNYGMDVWGQGTTVTVSSASTKG

SEQ ID NO: 4269 - protein, 126 aa, Artificial Sequence
  anti-HIV_Chain
QVQLVQSGGGVVQPGRSLRLSCAASGFTFSHHGIHWVRQAPGEGLEWVAVISEDGTNIHYEDSVRGRFTISRDNSKNTVDLQMNSLRAEDTAVYYCASLISMRDGDAFDLWGQGTRVTVSSASTKG

SEQ ID NO: 4270 - protein, 126 aa, Artificial Sequence
  anti-HIV_Chain
QVQLVESGGGLGQPGGSLRLSCAASGFTFRNYAMSWVRQAAGKGLEWVSGVSGGGDTTYYGDSVKGRFTISRDNSKNTLYLQMNNLRAEDTAVYYCAKDKGVWGSSDFDYWGQGTLVTVSSASTKG

SEQ ID NO: 4271 - protein, 126 aa, Artificial Sequence
  anti-HIV_Chain
EVQLVESGGGVVQPGRSLRLSCAASGFTFSHHGIHWVRQAPGEGLEWVAVISEDGTNIHYEDSVRGRFTISRDNSKNTVDLQMNSLRAEDTAVYYCASLISMRDGDAFDLWGQGTRVTVSSASTKG

SEQ ID NO: 4272 - protein, 126 aa, Artificial Sequence
  anti-HIV_Chain
RGPVTLAVSLGERATITCKSSQSVLVHSNNKNYLSWYQQKPGQPPKLLIYWASTRESGVPERFSGSGSGTDFTLSISSLQAEDVAVYYCHQYFSTPRTFGQGTKVEIKGTVAAPSVFIFPPSDEQL

SEQ ID NO: 4273 - protein, 126 aa, Artificial Sequence
  anti-HIV_Chain
SEIVMTQSPATLSMSPGERATLSCRASLSVNTNLAWYQQKPGQAPRLLIYGASTRATGIPARFSGSGSGTEFTLTISSLQSEDFALYYCQQYNHWPQTFGQGTKVEIKRTVAAPSVFIFPPSDEQK

SEQ ID NO: 4274 - protein, 126 aa, Artificial Sequence
  anti-HIV_Chain
SEIVLTQSPATLSLSPGERATLSCRASQSINNYLAWYQQKPGQAPRLLIYDASNRATGIPARFSGGGSGTDFTLTISSLEPEDFAVYYCQQRANWRLLTFGGGTKVEIKRTVAAPSVFIFPPSDEQ

SEQ ID NO: 4275 - protein, 126 aa, Artificial Sequence
  anti-HIV_Chain
QVQLVQSGGAVKKPGASVKVSCETYGYTFTDHFMHWWRQAPGQGLEWMGWINPYSSAVSYSPRYQGRVTMTRDTFLETVYMELRGLKFDDTAIYYCATPKSGRDYWSFDLWGQGTLVTVSSASTKG

SEQ ID NO: 4276 - protein, 126 aa, Artificial Sequence
  anti-HIV_Chain
SQVQLVESGPGLVKPSETLSLTCSVSNGSISSGGYYWSWLRQFPGKGLEWIGSIHYTGRTMYNPSLMGRPALSMDTSNNQFSLKLSSVTAADTALYFCARDLQWIFVVDPWGQGTLVTVSSASTKG

SEQ ID NO: 4277 - protein, 126 aa, Artificial Sequence
  anti-HIV_Chain
SVVQLVESGPGLVKPSETLSLTCSVSNGSISSGGYYWSWLRQFPGKGLEWIGSIHYTGRTMYNPSLMGRPALSMDTSNNQFSLKLRSVTAADTALYFCARDLQWIFVVDPWGQGTLVTVSSASTKG

SEQ ID NO: 4278 - protein, 126 aa, Artificial Sequence
  anti-HIV_Chain
SGGRLVQPGGSLRLSCSASGFTLSNSAMSWVRQAPGKGLEWVSSILSSGVGTFYADSVKGRFTVSRDNSRNTLYLQMKSLRAEDTALYYCAKVQIQQLNFGVITDAGLDVWGKGTTLIVSSASTKG

(The sequence listing continues in the following parts.)

The invention claimed is:

1. A composition comprising:
   (I) an RNA comprising
      (a) at least a first coding sequence, wherein the first coding sequence comprises a nucleic acid sequence at least 90% identical to the RNA sequence of SEQ ID NO: 61574 and encoding a polypeptide according to SEQ ID NO: 61573; and
      (b) at least a second coding sequence, wherein the second coding sequence comprises a nucleic acid sequence at least 90% identical to the RNA sequence of SEQ ID NO: 61585 and encoding a polypeptide according to SEQ ID NO: 61584, wherein the first coding sequence and the second coding sequence are present in the same RNA molecule; or
   (II)
      (a) at least a first RNA molecule comprising at least a first coding sequence, wherein the first coding sequence comprises a nucleic acid sequence at least 90% identical to the RNA sequence of SEQ ID NO: 61574 and encoding a polypeptide according to SEQ ID NO: 61573; and
      (b) at least a second RNA molecule comprising at least a second coding sequence, wherein the second coding sequence comprises a nucleic acid sequence at least 90% identical to the RNA sequence of SEQ ID NO: 61585 and encoding a polypeptide according to SEQ ID NO: 61584.

2. The composition according to claim 1, comprising:
(I) an RNA comprising
  (a) at least a first coding sequence, wherein the first coding sequence comprises a nucleic acid sequence at least 90% identical to the RNA sequence of SEQ ID NO: 61574 and encoding a polypeptide according to SEQ ID NO: 61573; and
  (b) at least a second coding sequence, wherein the second coding sequence comprises a nucleic acid sequence at least 90% identical to the RNA sequence of SEQ ID NO: 61585 and encoding a polypeptide according to SEQ ID NO: 61584, wherein the first coding sequence and the second coding sequence are present in the same RNA molecule.

3. The composition according to claim 1, comprising:
(II)
  (a) at least a first RNA molecule comprising at least a first coding sequence, wherein the first coding sequence comprises a nucleic acid sequence at least 90% identical to the RNA sequence of SEQ ID NO: 61574 and encoding a polypeptide according to SEQ ID NO: 61573; and
  (b) at least a second RNA molecule comprising at least a second coding sequence, wherein the second coding sequence comprises a nucleic acid sequence at least 90% identical to the RNA sequence of SEQ ID NO: 61585 and encoding a polypeptide according to SEQ ID NO: 61584.

4. The composition according to claim 3, wherein the first and/or the second RNA is monocistronic.

5. The composition according to claim 3, wherein the first and the second RNA is mRNA.

6. The composition according to claim 5, wherein
the G/C content of the first and second coding sequences of the RNAs is increased compared to the G/C content of the corresponding coding sequence of the corresponding wild-type RNA, and/or wherein
the C content of the first and second coding sequences of the RNAs is increased compared to the C content of the corresponding coding sequence of the corresponding wild-type RNA, and/or wherein
the codons in the first and second coding sequences of the RNA are adapted to human codon usage.

7. The composition according to claim 5, wherein the first and the second RNA comprise a 5'-CAP structure and at least one 3'-untranslated region element (3'-UTR element).

8. The composition according to claim 5, wherein the first and/or the second RNA comprises at least one histone stem-loop.

9. A method of treating cancer, wherein the method comprises administering to a subject in need thereof an effective amount of the composition according to claim 1.

10. The method according to claim 9, further defined as a method of treating a metastatic cancer.

11. The composition according to claim 3, comprising:
(II)
  (a) at least a first RNA molecule comprising at least a first coding sequence, wherein the first coding sequence comprises a nucleic acid sequence at least 95% identical to the RNA sequence of SEQ ID NO: 61574 and encoding a polypeptide according to SEQ ID NO: 61573; and
  (b) at least a second RNA molecule comprising at least a second coding sequence, wherein the second coding sequence comprises a nucleic acid sequence at least 95% identical to the RNA sequence of SEQ ID NO: 61585 and encoding a polypeptide according to SEQ ID NO: 61584.

12. The composition according to claim 7, wherein the first and the second mRNAs comprise a modified nucleoside.

13. The composition according to claim 12, wherein the modified nucleoside is N1-methyl-pseudouridine.

14. The composition according to claim 2, wherein the RNA is a mRNA.

15. The composition according to claim 14, comprising:
(I) an RNA comprising
  (a) at least a first coding sequence, wherein the first coding sequence comprises a nucleic acid sequence at least 95% identical to the RNA sequence of SEQ ID NO: 61574 and encoding a polypeptide according to SEQ ID NO: 61573; and
  (b) at least a second coding sequence, wherein the second coding sequence comprises a nucleic acid sequence at least 95% identical to the RNA sequence of SEQ ID NO: 61585 and encoding a polypeptide according to SEQ ID NO: 61584.

16. The composition according to claim 14, wherein said first and said second coding sequences are separated by an internal ribosome entry site (IRES).

17. The composition according to claim 14, wherein the mRNA comprises a 5'-CAP structure and at least one 3'-untranslated region element (3'-UTR element).

18. The composition according to claim 17, wherein the mRNA comprises a modified nucleoside.

19. The composition according to claim 18, wherein the modified nucleoside is N1-methyl-pseudouridine.

* * * * *